United States Patent 11,446,398 (REGULATED BIOCIRCUIT SYSTEMS) - sequence listing, part 10

SEQ ID NO: 40611 - protein, 263 aa, Homo sapiens
  Payload ID: 8264
  Gene Symbol: IGFBP3
  Gene Name: insulin-like growth factor binding protein 3
  ENSP ID: ENSP00000480717
MQRARPTLWAACEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 40612 - protein, 258 aa, Homo sapiens
  Payload ID: 8265
  Gene Symbol: IGFBP4
  Gene Name: insulin-like growth factor binding protein 4
  Uniprot ID: P22692
  ENSP ID: ENSP00000269593
MLPLCLVAALLLAAGPGPSLGDEAIHCPPCSEEKLARCRPPVGCEELVREPGCGCCATCALGLGMPCGVYTPRCGSGLRCYPPRGVEKPLHTLMHGQGVCMELAEIEAIQESLQPSDKDEGDHPNNSFSPCSAHDRRCLQKHFAKIRDRSTSGGKMKVNGAPREDARPVPQGSCQSELHRALERLAASQSRTHEDLYIIPIPNCDRNGNFHPKQCHPALDGQRGKCWCVDRKTGVKLPGGLEPKGELDCHQLADSFRE

SEQ ID NO: 40613 - protein, 272 aa, Homo sapiens
  Payload ID: 8266
  Gene Symbol: IGFBP5
  Gene Name: insulin-like growth factor binding protein 5
  Uniprot ID: P24593
  ENSP ID: ENSP00000233813
MVLLTAVLLLLAAYAGPAQSLGSFVHCEPCDEKALSMCPPSPLGCELVKEPGCGCCMTCALAEGQSCGVYTERCAQGLRCLPRQDEEKPLHALLHGRGVCLNEKSYREQVKIERDSREHEEPTTSEMAEETYSPKIFRPKHTRISELKAEAVKKDRRKKLTQSKFVGGAENTAHPRIISAPEMRQESEQGPCRRHMEASLQELKASPRMVPRAVYLPNCDRKGFYKRKQCKPSRGRKRGICWCVDKYGMKLPGMEYVDGDFQCHTFDSSNVE

SEQ ID NO: 40614 - protein, 233 aa, Homo sapiens
  Payload ID: 8266
  Gene Symbol: IGFBP5
  Gene Name: insulin-like growth factor binding protein 5
  ENSP ID: ENSP00000413474
MVLLTAVLLLLAAYAGPAQSLGSFVHCEPCDEKALSMCPPSPLGCELVKEPGCGCCMTCALAEGQSCGVYTERCAQGLRCLPRQDEEKPLHALLHGRGVCLNEKSYREQVKIGCAPGGQRHICFSLYYSPHPKLPSPGLWPCAPWPTGADPPAPSPAERDSREHEEPTTSEMAEETYSPKIFRPKHTRISELKAEAVKKDRRKKLTQSKFVGGAENTAHPRIISAPEMRQESE

SEQ ID NO: 40615 - protein, 240 aa, Homo sapiens
  Payload ID: 8267
  Gene Symbol: IGFBP6
  Gene Name: insulin-like growth factor binding protein 6
  Uniprot ID: P24592
  ENSP ID: ENSP00000301464
MTPHRLLPPLLLLLALLLAASPGGALARCPGCGQGVQAGCPGGCVEEEDGGSPAEGCAEAEGCLRREGQECGVYTPNCAPGLQCHPPKDDEAPLRALLLGRGRCLPARAPAVAEENPKESKPQAGTARPQDVNRRDQQRNPGTSTTPSQPNSAGVQDTEMGPCRRHLDSVLQQLQTEVYRGAQTLYVPNCDHRGFYRKRQCRSSQGQRRGPCWCVDRMGKSLPGSPDGNGSSSCPTGSSG

SEQ ID NO: 40616 - protein, 238 aa, Homo sapiens
  Payload ID: 8267
  Gene Symbol: IGFBP6
  Gene Name: insulin-like growth factor binding protein 6
  ENSP ID: ENSP00000448953
MTPHRLLPPLLLLLALLLAASPGGALARCPGCGQGVQAGCPGGCVEEEDGGSPAEGCAEAEGCLRREGQECGVYTPNCAPGLQCHPPKDDEAPLRALLLGRGRCLPARAPAEENPKESKPQAGTARPQDVNRRDQQRNPGTSTTPSQPNSAGVQDTEMGPCRRHLDSVLQQLQTEVYRGAQTLYVPNCDHRGFYRKRQCRSSQGQRRGPCWCVDRMGKSLPGSPDGNGSSSCPTGSSG

SEQ ID NO: 40617 - protein, 136 aa, Homo sapiens
  Payload ID: 8267
  Gene Symbol: IGFBP6
  Gene Name: insulin-like growth factor binding protein 6
  ENSP ID: ENSP00000449344
MTPHRLLPPLLLLLALLLAASPGGALARCPGCGQGVQAGCPGGCVEEEDGGSPAEGCAEAEGCLRREGQECGVYTPNCAPGLQCHPPKDDEAPLRALLLGRGRCLPARAPAVLSSPRTLRKLSPEPGATCSCRGES

SEQ ID NO: 40618 - protein, 282 aa, Homo sapiens
  Payload ID: 8268
  Gene Symbol: IGFBP7
  Gene Name: insulin-like growth factor binding protein 7
  Uniprot ID: Q16270
  ENSP ID: ENSP00000295666
MERPSLRALLLGAAGLLLLLLPLSSSSSSDTCGPCEPASCPPLPPLGCLLGETRDACGCCPMCARGEGEPCGGGGAGRGYCAPGMECVKSRKRRKGKAGAAAGGPGVSGVCVCKSRYPVCGSDGTTYPSGCQLRAASQRAESRGEKAITQVSKGTCEQGPSIVTPPKDIWNVTGAQVYLSCEVIGIPTPVLIWNKVKRGHYGVQRTELLPGDRDNLAIQTRGGPEKHEVTGWVLVSPLSKEDAGEYECHASNSQGQASASAKITVVDALHEIPVKKGEGAEL

SEQ ID NO: 40619 - protein, 279 aa, Homo sapiens
  Payload ID: 8268
  Gene Symbol: IGFBP7
  Gene Name: insulin-like growth factor binding protein 7
  Uniprot ID: Q16270
  ENSP ID: ENSP00000486293
MERPSLRALLLGAAGLLLLLLPLSSSSSSDTCGPCEPASCPPLPPLGCLLGETRDACGCCPMCARGEGEPCGGGGAGRGYCAPGMECVKSRKRRKGKAGAAAGGPGVSGVCVCKSRYPVCGSDGTTYPSGCQLRAASQRAESRGEKAITQVSKGTCEQGPSIVTPPKDIWNVTGAQVYLSCEVIGIPTPVLIWNKVKRGHYGVQRTELLPGDRDNLAIQTRGGPEKHEVTGWVLVSPLSKEDAGEYECHASNSQGQASASAKITVVDALHEIPVKKGTQ

SEQ ID NO: 40620 - protein, 605 aa, Homo sapiens
  Payload ID: 8269
  Gene Symbol: IGFALS
  Gene Name: insulin-like growth factor binding protein, acid labile subunit
  Uniprot ID: P35858
  ENSP ID: ENSP00000215539
MALRKGGLALALLLLSWVALGPRSLEGADPGTPGEAEGPACPAACVCSYDDDADELSVFCSSRNLTRLPDGVPGGTQALWLDGNNLSSVPPAAFQNLSSLGFLNLQGGQLGSLEPQALLGLENLCHLHLERNQLRSLALGTFAHTPALASLGLSNNRLSRLEDGLFEGLGSLWDLNLGWNSLAVLPDAAFRGLGSLRELVLAGNRLAYLQPALFSGLAELRELDLSRNALRAIKANVFVQLPRLQKLYLDRNLIAAVAPGAFLGLKALRWLDLSHNRVAGLLEDTFPGLLGLRVLRLSHNAIASLRPRTFKDLHFLEELQLGHNRIRQLAERSFEGLGQLEVLTLDHNQLQEVKAGAFLGLTNVAVMNLSGNCLRNLPEQVFRGLGKLHSLHLEGSCLGRIRPHTFTGLSGLRRLFLKDNGLVGIEEQSLWGLAELLELDLTSNQLTHLPHRLFQGLGKLEYLLLSRNRLAELPADALGPLQRAFWLDVSHNRLEALPNSLLAPLGRLRYLSLRNNSLRTFTPQPPGLERLWLEGNPWDCGCPLKALRDFALQNPSAVPRFVQAICEGDDCQPPAYTYNNITCASPPEVVGLDLRDLSEAHFAPC

SEQ ID NO: 40621 - protein, 643 aa, Homo sapiens
  Payload ID: 8269
  Gene Symbol: IGFALS
  Gene Name: insulin-like growth factor binding protein, acid labile subunit
  Uniprot ID: P35858
  ENSP ID: ENSP00000416683
MALRKAGDLEPQFTPERRFRLCWYQAHSGRALLGPPPQASPPAGGLALALLLLSWVALGPRSLEGADPGTPGEAEGPACPAACVCSYDDDADELSVFCSSRNLTRLPDGVPGGTQALWLDGNNLSSVPPAAFQNLSSLGFLNLQGGQLGSLEPQALLGLENLCHLHLERNQLRSLALGTFAHTPALASLGLSNNRLSRLEDGLFEGLGSLWDLNLGWNSLAVLPDAAFRGLGSLRELVLAGNRLAYLQPALFSGLAELRELDLSRNALRAIKANVFVQLPRLQKLYLDRNLIAAVAPGAFLGLKALRWLDLSHNRVAGLLEDTFPGLLGLRVLRLSHNAIASLRPRTFKDLHFLEELQLGHNRIRQLAERSFEGLGQLEVLTLDHNQLQEVKAGAFLGLTNVAVMNLSGNCLRNLPEQVFRGLGKLHSLHLEGSCLGRIRPHTFTGLSGLRRLFLKDNGLVGIEEQSLWGLAELLELDLTSNQLTHLPHRLFQGLGKLEYLLLSRNRLAELPADALGPLQRAFWLDVSHNRLEALPNSLLAPLGRLRYLSLRNNSLRTFTPQPPGLERLWLEGNPWDCGCPLKALRDFALQNPSAVPRFVQAICEGDDCQPPAYTYNNITCASPPEVVGLDLRDLSEAHFAPC

SEQ ID NO: 40622 - protein, 131 aa, Homo sapiens
  Payload ID: 8269
  Gene Symbol: IGFALS
  Gene Name: insulin-like growth factor binding protein, acid labile subunit
  ENSP ID: ENSP00000456923
MTVGRRLPTALHGACQEAWPWRCCCCPGWHWAPAAWREQTPERRGKPRAQRARPPVSAATMTTRMSSASSAAPGTSRACLMESRAAPKPCGWTATTSRPSPRQPSRTSPAWASSTCRAASWAAWSHRRCWA

SEQ ID NO: 40623 - protein, 278 aa, Homo sapiens
  Payload ID: 8270
  Gene Symbol: IGFBPL1
  Gene Name: insulin-like growth factor binding protein-like 1
  Uniprot ID: Q8WX77
  ENSP ID: ENSP00000366923
MPRLSLLLPLLLLLLLPLLPPLSPSLGIRDVGGRRPKCGPCRPEGCPAPAPCPAPGISALDECGCCARCLGAEGASCGGRAGGRCGPGLVCASQAAGAAPEGTGLCVCAQRGTVCGSDGRSYPSVCALRLRARHTPRAHPGHLHKARDGPCEFAPVVVVPPRSVHNVTGAQVGLSCEVRAVPTPVITWRKVTKSPEGTQALEELPGDHVNIAVQVRGGPSDHEATAWILINPLRKEDEGVYQCHAANMVGEAESHSTVTVLDLSKYRSFHFPAPDDRM

SEQ ID NO: 40624 - protein, 510 aa, Homo sapiens
  Payload ID: 8271
  Gene Symbol: INSM1
  Gene Name: insulinoma-associated 1
  Uniprot ID: Q01101
  ENSP ID: ENSP00000312631
MPRGFLVKRSKKSTPVSYRVRGGEDGDRALLLSPSCGGARAEPPAPSPVPGPLPPPPPAERAHAALAAALACAPGPQPPPQGPRAAHFGNPEAAHPAPLYSPTRPVSREHEKHKYFERSFNLGSPVSAESFPTPAALLGGGGGGGASGAGGGGTCGGDPLLFAPAELKMGTAFSAGAEAARGPGPGPPLPPAAALRPPGKRPPPPTAAEPPAKAVKAPGAKKPKAIRKLHFEDEVTTSPVLGLKIKEGPVEAPRGRAGGAARPLGEFICQLCKEEYADPFALAQHKCSRIVRVEYRCPECAKVFSCPANLASHRRWHKPRPAPAAARAPEPEAAARAEAREAPGGGSDRDTPSPGGVSESGSEDGLYECHHCAKKFRRQAYLRKHLLAHHQALQAKGAPLAPPAEDLLALYPGPDEKAPQEAAGDGEGAGVLGLSASAECHLCPVCGESFASKGAQERHLRLLHAAQVFPCKYCPATFYSSPGLTRHINKCHPSENRQVILLQVPVRPAC

SEQ ID NO: 40625 - protein, 566 aa, Homo sapiens
  Payload ID: 8272
  Gene Symbol: INSM2
  Gene Name: insulinoma-associated 2
  Uniprot ID: Q96T92
  ENSP ID: ENSP00000306523
MPRGFLVKRTKRTGGLYRVRLAERVFPLLGPQGAPPFLEEAPSASLPGAERATPPTREEPGKGLTAEAAREQSGSPCRAAGVSPGTGGREGAEWRAGGREGPGPSPSPSPSPAKPAGAELRRAFLERCLSSPVSAESFPGGAAAVAAFSCSVAPAAAPTPGEQFLLPLRAPFPEPALQPDPAPLSAALQSLKRAAGGERRGKAPTDCASGPAAAGIKKPKAMRKLSFADEVTTSPVLGLKIKEEEPGAPSRGLGGSRTPLGEFICQLCKEQYADPFALAQHRCSRIVRVEYRCPECDKVFSCPANLASHRRWHKPRPAAANAATVSSADGKPPSSSSSSSRDSGAIASFLAEGKENSRIERTADQHPQARDSSGADQHPDSAPRQGLQVLTHPEPPLPQGPYTEGVLGRRVPVPGSTSGGRGSEIFVCPYCHKKFRRQAYLRKHLSTHEAGSARALAPGFGSERGAPLAFACPLCGAHFPTADIREKHRLWHAVREELLLPALAGAPPETSGPSGPSDGSAQQIFSCKHCPSTFFSSPGLTRHINKCHPSESRQVLLLQMPLRPGC

SEQ ID NO: 40626 - protein, 263 aa, Homo sapiens
  Payload ID: 8273
  Gene Symbol: ITM2A
  Gene Name: integral membrane protein 2A
  Uniprot ID: O43736
  ENSP ID: ENSP00000362395
MVKIAFNTPTAVQKEEARQDVEALLSRTVRTQILTGKELRVATQEKEGSSGRCMLTLLGLSFILAGLIVGGACIYKYFMPKSTIYRGEMCFFDSEDPANSLRGGEPNFLPVTEEADIREDDNIAIIDVPVPSFSDSDPAAIIHDFEKGMTAYLDLLLGNCYLMPLNTSIVMPPKNLVELFGKLASGRYLPQTYVVREDLVAVEEIRDVSNLGIFIYQLCNNRKSFRLRRRDLLLGFNKRAIDKCWKIRHFPNEFIVETKICQE

SEQ ID NO: 40627 - protein, 219 aa, Homo sapiens
  Payload ID: 8273
  Gene Symbol: ITM2A
  Gene Name: integral membrane protein 2A
  Uniprot ID: O43736
  ENSP ID: ENSP00000415533
MVKIAFNTPTAVQKEEARQDVEALLSRTVRTQILTGKSTIYRGEMCFFDSEDPANSLRGGEPNFLPVTEEADIREDDNIAIIDVPVPSFSDSDPAAIIHDFEKGMTAYLDLLLGNCYLMPLNTSIVMPPKNLVELFGKLASGRYLPQTYVVREDLVAVEEIRDVSNLGIFIYQLCNNRKSFRLRRRDLLLGFNKRAIDKCWKIRHFPNEFIVETKICQE

SEQ ID NO: 40628 - protein, 160 aa, Homo sapiens
  Payload ID: 8274
  Gene Symbol: ITM2B
  Gene Name: integral membrane protein 2B
  Uniprot ID: Q9Y287
  ENSP ID: ENSP00000367811
MVKVTFNSALAQKEAKKDEPKSGEEALIIPPDAVAVDCKDPDDVVPVGQRRAWCWCMCFGLAFMLAGVILGGAYLYKYFALQAGTYLPQSYLIHEHMVITDRIENIDHLGFFIYRLCHDKETYKLQRRETIKGIQKREASNCFAIRHFENKFAVETLICS

SEQ ID NO: 40629 - protein, 266 aa, Homo sapiens
  Payload ID: 8274
  Gene Symbol: ITM2B
  Gene Name: integral membrane protein 2B
  Uniprot ID: Q9Y287
  ENSP ID: ENSP00000367828
MVKVTFNSALAQKEAKKDEPKSGEEALIIPPDAVAVDCKDPDDVVPVGQRRAWCWCMCFGLAFMLAGVILGGAYLYKYFALQPDDVYYCGIKYIKDDVILNEPSADAPAALYQTIEENIKIFEEEEVEFISVPVPEFADSDPANIVHDFNKKLTAYLDLNLDKCYVIPLNTSIVMPPRNLLELLINIKAGTYLPQSYLIHEHMVITDRIENIDHLGFFIYRLCHDKETYKLQRRETIKGIQKREASNCFAIRHFENKFAVETLICS

SEQ ID NO: 40630 - protein, 53 aa, Homo sapiens
  Payload ID: 8274
  Gene Symbol: ITM2B
  Gene Name: integral membrane protein 2B
  ENSP ID: ENSP00000475556
  MOD_RES (1)..(1): Any amino acid
XFMLAGVILGGAYLYKYFALQSFSLVAQTGVQWRDLGSLHPLSPGQMTCTTVE

SEQ ID NO: 40631 - protein, 29 aa, Homo sapiens
  Payload ID: 8274
  Gene Symbol: ITM2B
  Gene Name: integral membrane protein 2B
  ENSP ID: ENSP00000476004
  MOD_RES (1)..(1): Any amino acid
XGIQKREASNCFAIRHFENKFAVETLICS

SEQ ID NO: 40632 - protein, 230 aa, Homo sapiens
  Payload ID: 8275
  Gene Symbol: ITM2C
  Gene Name: integral membrane protein 2C
  Uniprot ID: Q9NQX7
  ENSP ID: ENSP00000322100
MVKISFQPAVAGIKGDKADKASASAPAPASATEILLTPAREEQPPQHRSKRGGSVGGVCYLSMGMVVLLMGLVFASVYIYRYFFLAQLARDNFFRCGVLYEDSLSSQVRTQMELEEDVKIYLDENYERINVPVPQFGGGDPADIIHDFQRRGTYLPQTYIIQEEMVVTEHVSDKEALGSFIYHLCNGKDTYRLRRRATRRRINKRGAKNCNAIRHFENTFVVETLICGVV

SEQ ID NO: 40633 - protein, 267 aa, Homo sapiens
  Payload ID: 8275
  Gene Symbol: ITM2C
  Gene Name: integral membrane protein 2C
  Uniprot ID: Q9NQX7
  ENSP ID: ENSP00000322730
MVKISFQPAVAGIKGDKADKASASAPAPASATEILLTPAREEQPPQHRSKRGGSVGGVCYLSMGMVVLLMGLVFASVYIYRYFFLAQLARDNFFRCGVLYEDSLSSQVRTQMELEEDVKIYLDENYERINVPVPQFGGGDPADIIHDFQRGLTAYHDISLDKCYVIELNTTIVLPPRNFWELLMNVKRGTYLPQTYIIQEEMVVTEHVSDKEALGSFIYHLCNGKDTYRLRRRATRRRINKRGAKNCNAIRHFENTFVVETLICGVV

SEQ ID NO: 40634 - protein, 220 aa, Homo sapiens
  Payload ID: 8275
  Gene Symbol: ITM2C
  Gene Name: integral membrane protein 2C
  Uniprot ID: Q9NQX7
  ENSP ID: ENSP00000335121
MVKISFQPAVAGIKGDKADKASASAPAPASATEILLTPARLARDNFFRCGVLYEDSLSSQVRTQMELEEDVKIYLDENYERINVPVPQFGGGDPADIIHDFQRGLTAYHDISLDKCYVIELNTTIVLPPRNFWELLMNVKRGTYLPQTYIIQEEMVVTEHVSDKEALGSFIYHLCNGKDTYRLRRRATRRRINKRGAKNCNAIRHFENTFVVETLICGVV

SEQ ID NO: 40635 - protein, 205 aa, Homo sapiens
  Payload ID: 8275
  Gene Symbol: ITM2C
  Gene Name: integral membrane protein 2C
  ENSP ID: ENSP00000387242
MGMVVLLMGLVFASVYIYRYFFLAQLARDNFFRCGVLYEDSLSSQVRTQMELEEDVKIYLDENYERINVPVPQFGGGDPADIIHDFQRGLTAYHDISLDKCYVIELNTTIVLPPRNFWELLMNVKRGTYLPQTYIIQEEMVVTEHVSDKEALGSFIYHLCNGKDTYRLRRRATRRRINKRGAKNCNAIRHFENTFVVETLICGVV

SEQ ID NO: 40636 - protein, 180 aa, Homo sapiens
  Payload ID: 8275
  Gene Symbol: ITM2C
  Gene Name: integral membrane protein 2C
  ENSP ID: ENSP00000390655
MVKISFQPAVAGIKGDKADKASASAPAPASATEILLTPAREEQPPQHRSKRGGSVGGVCYLSMGMVVLLMGLVFASVYIYRYFFLAQLARDNFFRCGVLYEDSLSSQVRTQMELEEDVKIYLDENYERINVPVPQFGGGDPADIIHDFQRGLTAYHDISLDKCYVIELNTTIVLPPRNFW

SEQ ID NO: 40637 - protein, 125 aa, Homo sapiens
  Payload ID: 8275
  Gene Symbol: ITM2C
  Gene Name: integral membrane protein 2C
  ENSP ID: ENSP00000403257
MGMVVLLMGLVFASVYIYRYFFLAQLARDNFFRCGVLYEDSLSSQVRTQMELEEDVKIYLDENYERINVPVPQFGGGDPADIIHDFQRGLTAYHDISLDKCYVIELNTTIVLPPRNFWELLMNVK

SEQ ID NO: 40638 - protein, 125 aa, Homo sapiens; identical to SEQ ID NO: 40637
  Payload ID: 8275
  Gene Symbol: ITM2C
  Gene Name: integral membrane protein 2C
  ENSP ID: ENSP00000440295

SEQ ID NO: 40639 - protein, 122 aa, Homo sapiens
  Payload ID: 8275
  Gene Symbol: ITM2C
  Gene Name: integral membrane protein 2C
  ENSP ID: ENSP00000444899
MGMVVLLMGLVFASVYIYRYFFLAQLARDNFFRCGVLYEDSLSSQVRTQMELEEDVKIYLDENYERINVPVPQFGGGDPADIIHDFQRGLTAYHDISLDKCYVIELNTTIVLPPRNFWELLM

SEQ ID NO: 40640 - protein, 166 aa, Homo sapiens
  Payload ID: 8275
  Gene Symbol: ITM2C
  Gene Name: integral membrane protein 2C
  ENSP ID: ENSP00000480137
MSLHSSPTLPTSLYQSCDLSVGGPSLLTWVWRRERRCCKVFSVSHCLEAGPAKAWAHSCTGSPRGRTGWGSRACEALGKGMGLWGRGGMGFRSICTIRKVLRSFFLEGTLSSLSLFLDLGLELRMGRCAQGGTHQSTREGGYLGVSQGLCQCLQPTSRSLEFGEWG

SEQ ID NO: 40641 - protein, 2190 aa, Homo sapiens
  Payload ID: 8276
  Gene Symbol: INTS1
  Gene Name: integrator complex subunit 1
  Uniprot ID: Q8N201
  ENSP ID: ENSP00000385722
MNRAKPTTVRRPSAAAKPSGHPPPGDFIALGSKGQANESKTASTLLKPAPSGLPSERKRDAAAALSSASALTGLTKRPKLSSTPPLSALGRLAEAAVAEKRAISPSIKEPSVVPIEVLPTVLLDEIEAAELEGNDDRIEGVLCGAVKQLKVTRAKPDSTLYLSLMYLAKIKPNIFATEGVIEALCSLLRRDASINFKAKGNSLVSVLACNLLMAAYEEDENWPEIFVKVYIEDSLGERIWVDSPHCKTFVDNIQTAFNTRMPPRSVLLQGEAGRVAGDLGAGSSPHPSLTEEEDSQTELLIAEEKLSPEQEGQLMPRYEELAESVEEYVLDMLRDQLNRRQPIDNVSRNLLRLLTSTCGYKEVRLLAVQKLEMWLQNPKLTRPAQDLLMSVCMNCNTHGSEDMDVISHLIKIRLKPKVLLNHFMLCIRELLSAHKDNLGTTIKLVIFNELSSARNPNNMQVLYTALQHSSELAPKFLAMVFQDLLTNKDDYLRASRALLREIIKQTKHEINFQAFCLGLMQERKEPQYLEMEFKERFVVHITDVLAVSMMLGITAQVKEAGIAWDKGEKRNLEVLRSFQNQIAAIQRDAVWWLHTVVPSISKLAPKDYVHCLHKVLFTEQPETYYKWDNWPPESDRNFFLRLCSEVPILEDTLMRILVIGLSRELPLGPADAMELADHLVKRAAAVQADDVEVLKVGRTQLIDAVLNLCTYHHPENIQLPPGYQPPNLAISTLYWKAWPLLLVVAAFNPENIGLAAWEEYPTLKMLMEMVMTNNYSYPPCTLTDEETRTEMLNRELQTAQREKQEILAFEGHLAAASTKQTITESSSLLLSQLTSLDPQGPPRRPPPHILDQVKSLNQSLRLGHLLCRSRNPDFLLHIIQRQASSQSMPWLADLVQSSEGSLDVLPVQCLCEFLLHDAVDDAASGEEDDEGESKEQKAKKRQRQQKQRQLLGRLQDLLLGPKADEQTTCEVLDYFLRRLGSSQVASRVLAMKGLSLVLSEGSLRDGEEKEPPMEEDVGDTDVLQGYQWLLRDLPRLPLFDSVRSTTALALQQAIHMETDPQTISAYLIYLSQHTPVEEQAQHSDLALDVARLVVERSTIMSHLFSKLSPSAASDAVLSALLSIFSRYVRRMRQSKEGEEVYSWSESQDQVFLRWSSGETATMHILVVHAMVILLTLGPPRADDSEFQALLDIWFPEEKPLPTAFLVDTSEEALLLPDWLKLRMIRSEVLRLVDAALQDLEPQQLLLFVQSFGIPVSSMSKLLQFLDQAVAHDPQTLEQNIMDKNYMAHLVEVQHERGASGGQTFHSLLTASLPPRRDSTEAPKPKSSPEQPIGQGRIRVGTQLRVLGPEDDLAGMFLQIFPLSPDPRWQSSSPRPVALALQQALGQELARVVQGSPEVPGITVRVLQALATLLSSPHGGALVMSMHRSHFLACPLLRQLCQYQRCVPQDTGFSSLFLKVLLQMLQWLDSPGVEGGPLRAQLRMLASQASAGRRLSDVRGGLLRLAEALAFRQDLEVVSSTVRAVIATLRSGEQCSVEPDLISKVLQGLIEVRSPHLEELLTAFFSATADAASPFPACKPVVVVSSLLLQEEEPLAGGKPGADGGSLEAVRLGPSSGLLVDWLEMLDPEVVSSCPDLQLRLLFSRRKGKGQAQVPSFRPYLLTLFTHQSSWPTLHQCIRVLLGKSREQRFDPSASLDFLWACIHVPRIWQGRDQRTPQKRREELVLRVQGPELISLVELILAEAETRSQDGDTAACSLIQARLPLLLSCCCGDDESVRKVTEHLSGCIQQWGDSVLGRRCRDLLLQLYLQRPELRVPVPEVLLHSEGAASSSVCKLDGLIHRFITLLADTSDSRALENRGADASMACRKLAVAHPLLLLRHLPMIAALLHGRTHLNFQEFRQQNHLSCFLHVLGLLELLQPHVFRSEHQGALWDCLLSFIRLLLNYRKSSRHLAAFINKFVQFIHKYITYNAPAAISFLQKHADPLHDLSFDNSDLVMLKSLLAGLSLPSRDDRTDRGLDEEGEEESSAGSLPLVSVSLFTPLTAAEMAPYMKRLSRGQTVEDLLEVLSDIDEMSRRRPEILSFFSTNLQRLMSSAEECCRNLAFSLALRSMQNSPSIAAAFLPTFMYCLGSQDFEVVQTALRNLPEYALLCQEHAAVLLHRAFLVGMYGQMDPSAQISEALRILHMEAVM

SEQ ID NO: 40642 - protein, 128 aa, Homo sapiens
  Payload ID: 8276
  Gene Symbol: INTS1
  Gene Name: integrator complex subunit 1
  ENSP ID: ENSP00000419206
LKSLLAGLSLPSRDDRTDRGLDEEGEEESSAGSLPLVSVSLFTPLTAAEMAPYMKRLSRGQTVEGESGPASPTPDLLEVLSDIDEMSRRRPEILSFFSTNLQRLMSSAEECCRNLAFSLALRSMQNSP

SEQ ID NO: 40643 - protein, 710 aa, Homo sapiens
  Payload ID: 8277
  Gene Symbol: INTS10
  Gene Name: integrator complex subunit 10
  Uniprot ID: Q9NVR2
  ENSP ID: ENSP00000381064
MSAQGDCEFLVQRARELVPQDLWAAKAWLITARSLYPADFNIQYEMYTIERNAERTATAGRLLYDMFVNFPDQPVVWREISIITSALRNDSQDKQTQFLRSLFETLPGRVQCEMLLKVTEQCFNTLERSEMLLLLLRRFPETVVQHGVGLGEALLEAETIEEQESPVNCFRKLFVCDVLPLIINNHDVRLPANLLYKYLNKAAEFYINYVTRSTQIENQHQGAQDTSDLMSPSKRSSQKYIIEGLTEKSSQIVDPWERLFKILNVVGMRCEWQMDKGRRSYGDILHRMKDLCRYMNNFDSEAHAKYKNQVVYSTMLVFFKNAFQYVNSIQPSLFQGPNAPSQVPLVLLEDVSNVYGDVEIDRNKHIHKKRKLAEGREKTMSSDDEDCSAKGRNRHIVVNKAELANSTEVLESFKLARESWELLYSLEFLDKEFTRICLAWKTDTWLWLRIFLTDMIIYQGQYKKAIASLHHLAALQGSISQPQITGQGTLEHQRALIQLATCHFALGEYRMTCEKVLDLMCYMVLPIQDGGKSQEEPSKVKPKFRKGSDLKLLPCTSKAIMPYCLHLMLACFKLRAFTDNRDDMALGHVIVLLQQEWPRGENLFLKAVNKICQQGNFQYENFFNYVTNIDMLEEFAYLRTQEGGKIHLELLPNQGMLIKHHTVTRGITKGVKEDFRLAMERQVSRCGENLMVVLHRFCINEKILLLQTLT

SEQ ID NO: 40644 - protein, 54 aa, Homo sapiens
  Payload ID: 8277
  Gene Symbol: INTS10
  Gene Name: integrator complex subunit 10
  ENSP ID: ENSP00000428107
  MOD_RES (1)..(1): Any amino acid
XELVPQDLWAAKAWLITARSLYPADFNIQYEMYTIERNAERTATAGRLLYDMFI

SEQ ID NO: 40645 - protein, 29 aa, Homo sapiens
  Payload ID: 8277
  Gene Symbol: INTS10
  Gene Name: integrator complex subunit 10
  ENSP ID: ENSP00000428300
  MOD_RES (1)..(1): Any amino acid
XCYMVLPIQDGGKSQEEPSKVKPKFRKGS

SEQ ID NO: 40646 - protein, 173 aa, Homo sapiens
  Payload ID: 8277
  Gene Symbol: INTS10
  Gene Name: integrator complex subunit 10
  ENSP ID: ENSP00000428608
  MOD_RES (1)..(1): Any amino acid
XLHLMLACFKLRAFTDNRDDMALGHVIVLLQQEWPRGENLFLKAVNKICQQGNFQYENFFNYVTNIDMLEEFAYLRTQEGGKIHLELLPNQGMLIKPSSPPMGLLQQEFLPVLQPSIQTADRHHTVTRGITKGVKEDFRLAMERQVSRCGENLMVVLHRFCINEKILLLQTLT

SEQ ID NO: 40647 - protein, 41 aa, Homo sapiens
  Payload ID: 8277
  Gene Symbol: INTS10
  Gene Name: integrator complex subunit 10
  ENSP ID: ENSP00000428671
  MOD_RES (1)..(1): Any amino acid
XLLQQEWPRGENLFLKAVNKICQQGNFQYENFFNYVTTCRY

SEQ ID NO: 40648 - protein, 66 aa, Homo sapiens
  Payload ID: 8277
  Gene Symbol: INTS10
  Gene Name: integrator complex subunit 10
  ENSP ID: ENSP00000429011
MSAQGDCEFLVQRARELVPQDLWAAKAWLITARSLYPADFNIQYEMYTIERNAERTATAGRLLYDM

SEQ ID NO: 40649 - protein, 103 aa, Homo sapiens
  Payload ID: 8277
  Gene Symbol: INTS10
  Gene Name: integrator complex subunit 10
  ENSP ID: ENSP00000429117
  MOD_RES (1)..(1): Any amino acid
XTCEKVLDLMCYMVLPIQDGGKSQEEPSKVKPKFRKGSDLKLLPCTSKAIMPYCLHLMLACFKAPHCNSRHHQRREGGLSPGHGAPGLPLWRESDGGSAQVLH

SEQ ID NO: 40650 - protein, 153 aa, Homo sapiens
  Payload ID: 8277
  Gene Symbol: INTS10
  Gene Name: integrator complex subunit 10
  ENSP ID: ENSP00000429534
  MOD_RES (1)..(1): Any amino acid
XSWELLYSLEFLDKEFTRICLAWKTDTWLWLRIFLTDMIIYQGQYKKAIASLHHLAALQGSISQPQITGQGTLEHQRALIQLATCHFALGEYRMTCEKVLDLMCYMVLPIQDGGKSQEEPSKVKPKFRKDIDMLEEFAYLRTQEGGKIHLELL

SEQ ID NO: 40651 - protein, 235 aa, Homo sapiens
  Payload ID: 8277
  Gene Symbol: INTS10
  Gene Name: integrator complex subunit 10
  ENSP ID: ENSP00000430446
  MOD_RES (1)..(1): Any amino acid
XFYINYVTRSTQIENQHQGAQDTSDLMSPSKRSSQKYIIEGLTEKSSQIVDPWERSYGDILHRMKDLCRYMNNFDSEAHAKYKNQVVYSTMLVFFKNAFQYVNSIQPSLFQGPNAPSQVPLVLLEDVSNVYGDVEIDRNKHIHKKRKLAEGREKTMSSDDEDCSAKGRNRHIVVNKAELANSTEVLESFKLARESWELLYSLEFLDKEFTRICLAWKTDTWLWLRIFLTDMIIYQ

SEQ ID NO: 40652 - protein, 49 aa, Homo sapiens
  Payload ID: 8277
  Gene Symbol: INTS10
  Gene Name: integrator complex subunit 10
  ENSP ID: ENSP00000430704
  MOD_RES (1)..(1): Any amino acid
XCRYMNNFDSEAHAKYKNQVVYSTMLVFFKNAFQYVNSIQPSLFQEFRR

SEQ ID NO: 40653 - protein, 65 aa, Homo sapiens
  Payload ID: 8277
  Gene Symbol: INTS10
  Gene Name: integrator complex subunit 10
  ENSP ID: ENSP00000430877
MSAQGDCEFLVQRARELVPQDLWAAKAWLITARSLYPADFNIQEGQRAMLDELGAFWAGVSDQGA

SEQ ID NO: 40654 - protein, 462 aa, Homo sapiens
  Payload ID: 8278
  Gene Symbol: INTS12
  Gene Name: integrator complex subunit 12
  Uniprot ID: Q96CB8
  ENSP ID: ENSP00000340737
MAATVNLELDPIFLKALGFLHSKSKDSAEKLKALLDESLARGIDSSYRPSQKDVEPPKISSTKNISIKQEPKISSSLPSGNNNGKVLTTEKVKKEAEKRPADKMKSDITEGVDIPKKPRLEKPETQSSPITVQSSKDLPMADLSSFEETSADDFAMEMGLACVVCRQMMVASGNQLVECQECHNLYHRDCHKPQVTDKEANDPRLVWYCARCTRQMKRMAQKTQKPPQKPAPAVVSVTPAVKDPLVKKPETKLKQETTFLAFKRTEVKTSTVISGNSSSASVSSSVTSGLTGWAAFAAKTSSAGPSTAKLSSTTQNNTGKPATSSANQKPVGLTGLATSSKGGIGSKIGSNNSTTPTVPLKPPPPLTLGKTGLSRSVSCDNVSKVGLPSPSSLVPGSSSQLSGNGNSGTSGPSGSTTSKTTSESSSSPSASLKGPTSQESQLNAMKRLQMVKKKAAQKKLKK

SEQ ID NO: 40655 - protein, 462 aa, Homo sapiens; identical to SEQ ID NO: 40654
  Payload ID: 8278
  Gene Symbol: INTS12
  Gene Name: integrator complex subunit 12
  Uniprot ID: Q96CB8
  ENSP ID: ENSP00000378221

SEQ ID NO: 40656 - protein, 88 aa, Homo sapiens
  Payload ID: 8278
  Gene Symbol: INTS12
  Gene Name: integrator complex subunit 12
  ENSP ID: ENSP00000396309
MAATVNLELDPIFLKALGFLHSKSKDSAEKLKALLDESLARGIDSSYRPSQKDVEPPKISSTKNISIKQEPKISSSLPSGNNNGKVLT

SEQ ID NO: 40657 - protein, 87 aa, Homo sapiens
  Payload ID: 8278
  Gene Symbol: INTS12
  Gene Name: integrator complex subunit 12
  ENSP ID: ENSP00000396729
MAATVNLELDPIFLKALGFLHSKSKDSAEKLKALLDESLARGIDSSYRPSQKDVEPPKISSTKNISIKQEPKISSSLPSGNNNGKVL

SEQ ID NO: 40658 - protein, 131 aa, Homo sapiens
  Payload ID: 8278
  Gene Symbol: INTS12
  Gene Name: integrator complex subunit 12
  ENSP ID: ENSP00000412317
MAATVNLELDPIFLKALGFLHSKSKDSAEKLKALLDESLARGIDSSYRPSQKDVEPPKISSTKNISIKQEPKISSSLPSGNNNGKVLTTEKVKKEAEKRPADKMKSDITEGVDIPKKPRLEKPETQSSPIT

SEQ ID NO: 40659 - protein, 462 aa, Homo sapiens; identical to SEQ ID NO: 40654
  Payload ID: 8278
  Gene Symbol: INTS12
  Gene Name: integrator complex subunit 12
  Uniprot ID: Q96CB8
  ENSP ID: ENSP00000415433

SEQ ID NO: 40660 - protein, 18 aa, Homo sapiens
  Payload ID: 8278
  Gene Symbol: INTS12
  Gene Name: integrator complex subunit 12
  ENSP ID: ENSP00000422048
MAATVNLELDPIFLKALG

SEQ ID NO: 40661 - protein, 57 aa, Homo sapiens
  Payload ID: 8278
  Gene Symbol: INTS12
  Gene Name: integrator complex subunit 12
  ENSP ID: ENSP00000422856
MVMSRQSQSQAFAMAATVNLELDPIFLKALGFLHSKSKDSAEKLKALLDESLARGID

SEQ ID NO: 40662 - protein, 159 aa, Homo sapiens
  Payload ID: 8278
  Gene Symbol: INTS12
  Gene Name: integrator complex subunit 12
  ENSP ID: ENSP00000423618
MAATVNLELDPIFLKALGFLHSKSKDSAEKLKALLDESLARGIDSSYRPSQKDVEPPKISSTKNISIKQEPKISSSLPSGNNNGKVLTTEKVKKEAEKRPADKMKSDITEGVDIPKKPRLEKPETQSSPITVQSSKDLPMADLSSFEETSADDFAMEMG

SEQ ID NO: 40663 - protein, 444 aa, Homo sapiens
  Payload ID: 8278
  Gene Symbol: INTS12
  Gene Name: integrator complex subunit 12
  ENSP ID: ENSP00000481164
MAATVNLELDPIFLKALGFLHSKSKDSAEKLKALLDESLARGIDSSYRPSQKDVEPPKISSTKNISIKQEPKISSSLPSGNNNGKVLTTEKVKKEAEKRPADKMKSDITEGVDIPKKPRLEKPETQSSPITVQSSKDLPMADLSSFEETSADDFAMEMGLACVVCRQMMVASGNQLVECQECHNLYHRDCHKPQVTDKEANDPRLVWYCARCTRQMKRMAQKTQKPPQKPAPAVVSVTPAVKDPLVKKPETKLKQETTFLAFKRTEVKTSTVISGNSSSASVSSSVTSGLTGWAAFAAKTSSAGPSTAKLSSTTQNNTGKPATSSANQKPVGLTGLATSSKGGIGSKIGSNNSTTPTVPLKPPPPLTLGKTGLSRSVSCDNVSKVGLPSPSSLVPGSSSQLSGNGNSGTSGPSGSTTSKTTSESSSSPSASLKGPTSQNHSSML

SEQ ID NO: 40664 - protein, 1196 aa, Homo sapiens
  Payload ID: 8279
  Gene Symbol: INTS2
  Gene Name: integrator complex subunit 2
  ENSP ID: ENSP00000251334
MTECTSLQFVSPFAFEAMQKVDVVCLASLSDPELRLLLPCLVRMALCAPADQSQSWAQDKKLILRLLSGVEAVNSIVALLSVDFHALEQDASKEQQLRHKLGGGSGESILVSQLQHGLTLEFEHSDSPRRLRLVLSELLAIMNKVSESNGEFFFKSSELFESPVYLEEAADVLCILQAELPSLLPIVDVAEALLHVRNGAWFLCLLVANVPDSFNEVCRGLIKNGERQDEESLGGRRRTDALRFLCKMNPSQALKVRGMVVEECHLPGLGVALTLDHTKNEACEDGVSDLVCFVSGLLLGTNAKVRTWFGTFIRNGQQRKRETSSSVLWQMRRQLLLELMGILPTVRSTRIVEEADVDMEPNVSVYSGLKEEHVVKASALLRLYCALMGIAGLKPTEEEAEQLLQLMTSRPPATPAGVRFVSLSFCMLLAFSTLVSTPEQEQLMVVWLSWMIKEEAYFESTSGVSASFGEMLLLVAMYFHSNQLSAIIDLVCSTLGMKIVIKPSSLSRMKTIFTQEIFTEQVVTAHAVRVPVTSNLSANITGFLPIHCIYQLLRSRSFTKHKVSIKDWIYRQLCETSTPLHPQLLPLIDVYINSILTPASKSNPEATNQPVTEQEILNIFQGVIGGDNIRLNQRFSITAQLLVLYYILSYEEALLANTKTLAAMQRKPKSYSSSLMDQIPIKFLIRQAQGLQQELGGLHSALLRLLATNYPHLCIVDDWICEEEITGTDALLRRMLLTNNAKNHSPKQLQEAFSAVPVNNTQVMQIIEHLTLLSASELIPYAEVLTSNMSQLLNSGVPRRILQTVNKLWMVLNTVMPRRLWVMTVNALQPSIKFVRQQKYTQNDLMIDPLIVLRCDQRVHRCPPLMDITLHMLNGYLLASKAYLSAHLKETEQDRPSQNNTIGLVGQTDAPEVTREELKNALLAAQDSAAVQILLEICLPTEEEKANGVNPDSLLRNVQSVITTSAPNKGMEEGEDNLLCNLREVQCLICCLLHQMYIADPNIAKLVHFQGYPCELLPLTVAGIPSMHICLDFIPELIAQPELEKQIFAIQLLSHLCIQYALPKSLSVARLAVNVMGTLLTVLTQAKRYAFFMPTLPSLVSFCRAFPPLYEDIMSLLIQIGQVCASDVATQTRDIDPIITRLQQIKEKPSGWSQICKDSSYKNGSRDTGSMDPDVQLCHCIERTVIEIINMSVSGI

SEQ ID NO: 40665 - protein, 1204 aa, Homo sapiens
  Payload ID: 8279
  Gene Symbol: INTS2
  Gene Name: integrator complex subunit 2
  Uniprot ID: Q9H0H0
  ENSP ID: ENSP00000414237
MKDQQTVIMTECTSLQFVSPFAFEAMQKVDVVCLASLSDPELRLLLPCLVRMALCAPADQSQSWAQDKKLILRLLSGVEAVNSIVALLSVDFHALEQDASKEQQLRHKLGGGSGESILVSQLQHGLTLEFEHSDSPRRLRLVLSELLAIMNKVSESNGEFFFKSSELFESPVYLEEAADVLCILQAELPSLLPIVDVAEALLHVRNGAWFLCLLVANVPDSFNEVCRGLIKNGERQDEESLGGRRRTDALRFLCKMNPSQALKVRGMVVEECHLPGLGVALTLDHTKNEACEDGVSDLVCFVSGLLLGTNAKVRTWFGTFIRNGQQRKRETSSSVLWQMRRQLLLELMGILPTVRSTRIVEEADVDMEPNVSVYSGLKEEHVVKASALLRLYCALMGIAGLKPTEEEAEQLLQLMTSRPPATPAGVRFVSLSFCMLLAFSTLVSTPEQEQLMVVWLSWMIKEEAYFESTSGVSASFGEMLLLVAMYFHSNQLSAIIDLVCSTLGMKIVIKPSSLSRMKTIFTQEIFTEQVVTAHAVRVPVTSNLSANITGFLPIHCIYQLLRSRSFTKHKVSIKDWIYRQLCETSTPLHPQLLPLIDVYINSILTPASKSNPEATNQPVTEQEILNIFQGVIGGDNIRLNQRFSITAQLLVLYYILSYEEALLANTKTLAAMQRKPKSYSSSLMDQIPIKFLIRQAQGLQQELGGLHSALLRLLATNYPHLCIVDDWICEEEITGTDALLRRMLLTNNAKNHSPKQLQEAFSAVPVNNTQVMQIIEHLTLLSASELIPYAEVLTSNMSQLLNSGVPRRILQTVNKLWMVLNTVMPRRLWVMTVNALQPSIKFVRQQKYTQNDLMIDPLIVLRCDQRVHRCPPLMDITLHMLNGYLLASKAYLSAHLKETEQDRPSQNNTIGLVGQTDAPEVTREELKNALLAAQDSAAVQILLEICLPTEEEKANGVNPDSLLRNVQSVITTSAPNKGMEEGEDNLLCNLREVQCLICCLLHQMYIADPNIAKLVHFQGYPCELLPLTVAGIPSMHICLDFIPELIAQPELEKQIFAIQLLSHLCIQYALPKSLSVARLAVNVMGTLLTVLTQAKRYAFFMPTLPSLVSFCRAFPPLYEDIMSLLIQIGQVCASDVATQTRDIDPIITRLQQIKEKPSGWSQICKDSSYKNGSRDTGSMDPDVQLCHCIERTVIEIINMSVSGI

SEQ ID NO: 40666 - protein, 79 aa, Homo sapiens
  Payload ID: 8279
  Gene Symbol: INTS2
  Gene Name: integrator complex subunit 2
  ENSP ID: ENSP00000461996
MTECTSLQFVSPFAFEAMQKVDVVCLASLSDPELRLLLPCLVRMALCAPADQSQSWAQDKKLILRLLSGVEAVNSIVAL

SEQ ID NO: 40667 - protein, 1204 aa, Homo sapiens; identical to SEQ ID NO: 40665
  Payload ID: 8279
  Gene Symbol: INTS2
  Gene Name: integrator complex subunit 2
  Uniprot ID: Q9H0H0
  ENSP ID: ENSP00000482710

SEQ ID NO: 40668 - protein, 1042 aa, Homo sapiens
  Payload ID: 8280
  Gene Symbol: INTS3
  Gene Name: integrator complex subunit 3
  Uniprot ID: Q68E01
  ENSP ID: ENSP00000318641
MELQKGKGAAAAAAASGAAGGGGGGAGAGAPGGGRLLLSTSLDAKDELEERLERCMSIVTSMTAGVSEREANDALNAYVCKGLPQHEEICLGLFTLILTEPAQAQKCYRDLALVSRDGMNIVLNKINQILMEKYLKLQDTCRTQLVWLVRELVKSGVLGADGVCMTFMKQIAGGDVTAKNIWLAESVLDILTEQREWVLKSSILIAMAVYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLAHLAPLFDNPKLDKELRAMLREKFPEFCSSPSPPVEVKIEEPVSMEMDNHMSDKDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCLMMDMKACQEDDVRLLCHLTPSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNFFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 40669 - protein, 1042 aa, Homo sapiens; identical to SEQ ID NO: 40668
  Payload ID: 8280
  Gene Symbol: INTS3
  Gene Name: integrator complex subunit 3
  Uniprot ID: Q68E01
  ENSP ID: ENSP00000404290

SEQ ID NO: 40670 - protein, 49 aa, Homo sapiens
  Payload ID: 8280
  Gene Symbol: INTS3
  Gene Name: integrator complex subunit 3
  ENSP ID: ENSP00000422616
  MOD_RES (1)..(1): Any amino acid
XSQSLRCDLIRYICGVVHPSNEVLSSDILPRWAIIGWLLTTCTTPSSPV

SEQ ID NO: 40671 - protein, 902 aa, Homo sapiens
  Payload ID: 8280
  Gene Symbol: INTS3
  Gene Name: integrator complex subunit 3
  Uniprot ID: Q68E01
  ENSP ID: ENSP00000425437
MAVYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLAHLAPLFDNPKLDKELRAMLREKFPEFCSSPSPPVEVKIEEPVSMEMDNHMSDKDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCLMMDMKACQEDDVRLLCHLTPSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNCMPSTLGVQCRRCCPGPDYAWSQAGGRGRTPGATTHTRDKTTCACCLISSQTSDCFSFPALPFLPLVFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 40672 - protein, 1042 aa, Homo sapiens; identical to SEQ ID NO: 40668
  Payload ID: 8280
  Gene Symbol: INTS3
  Gene Name: integrator complex subunit 3
  Uniprot ID: Q68E01
  ENSP ID: ENSP00000458631

SEQ ID NO: 40673 - protein, 49 aa, Homo sapiens; identical to SEQ ID NO: 40670
  Payload ID: 8280
  Gene Symbol: INTS3
  Gene Name: integrator complex subunit 3
  ENSP ID: ENSP00000459285
  MOD_RES (1)..(1): Any amino acid

SEQ ID NO: 40674 - protein, 902 aa, Homo sapiens; identical to SEQ ID NO: 40671
  Payload ID: 8280
  Gene Symbol: INTS3
  Gene Name: integrator complex subunit 3
  Uniprot ID: Q68E01
  ENSP ID: ENSP00000459907

SEQ ID NO: 40675 - protein, 1042 aa, Homo sapiens; identical to SEQ ID NO: 40668
  Payload ID: 8280
  Gene Symbol: INTS3
  Gene Name: integrator complex subunit 3
  Uniprot ID: Q68E01
  ENSP ID: ENSP00000460221

SEQ ID NO: 40676 - protein, 41 aa, Homo sapiens
  Payload ID: 8280
  Gene Symbol: INTS3
  Gene Name: integrator complex subunit 3
  ENSP ID: ENSP00000485252
TQPPNAEEESGSSSASEEEDTKPKPTKRKRKGSSAVGSDSD

SEQ ID NO: 40677 - protein, 280 aa, Homo sapiens
  Payload ID: 8280
  Gene Symbol: INTS3
  Gene Name: integrator complex subunit 3
  ENSP ID: ENSP00000485263
VYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLACKKYWLYLRLLGICLLGS

SEQ ID NO: 40678 - protein, 280 aa, Homo sapiens; identical to SEQ ID NO: 40677
  Payload ID: 8280
  Gene Symbol: INTS3
  Gene Name: integrator complex subunit 3
  ENSP ID: ENSP00000485412

SEQ ID NO: 40679 - protein, 41 aa, Homo sapiens; identical to SEQ ID NO: 40676
  Payload ID: 8280
  Gene Symbol: INTS3
  Gene Name: integrator complex subunit 3
  ENSP ID: ENSP00000485502

SEQ ID NO: 40680 - protein, 132 aa, Homo sapiens
  Payload ID: 8281
  Gene Symbol: INTS4
  Gene Name: integrator complex subunit 4
  ENSP ID: ENSP00000407787
MAAHLKKRVYEEFTKVVQPQEEIATKKLRLTKPSKSAALHIDLCKATSPADALQYLLQFARKPVEAESVEGVVRILLEHYYKENDPSVRLKIASLLGLLSKTAGFSPDCIMDDAINILQNETSDRYVSWCKK

SEQ ID NO: 40681 - protein, 96 aa, Homo sapiens
  Payload ID: 8281
  Gene Symbol: INTS4
  Gene Name: integrator complex subunit 4
  ENSP ID: ENSP00000432776
MAAHLKKRVYEEFTKVVQPQEEIATKKLRLTKPSKSAALHIDLCKATSPADALQYLLQFARKPVEAESVEGVVRILLEHYYKRWSLSVLPRLVANS

SEQ ID NO: 40682 - protein, 505 aa, Homo sapiens
  Payload ID: 8281
  Gene Symbol: INTS4
  Gene Name: integrator complex subunit 4
  Uniprot ID: Q96HW7
  ENSP ID: ENSP00000433644
MAAHLKKRVYEEFTKVVQPQEEIATKKLRLTKPSKSAALHIDLCKATSPADALQYLLQFARKPVEAESVEGVVRILLEHYYKENDPSVRLKIASLLGLLSKTAGFSPDCIMDDAINILQNEKSHQVLAQLLDTLLAIGTKLPENQAIQMRLVDVACKHLTDTSHGVRNKCLQLLGNLGSLEKSVTKDAEGLAARDVQKIIGDYFSDQDPRVRTAAIKAMLQLHERGLKLHQTIYNQACKLLSDDYEQVRSAAVQLIWVVSQLYPESIVPIPSSNEEIRLVDDAFGKICHMVSDGSWVVRVQAAKLLGSMEQVSSHFLEQTLDKKLMSDLRRKRTAHERAKELYSSGEFSSGRKWGDDAPKEEVDTGAVNLIESGACGAFVHGLEDEMYEVRIAAVEALCMLAQSSPSFAEKCLDFLVDMFNDEIEEVRLQSIHTMRKISNNITLREDQLDTVLAVLEDSSRDIREALHELLCCTNVSTKEGIHLALVELLKNLTKYPTDRDSIWK

SEQ ID NO: 40683 - protein, 963 aa, Homo sapiens
  Payload ID: 8281
  Gene Symbol: INTS4
  Gene Name: integrator complex subunit 4
  Uniprot ID: Q96HW7
  ENSP ID: ENSP00000434466
MAAHLKKRVYEEFTKVVQPQEEIATKKLRLTKPSKSAALHIDLCKATSPADALQYLLQFARKPVEAESVEGVVRILLEHYYKENDPSVRLKIASLLGLLSKTAGFSPDCIMDDAINILQNEKSHQVLAQLLDTLLAIGTKLPENQAIQMRLVDVACKHLTDTSHGVRNKCLQLLGNLGSLEKSVTKDAEGLAARDVQKIIGDYFSDQDPRVRTAAIKAMLQLHERGLKLHQTIYNQACKLLSDDYEQVRSAAVQLIWVVSQLYPESIVPIPSSNEEIRLVDDAFGKICHMVSDGSWVVRVQAAKLLGSMEQVSSHFLEQTLDKKLMSDLRRKRTAHERAKELYSSGEFSSGRKWGDDAPKEEVDTGAVNLIESGACGAFVHGLEDEMYEVRIAAVEALCMLAQSSPSFAEKCLDFLVDMFNDEIEEVRLQSIHTMRKISNNITLREDQLDTVLAVLEDSSRDIREALHELLCCTNVSTKEGIHLALVELLKNLTKYPTDRDSIWKCLKFLGSRHPTLVLPLVPELLSTHPFFDTAEPDMDDPAYIAVLVLIFNAAKTCPTMPALFSDHTFRHYAYLRDSLSHLVPALRLPGRKLVSSAVSPSIIPQEDPSQQFLQQSLERVYSLQHLDPQGAQELLEFTIRDLQRLGELQSELAGVADFSATYLRCQLLLIKALQEKLWNVAAPLYLKQSDLASAAAKQIMEETYKMEFMYSGVENKQVVIIHHMRLQAKALQLIVTARTTRGLDPLFGMCEKFLQEVDFFQRYFIADLPHLQDSFVDKLLDLMPRLMTSKPAEVVKILQTMLRQSAFLHLPLPEQIHKASATIIEPAGESDNPLRFTSGLVVALDVDATLEHVQDPQNTVKVQVLYPDGQAQMIHPKPADFRNPGPGRHRLITQVYLSHTAWTEACQVEVRLLLAYNSSARIPKCPWMEGGEMSPQVETSIEGTIPFSKPVKVYIMPKPARR

SEQ ID NO: 40684 - protein, 96 aa, Homo sapiens; identical to SEQ ID NO: 40681
  Payload ID: 8281
  Gene Symbol: INTS4
  Gene Name: integrator complex subunit 4
  ENSP ID: ENSP00000435758

SEQ ID NO: 40685 - protein, 96 aa, Homo sapiens; identical to SEQ ID NO: 40681
  Payload ID: 8281
  Gene Symbol: INTS4
  Gene Name: integrator complex subunit 4
  ENSP ID: ENSP00000436248

SEQ ID NO: 40686 - protein, 338 aa, Homo sapiens
  Payload ID: 8281
  Gene Symbol: INTS4
  Gene Name: integrator complex subunit 4
  Uniprot ID: Q96HW7
  ENSP ID: ENSP00000441084
MPALKQTASQVTQTLRDLQRLGELQSELAGVADFSATYLRCQLLLIKALQEKLWNVAAPLYLKQSDLASAAAKQIMEETYKMEFMYSGVENKQVVIIHHMRLQAKALQLIVTARTTRGLDPLFGMCEKFLQEVDFFQRYFIADLPHLQDSFVDKLLDLMPRLMTSKPAEVVKILQTMLRQSAFLHLPLPEQIHKASATIIEPAGESDNPLRFTSGLVVALDVDATLEHVQDPQNTVKVQVLYPDGQAQMIHPKPADFRNPGPGRHRLITQVYLSHTAWTEACQVEVRLLLAYNSSARIPKCPWMEGGEMSPQVETSIEGTIPFSKPVKVYIMPKPARR

SEQ ID NO: 40687 - protein, 1019 aa, Homo sapiens
  Payload ID: 8282
  Gene Symbol: INTS5
  Gene Name: integrator complex subunit 5
  Uniprot ID: Q6P9B9
  ENSP ID: ENSP00000327889
MSALCDPPGAPGPPGPAPATHGPAPLSAQELSQEIKAFLTGVDPILGHQLSAREHARCGLLLLRSLPPARAAVLDHLRGVFDESVRAHLAALDETPVAGPPHLRPPPPSHVPAGGPGLEDVVQEVQQVLSEFIRANPKAWAPVISAWSIDLMGQLSSTYSGQHQRVPHATGALNELLQLWMGCRATRTLMDIYVQCLSALIGSCPDACVDALLDTSVQHSPHFDWVVAHIGSSFPGTIISRVLSCGLKDFCVHGGAGGGAGSSGGSSSQTPSTDPFPGSPAIPAEKRVPKIASVVGILGHLASRHGDSIRRELLRMFHDSLAGGSGGRSGDPSLQATVPFLLQLAVMSPALLGTVSGELVDCLKPPAVLSQLQQHLQGFPREELDNMLNLAVHLVSQASGAGAYRLLQFLVDTAMPASVITTQGLAVPDTVREACDRLIQLLLLHLQKLVHHRGGSPGEGVLGPPPPPRLVPFLDALKNHVGELCGETLRLERKRFLWQHQLLGLLSVYTRPSCGPEALGHLLSRARSPEELSLATQLYAGLVVSLSGLLPLAFRSCLARVHAGTLQPPFTARFLRNLALLVGWEQQGGEGPAALGAHFGESASAHLSDLAPLLLHPEEEVAEAAASLLAICPFPSEALSPSQLLGLVRAGVHRFFASLRLHGPPGVASACQLLTRLSQTSPAGLKAVLQLLVEGALHRGNTELFGGQVDGDNETLSVVSASLASASLLDTNRRHTAAVPGPGGIWSVFHAGVIGRGLKPPKFVQSRNQQEVIYNTQSLLSLLVHCCSAPGGTECGECWGAPILSPEAAKAVAVTLVESVCPDAAGAELAWPPEEHARATVERDLRIGRRFREQPLLFELLKLVAAAPPALCYCSVLLRGLLAALLGHWEASRHPDTTHSPWHLEASCTLVAVMAEGSLLPPALGNMHEVFSQLAPFEVRLLLLSVWGFLREHGPLPQKFIFQSERGRFIRDFSREGGGEGGPHLAVLHSVLHRNIDRLGLFSGRFQAPSPSTLLRQGT

SEQ ID NO: 40688 - protein, 887 aa, Homo sapiens
  Payload ID: 8283
  Gene Symbol: INTS6
  Gene Name: integrator complex subunit 6
  Uniprot ID: Q9UL03
  ENSP ID: ENSP00000310260
MPILLFLIDTSASMNQRSHLGTTYLDTAKGAVETFMKLRARDPASRGDRYMLVTFEEPPYAIKAGWKENHATFMNELKNLQAEGLTTLGQSLRTAFDLLNLNRLVTGIDNYGQGRNPFFLEPAIIITITDGSKLTTTSGVQDELHLPLNSPLPGSELTKEPFRWDQRLFALVLRLPGTMSVESEQLTGVPLDDSAITPMCEVTGGRSYSVCSPRMLNQCLESLVQKVQSGVVINFEKAGPDPSPVEDGQPDISRPFGSQPWHSCHKLIYVRPNPKTGVPIGHWPVPESFWPDQNSPTLPPRTSHPVVKFSCTDCEPMVIDKLPFDKYELEPSPLTQFILERKSPQTCWQVYVSNSAKYSELGHPFGYLKASTALNCVNLFVMPYNYPVLLPLLDDLFKVHKAKPTLKWRQSFESYLKTMPPYYLGPLKKAVRMMGAPNLIADSMEYGLSYSVISYLKKLSQQAKIESDRVIGSVGKKVVQETGIKVRSRSHGLSMAYRKDFQQLLQGISEDVPHRLLDLNMKEYTGFQVALLNKDLKPQTFRNAYDIPRRNLLDHLTRMRSNLLKSTRRFLKGQDEDQVHSVPIAQMGNYQEYLKQVPSPLRELDPDQPRRLHTFGNPFKLDKKGMMIDEADEFVAGPQNKHKRPGEPNMQGIPKRRRCMSPLLRGRQQNPVVNNHIGGKGPPAPTTQAQPDLIKPLPLHKISETTNDSIIHDVVENHVADQLSSDITPNAMDTEFSASSPASLLERPTNHMEALGHDHLGTNDLTVGGFLENHEEPRDKEQCAEENIPASSLNKGKKLMHCRSHEEVNTELKAQIMKEIRKPGRKYERIFTLLKHVQGSLQTRLIFLQNVIKEASRFKKRMLIEQLENFLDEIHRRANQINHINSN

SEQ ID NO: 40689 - protein, 874 aa, Homo sapiens
  Payload ID: 8283
  Gene Symbol: INTS6
  Gene Name: integrator complex subunit 6
  Uniprot ID: Q9UL03
  ENSP ID: ENSP00000381187
MNQRSHLGTTYLDTAKGAVETFMKLRARDPASRGDRYMLVTFEEPPYAIKAGWKENHATFMNELKNLQAEGLTTLGQSLRTAFDLLNLNRLVTGIDNYGQGRNPFFLEPAIIITITDGSKLTTTSGVQDELHLPLNSPLPGSELTKEPFRWDQRLFALVLRLPGTMSVESEQLTGVPLDDSAITPMCEVTGGRSYSVCSPRMLNQCLESLVQKVQSGVVINFEKAGPDPSPVEDGQPDISRPFGSQPWHSCHKLIYVRPNPKTGVPIGHWPVPESFWPDQNSPTLPPRTSHPVVKFSCTDCEPMVIDKLPFDKYELEPSPLTQFILERKSPQTCWQVYVSNSAKYSELGHPFGYLKASTALNCVNLFVMPYNYPVLLPLLDDLFKVHKAKPTLKWRQSFESYLKTMPPYYLGPLKKAVRMMGAPNLIADSMEYGLSYSVISYLKKLSQQAKIESDRVIGSVGKKVVQETGIKVRSRSHGLSMAYRKDFQQLLQGISEDVPHRLLDLNMKEYTGFQVALLNKDLKPQTFRNAYDIPRRNLLDHLTRMRSNLLKSTRRFLKGQDEDQVHSVPIAQMGNYQEYLKQVPSPLRELDPDQPRRLHTFGNPFKLDKKGMMIDEADEFVAGPQNKHKRPGEPNMQGIPKRRRCMSPLLRGRQQNPVVNNHIGGKGPPAPTTQAQPDLIKPLPLHKISETTNDSIIHDVVENHVADQLSSDITPNAMDTEFSASSPASLLERPTNHMEALGHDHLGTNDLTVGGFLENHEEPRDKEQCAEENIPASSLNKGKKLMHCRSHEEVNTELKAQIMKEIRKPGRKYERIFTLLKHVQGSLQTRLIFLQNVIKEASRFKKRMLIEQLENFLDEIHRRANQINHINSN

SEQ ID NO: 40690 - protein, 115 aa, Homo sapiens
  Payload ID: 8283
  Gene Symbol: INTS6
  Gene Name: integrator complex subunit 6
  Uniprot ID: Q9UL03
  ENSP ID: ENSP00000411245
MPILLFLIDTSASMNQRSHLGTTYLDTAKGAVETFMKLRARDPASRGDRYMLVTFEEPPYAIKAGWKENHATFMNELKNLQAEGLTTLGQSLRTAFDLLNLNRLVTGIDNYGQVG

SEQ ID NO: 40691 - protein, 151 aa, Homo sapiens
  Payload ID: 8283
  Gene Symbol: INTS6
  Gene Name: integrator complex subunit 6
  ENSP ID: ENSP00000417442
MPILLFLIDTSASMNQRSHLGTTYLDTAKGAVETFMKLRARDPASRGDRYMLVTFEEPPYAIKAGWKENHATFMNELKNLQAEGLTTLGQSLRTAFDLLNLNRLVTGIDNYGQGRNPFFLEPAIIITITDGSKLTTTSGVQDEVLGTHRWN

SEQ ID NO: 40692 - protein, 126 aa, Homo sapiens
  Payload ID: 8283
  Gene Symbol: INTS6
  Gene Name: integrator complex subunit 6
  ENSP ID: ENSP00000417707
MNQRSHLGTTYLDTAKGAVETFMKLRARDPASRGDRYMLVTFEEPPYAIKAGWKENHATFMNELKNLQAEGLTTLGQSLRTAFDLLNLNRLVTGIDNYGQGRNPFFLEPAIIITITDGSKLTTTSG

SEQ ID NO: 40693 - protein, 154 aa, Homo sapiens
  Payload ID: 8283
  Gene Symbol: INTS6
  Gene Name: integrator complex subunit 6
  ENSP ID: ENSP00000418026
MEDEGKISRITARFLEQPPRTSHPVVKFSCTDCEPMVIDKLPFDKYELEPSPLTQFILERKSPQTCWQVYVSNSAKYSELGHPFGYLKASTALNCVNLFVMPYNYPVLLPLLDDLFKVHKAKPTLKWRQSFESYLKTMPPYYLGPLKKAVRMMG

SEQ ID NO: 40694 - protein, 89 aa, Homo sapiens
  Payload ID: 8283
  Gene Symbol: INTS6
  Gene Name: integrator complex subunit 6
  ENSP ID: ENSP00000419144
MNELKNLQAEGLTTLGQSLRTAFDLLNLNRLVTGIDNYGQGRNPFFLEPAIIITITDGSKLTTTSGVQDEVSCAYITWIMQMQLNNPLF

SEQ ID NO: 40695 - protein, 131 aa, Homo sapiens
  Payload ID: 8283
  Gene Symbol: INTS6
  Gene Name: integrator complex subunit 6
  ENSP ID: ENSP00000419287
MNELKNLQAEGLTTLGQSLRTAFDLLNLNRLVTGIDNYGQGRNPFFLEPAIIITITDGSKLTTTSGVQDELHLPLNSPLPGSELTKEPFRWDQRLFALVLRLPGTMSVESEQLTGVPLDDSAITPMCEVTG

SEQ ID NO: 40696 - protein, 130 aa, Homo sapiens
  Payload ID: 8283
  Gene Symbol: INTS6
  Gene Name: integrator complex subunit 6
  ENSP ID: ENSP00000419569
MNQRSHLGTTYLDTAKGAVETFMKLRARDPASRGDRYMLVTFEEPPYAIKAGWKENHATFMNELKNLQAEGLTTLGQSLRTAFDLLNLNRLVTGIDNYGQGRNPFFLEPAIIITITDGSKLTTTSGVQDE

SEQ ID NO: 40697 - protein, 709 aa, Homo sapiens
  Payload ID: 8283
  Gene Symbol: INTS6
  Gene Name: integrator complex subunit 6
  ENSP ID: ENSP00000419871
MSVESEQLTGVPLDDSAITPMCEVTGGRSYSVCSPRMLNQCLESLVQKVQSGVVINFEKAGPDPSPVEDGQPDISRPFGSQPWHSCHKLIYVRPNPKTGVPIGHWPVPESFWPDQNSPTLPPRTSHPVVKFSCTDCEPMVIDKLPFDKYELEPSPLTQFILERKSPQTCWQVYVSNSAKYSELGHPFGYLKASTALNCVNLFVMPYNYPVLLPLLDDLFKVHKAKPTLKWRQSFESYLKTMPPYYLGPLKKAVRMMGAPNLIADSMEYGLSYSVISYLKKLSQQAKIESDRVIGSVGKKVVQETGIKVRSRSHGLSMAYRKDFQQLLQGISEDVPHRLLDLNMKEYTGFQVALLNKDLKPQTFRNAYDIPRRNLLDHLTRMRSNLLKSTRRFLKGQDEDQVHSVPIAQMGNYQEYLKQVPSPLRELDPDQPRRLHTFGNPFKLDKKGMMIDEADEFVAGPQNKHKRPGEPNMQGIPKRRRCMSPLLRGRQQNPVVNNHIGGKGPPAPTTQAQPDLIKPLPLHKISETTNDSIIHDVVENHVADQLSSDITPNAMDTEFSASSPASLLERPTNHMEALGHDHLGTNDLTVGGFLENHEEPRDKEQCAEENIPASSLNKGKKLMHCRSHEEVNTELKAQIMKEIRKPGRKYERIFTLLKHVQGSLQTRLIFLQNVIKEASRFKKRMLIEQLENFLDEIHRRANQINHINSN

SEQ ID NO: 40698 - protein, 571 aa, Homo sapiens
  Payload ID: 8283
  Gene Symbol: INTS6
  Gene Name: integrator complex subunit 6
  ENSP ID: ENSP00000419984
MVIDKLPFDKYELEPSPLTQFILERKSPQTCWQVYVSNSAKYSELGHPFGYLKASTALNCVNLFVMPYNYPVLLPLLDDLFKVHKAKPTLKWRQSFESYLKTMPPYYLGPLKKAVRMMGAPNLIADSMEYGLSYSVISYLKKLSQQAKIESDRVIGSVGKKVVQETGIKVRSRSHGLSMAYRKDFQQLLQGISEDVPHRLLDLNMKEYTGFQVALLNKDLKPQTFRNAYDIPRRNLLDHLTRMRSNLLKSTRRFLKGQDEDQVHSVPIAQMGNYQEYLKQVPSPLRELDPDQPRRLHTFGNPFKLDKKGMMIDEADEFVAGPQNKHKRPGEPNMQGIPKRRRCMSPLLRGRQQNPVVNNHIGGKGPPAPTTQAQPDLIKPLPLHKISETTNDSIIHDVVENHVADQLSSDITPNAMDTEFSASSPASLLERPTNHMEALGHDHLGTNDLTVGGFLENHEEPRDKEQCAEENIPASSLNKGKKLMHCRSHEEVNTELKAQIMKEIRKPGRKYERIFTLLKHVQGSLQTRLIFLQNVIKEASRFKKRMLIEQLENFLDEIHRRANQINHINSN

SEQ ID NO: 40699 - protein, 942 aa, Homo sapiens
  Payload ID: 8284
  Gene Symbol: INTS7
  Gene Name: integrator complex subunit 7
  Uniprot ID: Q9NVH2
  ENSP ID: ENSP00000355959
MASNSTKSFLADAGYGEQELDANSALMELDKGLRSGKLGEQCEAVVRFPRLFQKYPFPILINSAFLKLADVFRVGNNFLRLCVLKVTQQSEKHLEKILNVDEFVKRIFSVIHSNDPVARAITLRMLGSLASIIPERKNAHHSIRQSLDSHDNVEVEAAVFAAANFSAQSKDFAVGICNKISEMIQGLATPVDLKLKLIPILQHMHHDAILASSARQLLQQLVTSYPSTKMVIVSLHTFTLLAASSLVDTPKQIQLLLQYLKNDPRKAVKRLAIQDLKLLANKTPHTWSRENIQALCECALQTPYDSLKLGMLSVLSTLSGTIAIKHYFSIVPGNVSSSPRSSDLVKLAQECCYHNNRGIAAHGVRVLTNITVSCQEKDLLALEQDAVFGLESLLVLCSQDDSPGAQATLKIALNCMVKLAKGRPHLSQSVVETLLTQLHSAQDAARILMCHCLAAIAMQLPVLGDGMLGDLMELYKVIGRSATDKQQELLVSLATVIFVASQKALSVESKAVIKQQLESVSNGWTVYRIARQASRMGNHDMAKELYQSLLTQVASEHFYFWLNSLKEFSHAEQCLTGLQEENYSSALSCIAESLKFYHKGIASLTAASTPLNPLSFQCEFVKLRIDLLQAFSQLICTCNSLKTSPPPAIATTIAMTLGNDLQRCGRISNQMKQSMEEFRSLASRYGDLYQASFDADSATLRNVELQQQSCLLISHAIEALILDPESASFQEYGSTGTAHADSEYERRMMSVYNHVLEEVESLNRKYTPVSYMRYFFQKLQSTSIKLALSPSPRNPAEPIAVQNNQQLALKVEGVVQHGSKPGLFRKIQSVCLNVSSTLQSKSGQDYKIPIDNMTNEMEQRVEPHNDYFSTQFLLNFAILGTHNITVESSVKDANGIVWKTGPRTTIFVKSLEDPYSQQIRLQQQQAQQPLQQQQQRNAYTRF

SEQ ID NO: 40700 - protein, 948 aa, Homo sapiens
  Payload ID: 8284
  Gene Symbol: INTS7
  Gene Name: integrator complex subunit 7
  Uniprot ID: Q9NVH2
  ENSP ID: ENSP00000355960
MASNSTKSFLADAGYGEQELDANSALMELDKGLRSGKLGEQCEAVVRFPRLFQKYPFPILINSAFLKLADVFRVGNNFLRLCVLKVTQQSEKHLEKILNVDEFVKRIFSVIHSNDPVARAITLRMLGSLASIIPERKNAHHSIRQSLDSHDNVEVEAAVFAAANFSAQSKDFAVGICNKISEMIQGLATPVDLKLKLIPILQHMHHDAILASSARQLLQQLVTSYPSTKMVIVSLHTFTLLAASSLVDTPKQIQLLLQYLKNDPRKAVKRLAIQDLKLLANKTPHTWSRENIQALCECALQTPYDSLKLGMLSVLSTLSGTIAIKHYFSIVPGNVSSSPRSSDLVKLAQECCYHNNRGIAAHGVRVLTNITVSCQEKDLLALEQDAVFGLESLLVLCSQDDSPGAQATLKIALNCMVKLAKGRPHLSQSVVETLLTQLHSAQDAARILMCHCLAAIAMQLPVLGDGMLGDLMELYKVIGRSATDKQQELLVSLATVIFVASQKALSVESKAVIKQQLESVSNGWTVYRIARQASRMGNHDMAKELYQSLLTQVASEHFYFWLNSLKEFSHAEQCLTGLQEENYSSALSCIAESLKFYHKGIASLTAASTPLNPLSFQCEFVKLRIDLLQAFSQLICTCNSLKTSPPPAIATTIAMTLGNDLQRCGRISNQMKQSMEEFRSLASRYGDLYQASFDADSATLRNVELQQQSCLLISHAIEALILDPESASFQEYGSTGTAHADSEYERRMMSVYNHVLEEHTACLCNAIIALLKVPLSFQRYFFQKLQSTSIKLALSPSPRNPAEPIAVQNNQQLALKVEGVVQHGSKPGLFRKIQSVCLNVSSTLQSKSGQDYKIPIDNMTNEMEQRVEPHNDYFSTQFLLNFAILGTHNITVESSVKDANGIVWKTGPRTTIFVKSLEDPYSQQIRLQQQQAQQPLQQQQQRNAYTRF

SEQ ID NO: 40701 - protein, 962 aa, Homo sapiens
  Payload ID: 8284
  Gene Symbol: INTS7
  Gene Name: integrator complex subunit 7
  Uniprot ID: Q9NVH2
  ENSP ID: ENSP00000355961
MASNSTKSFLADAGYGEQELDANSALMELDKGLRSGKLGEQCEAVVRFPRLFQKYPFPILINSAFLKLADVFRVGNNFLRLCVLKVTQQSEKHLEKILNVDEFVKRIFSVIHSNDPVARAITLRMLGSLASIIPERKNAHHSIRQSLDSHDNVEVEAAVFAAANFSAQSKDFAVGICNKISEMIQGLATPVDLKLKLIPILQHMHHDAILASSARQLLQQLVTSYPSTKMVIVSLHTFTLLAASSLVDTPKQIQLLLQYLKNDPRKAVKRLAIQDLKLLANKTPHTWSRENIQALCECALQTPYDSLKLGMLSVLSTLSGTIAIKHYFSIVPGNVSSSPRSSDLVKLAQECCYHNNRGIAAHGVRVLTNITVSCQEKDLLALEQDAVFGLESLLVLCSQDDSPGAQATLKIALNCMVKLAKGRPHLSQSVVETLLTQLHSAQDAARILMCHCLAAIAMQLPVLGDGMLGDLMELYKVIGRSATDKQQELLVSLATVIFVASQKALSVESKAVIKQQLESVSNGWTVYRIARQASRMGNHDMAKELYQSLLTQVASEHFYFWLNSLKEFSHAEQCLTGLQEENYSSALSCIAESLKFYHKGIASLTAASTPLNPLSFQCEFVKLRIDLLQAFSQLICTCNSLKTSPPPAIATTIAMTLGNDLQRCGRISNQMKQSMEEFRSLASRYGDLYQASFDADSATLRNVELQQQSCLLISHAIEALILDPESASFQEYGSTGTAHADSEYERRMMSVYNHVLEEVESLNRKYTPVSYMHTACLCNAIIALLKVPLSFQRYFFQKLQSTSIKLALSPSPRNPAEPIAVQNNQQLALKVEGVVQHGSKPGLFRKIQSVCLNVSSTLQSKSGQDYKIPIDNMTNEMEQRVEPHNDYFSTQFLLNFAILGTHNITVESSVKDANGIVWKTGPRTTIFVKSLEDPYSQQIRLQQQQAQQPLQQQQQRNAYTRF

SEQ ID NO: 40702 - protein, 913 aa, Homo sapiens
  Payload ID: 8284
  Gene Symbol: INTS7
  Gene Name: integrator complex subunit 7
  Uniprot ID: Q9NVH2
  ENSP ID: ENSP00000388908
MASNSTKSFLADAGYGEQELDANSALMELDKGLRSGKLGEQCEAVVRFPRLFQKYPFPILINSAFLKLADVFRVGMLGSLASIIPERKNAHHSIRQSLDSHDNVEVEAAVFAAANFSAQSKDFAVGICNKISEMIQGLATPVDLKLKLIPILQHMHHDAILASSARQLLQQLVTSYPSTKMVIVSLHTFTLLAASSLVDTPKQIQLLLQYLKNDPRKAVKRLAIQDLKLLANKTPHTWSRENIQALCECALQTPYDSLKLGMLSVLSTLSGTIAIKHYFSIVPGNVSSSPRSSDLVKLAQECCYHNNRGIAAHGVRVLTNITVSCQEKDLLALEQDAVFGLESLLVLCSQDDSPGAQATLKIALNCMVKLAKGRPHLSQSVVETLLTQLHSAQDAARILMCHCLAAIAMQLPVLGDGMLGDLMELYKVIGRSATDKQQELLVSLATVIFVASQKALSVESKAVIKQQLESVSNGWTVYRIARQASRMGNHDMAKELYQSLLTQVASEHFYFWLNSLKEFSHAEQCLTGLQEENYSSALSCIAESLKFYHKGIASLTAASTPLNPLSFQCEFVKLRIDLLQAFSQLICTCNSLKTSPPPAIATTIAMTLGNDLQRCGRISNQMKQSMEEFRSLASRYGDLYQASFDADSATLRNVELQQQSCLLISHAIEALILDPESASFQEYGSTGTAHADSEYERRMMSVYNHVLEEVESLNRKYTPVSYMHTACLCNAIIALLKVPLSFQRYFFQKLQSTSIKLALSPSPRNPAEPIAVQNNQQLALKVEGVVQHGSKPGLFRKIQSVCLNVSSTLQSKSGQDYKIPIDNMTNEMEQRVEPHNDYFSTQFLLNFAILGTHNITVESSVKDANGIVWKTGPRTTIFVKSLEDPYSQQIRLQQQQAQQPLQQQQQRNAYTRF

SEQ ID NO: 40703 - protein, 152 aa, Homo sapiens
  Payload ID: 8284
  Gene Symbol: INTS7
  Gene Name: integrator complex subunit 7
  ENSP ID: ENSP00000481102
AIEALILDPESASFQEYGSTGTAHADSEYERRMMSVYNHVLEEVESLNRKYTPVSYMIPIDNMTNEMEQRVEPHNDYFSTQFLLNFAILGTHNITVESSVKDANGIVWKTGPRTTIFVKSLEDPYSQQIRLQQQQAQQPLQQQQQRNAYTRF

SEQ ID NO: 40704 - protein, 87 aa, Homo sapiens
  Payload ID: 8284
  Gene Symbol: INTS7
  Gene Name: integrator complex subunit 7
  ENSP ID: ENSP00000481687
MASNSTKSFLADAGYGEQELDANSALMELDKGLRSGKLGEQCEAVVRFPRLFQKYPFPILINSAFLKLADVFRVGMRCMSVKYLKHK

SEQ ID NO: 40705 - protein, 114 aa, Homo sapiens
  Payload ID: 8284
  Gene Symbol: INTS7
  Gene Name: integrator complex subunit 7
  ENSP ID: ENSP00000483346
  MOD_RES (1)..(1): Any amino acid
XVIKQQLESVSNGWTVYRIARQASRMGNHDMAKELYQSLLTQVASEHFYFWLNSLKEFSHAEQCLTGLQEENYSSALSCIAESLKFYHKGIASLTPEDKPTTCNCHNNCHDLRK

SEQ ID NO: 40706 - protein, 42 aa, Homo sapiens
  Payload ID: 8284
  Gene Symbol: INTS7
  Gene Name: integrator complex subunit 7
  ENSP ID: ENSP00000484371
MASNSTKSFLADAGYGEQELDANSALMELDKDGVTSPVFQNT

SEQ ID NO: 40707 - protein, 758 aa, Homo sapiens
  Payload ID: 8285
  Gene Symbol: INTS8
  Gene Name: integrator complex subunit 8
  ENSP ID: ENSP00000343274
MSAEAADREAATSSRPCTPPQTCWFEFLLEESLLEKHLRKPCPDPAPVQLIVQFLEQASKPSVNEQNQVQPPPDNKRNRILKLLALKVAAHLKWDLDILEKSLSVPVLNMLLNELLCISKVPPGTKHVDMDLATLPPTTAMAVLLYNRWAIRTIVQSSFPVKQAKPGPPQLSVMNQMQQEKELTENILKVLKEQAADSILVLEAALKLNKDLYVHTMRTLDLLAMEPGMVNGETESSTAGLKVKTEEMQCQVCYDLGAAYFQQGSTNSAVYENAREKFFRTKELIAEIGSLSLHCTIDEKRLAGYCQACDVLVPSSDSTSQQLTPYSQVHICLRSGNYQEVIQIFIEDNLTLSLPVQFRQSVLRELFKKAQQGNEALDEICFKVCACNTVRDILEGRTISVQFNQLFLRPNKEKIDFLLEVCSRSVNLEKASESLKGNMAAFLKNVCLGLEDLQYVFMISSHELFITLLKDEERKLLVDQMRKRSPRVNLCIKPVTSFYDIPASASVNIGQLEHQLILSVDPWRIRQILIELHGMTSERQFWTVSNKWEVPSVYSGVILGIKDNLTRDLVYILMAKGLHCSTVKDFSHAKQLFAACLELVTEFSPKLRQVMLNEMLLLDIHTHEAGTGQAGERPPSDLISRVRGYLEMRLPDIPLRQVIAEECVAFMLNWRENEYLTLQVPAFLLQSNPYVKLGQLLAATCKELPGPKESRRTAKDLWEVVVQICSVSSQHKRGNDGRVSLIKQRESTLGIMYRYVLE

SEQ ID NO: 40708 - protein, 291 aa, Homo sapiens
  Payload ID: 8285
  Gene Symbol: INTS8
  Gene Name: integrator complex subunit 8
  ENSP ID: ENSP00000427840
MSAEAADREAATSSRPCTPPQTCWFEFLLEESLLEKHLRKPCPDPAPVQLIVQFLEQASKPSVNEQNQVQPPPDNKRNRILKLLALKVAAHLKWDLDILEKSLSVPVLNMLLNELLCISKVPPGTKHVDMDLATLPPTTAMAVLLYNRWAIRTIVQSSFPVKQAKPGPPQLSVMNQMQQEKELTENILKVLKEQAADSILVLEAALKLNKDLYVHTMRTLDLLAMEPGMVNGETESSTAGLKVKTEEMQCQVCYDLGAAYFQQGSTNSAVYENAREKFFRTKELIAEMRSG

SEQ ID NO: 40709 - protein, 146 aa, Homo sapiens
  Payload ID: 8285
  Gene Symbol: INTS8
  Gene Name: integrator complex subunit 8
  ENSP ID: ENSP00000428260
MSAEAADREAATSSRPCTPPQTCWFEFLLEESLLEKHLRKPCPDPAPVQLIVQFLEQASKPSVNEQNQVQPPPDNKRNRILKLLALKVAAHLKWDLDILEKRAIRTIVQSSFPVKQAKPGPPQLSVMNQMQQEKELTENILKVLKE

SEQ ID NO: 40710 - protein, 94 aa, Homo sapiens
  Payload ID: 8285
  Gene Symbol: INTS8
  Gene Name: integrator complex subunit 8
  ENSP ID: ENSP00000429056
MLLNELLCISKVPPGTKHVDMDLATLPPTTAMAVLLYNRWAIRTIVQSSFPVKQAKPGPPQLSVMNQMQQEKELTENILKVLKEQAADSILVLE

SEQ ID NO: 40711 - protein, 204 aa, Homo sapiens
  Payload ID: 8285
  Gene Symbol: INTS8
  Gene Name: integrator complex subunit 8
  ENSP ID: ENSP00000429340
MFDPAPVQLIVQFLEQASKPSVNEQNQVQPPPDNKRNRILKLLALKVAAHLKWDLDILEKSLSVPVLNMLLNELLCISKVPPGTKHVDMDLATLPPTTAMAVLLYNRWAIRTIVQSSFPVKQAKPGPPQLSVMNQMQQEKELTENILKVLKEQAADSILVLEAALKLNKDLYVHTMRTLDLLAMEPGMVNGETESSTAGLKVKT

SEQ ID NO: 40712 - protein, 291 aa, Homo sapiens; identical to SEQ ID NO: 40708
  Payload ID: 8285
  Gene Symbol: INTS8
  Gene Name: integrator complex subunit 8
  ENSP ID: ENSP00000429452

SEQ ID NO: 40713 - protein, 196 aa, Homo sapiens
  Payload ID: 8285
  Gene Symbol: INTS8
  Gene Name: integrator complex subunit 8
  ENSP ID: ENSP00000430033
MLPSVQEASGKLVFSAGRREHLRRGPRCEEISEMGTGKLKAQEINFAWVTTRTLRFAFTKILRPVATLDEVVSFSRWRTVREHGKPTRDPASCGAVSYGNREEAWFEDPAPVQLIVQFLEQASKPSVNEQNQVQPPPDNKRNRILKLLALKVAAHLKWDLDILEKSLSVPVLNMLLNELLCISKVPPGTKHVDMDL

SEQ ID NO: 40714 - protein, 183 aa, Homo sapiens
  Payload ID: 8285
  Gene Symbol: INTS8
  Gene Name: integrator complex subunit 8
  ENSP ID: ENSP00000430049
  MOD_RES (1)..(1): Any amino acid
XNNDWSEGAAVARGGGSRTAAPAGPRRHFGLYPAPVQLIVQFLEQASKPSVNEQNQVQPPPDNKRNRILKLLALKVAAHLKWDLDILEKSLSVPVLNMLLNELLCISKVPPGTKHVDMDLATLPPTTAMAVLLYNRWAIRTIVQSSFPVKQAKPGPPQLSVMNQMQQEKELTENILKVLKEQA

SEQ ID NO: 40715 - protein, 800 aa, Homo sapiens
  Payload ID: 8285
  Gene Symbol: INTS8
  Gene Name: integrator complex subunit 8
  ENSP ID: ENSP00000430180
  MOD_RES (1)..(1): Any amino acid
XEKELTENILKVLKEQAADSILVLEAALKLNKDLYVHTMRTLDLLAMEPGMVNGETESSTAGLKVKTEEMQCQVCYDLGAAYFQQGSTNSAVYENAREKFFRTKELIAEIGSLSLHCTIDEKRLAGYCQACDVLVPSSDSTSQQLTPYSQVHICLRSGNYQEVIQIFIEDNLTLSLPVQFRQSVLRELFKKAQQGNEALDEICFKVCACNTVRDILEGRTISVQFNQLFLRPNKEKIDFLLEVCSRSVNLEKASESLKGNMAAFLKNVCLGLEDLQYVFMISSHELFITLLKDEERKLLVDQMRKRSPRVNLCIKPVTSFYDIPASASVNIGQLEHQLILSVDPWRIRQILIELHGMTSERQFWTVSNKWEVPSVYSGVILGIKDNLTRDLVYILMAKGLHCSTVKDFSHAKQLFAACLELVTEFSPKLRQVMLNEMLLLDIHTHEAGTGQAGERPPSDLISRVRGYLEMRLPDIPLRQVIAEECVAFMLNWRENEYLTLQVPAFLLQSNPYVKLGQLLAATCKELPGPKESRRTAKDLWEVVVQICSVSSQHKRGNDGRVSLIKQRESTLGIMYRSELLSFIKKLREPLVLTIILSLFVKLHNVREDIVNDITAEHISIWPSSIPNLQSVDFEAVAITVKELVRYTLSINPNNHSWLIIQADIYFATNQYSAALHYYLQAGAVCSDFFNKAVPPDVYTDQVAILCQFLREIDYKTAFKSLQEQNSHDAMDSYYDYIWDVTILEYLTYLHHKRGETDKRQIAIKAIGQTELNASNPEEVLQLAAQRRKKKFLQAMAKLYF

SEQ ID NO: 40716 - protein, 995 aa, Homo sapiens
  Payload ID: 8285
  Gene Symbol: INTS8
  Gene Name: integrator complex subunit 8
  Uniprot ID: Q75QN2
  ENSP ID: ENSP00000430338
MSAEAADREAATSSRPCTPPQTCWFEFLLEESLLEKHLRKPCPDPAPVQLIVQFLEQASKPSVNEQNQVQPPPDNKRNRILKLLALKVAAHLKWDLDILEKSLSVPVLNMLLNELLCISKVPPGTKHVDMDLATLPPTTAMAVLLYNRWAIRTIVQSSFPVKQAKPGPPQLSVMNQMQQEKELTENILKVLKEQAADSILVLEAALKLNKDLYVHTMRTLDLLAMEPGMVNGETESSTAGLKVKTEEMQCQVCYDLGAAYFQQGSTNSAVYENAREKFFRTKELIAEIGSLSLHCTIDEKRLAGYCQACDVLVPSSDSTSQQLTPYSQVHICLRSGNYQEVIQIFIEDNLTLSLPVQFRQSVLRELFKKAQQGNEALDEICFKVCACNTVRDILEGRTISVQFNQLFLRPNKEKIDFLLEVCSRSVNLEKASESLKGNMAAFLKNVCLGLEDLQYVFMISSHELFITLLKDEERKLLVDQMRKRSPRVNLCIKPVTSFYDIPASASVNIGQLEHQLILSVDPWRIRQILIELHGMTSERQFWTVSNKWEVPSVYSGVILGIKDNLTRDLVYILMAKGLHCSTVKDFSHAKQLFAACLELVTEFSPKLRQVMLNEMLLLDIHTHEAGTGQAGERPPSDLISRVRGYLEMRLPDIPLRQVIAEECVAFMLNWRENEYLTLQVPAFLLQSNPYVKLGQLLAATCKELPGPKESRRTAKDLWEVVVQICSVSSQHKRGNDGRVSLIKQRESTLGIMYRSELLSFIKKLREPLVLTIILSLFVKLHNVREDIVNDITAEHISIWPSSIPNLQSVDFEAVAITVKELVRYTLSINPNNHSWLIIQADIYFATNQYSAALHYYLQAGAVCSDFFNKAVPPDVYTDQVIKRMIKCCSLLNCHTQVAILCQFLREIDYKTAFKSLQEQNSHDAMDSYYDYIWDVTILEYLTYLHHKRGETDKRQIAIKAIGQTELNASNPEEVLQLAAQRRKKKFLQAMAKLYF

SEQ ID NO: 40717 - protein, 131 aa, Homo sapiens
  Payload ID: 8285
  Gene Symbol: INTS8
  Gene Name: integrator complex subunit 8
  ENSP ID: ENSP00000430722
EMRLPDIPLRQVIAEECVAFMLNWRENEYLTLQVPAFLLQSNPYVKLGQLLAATCKELPGPKESRRTAKDLWEVVVQICSVSSQHKRGNDGRVSLIKQRESTLGIMYRSELLSFIKKLRGQGLDLSPKLEC

SEQ ID NO: 40718 - protein, 637 aa, Homo sapiens
  Payload ID: 8286
  Gene Symbol: INTS9
  Gene Name: integrator complex subunit 9
  Uniprot ID: Q9NV88
  ENSP ID: ENSP00000398208
MKLYCLSGHPTLPCNVLKFKSTTIMLDCGLDMTSTLNFLPLPLVQSPRLSNLPGWSLKDGNAFLDKTELIDLSTVDVILISNYHCMMALPYITEHTGFTGTVYATEPTVQIGRLLMEELVNFIERVPKAQSASLWKNKDIQRLLPSPLKDAVEVSTWRRCYTMQEVNSALSKIQLVGYSQKIELFGAVQVTPLSSGYALGSSNWIIQSHYEKVSYVSGSSLLTTHPQPMDQASLKNSDVLVLTGLTQIPTANPDGMVGEFCSNLALTVRNGGNVLVPCYPSGVIYDLLECLYQYIDSAGLSSVPLYFISPVANSSLEFSQIFAEWLCHNKQSKVYLPEPPFPHAELIQTNKLKHYPSIHGDFSNDFRQPCVVFTGHPSLRFGDVVHFMELWGKSSLNTVIFTEPDFSYLEALAPYQPLAMKCIYCPIDTRLNFIQVSKLLKEVQPLHVVCPEQYTQPPPAQSHRMDLMIDCQPPAMSYRRAEVLALPFKRRYEKIEIMPELADSLVPMEIKPGISLATVSAVLHTKDNKHLLQPPPRPAQPTSGKKRKRVSDDVPDCKVLKPLLSGSIPVEQFVQTLEKHGFSDIKVEDTAKGHIVLLQEAETLIQIEEDSTHIICDNDEMLRVRLRDLVLKFLQKF

SEQ ID NO: 40719 - protein, 300 aa, Homo sapiens
  Payload ID: 8286
  Gene Symbol: INTS9
  Gene Name: integrator complex subunit 9
  ENSP ID: ENSP00000427789
MKLYCLSGHPTLPCNVLKFKSTTIMLDCGLDMTSTLNFLPLPLVQSPRLSNLPGWSLKDGNAFLDKELKECSGHVFVDSVPEFCLPETELIDLSTVDVILISNYHCMMALPYITEHTGFTGTVYATEPTVQIGRLLMEELVNFIERVPKAQSASLWKNKDIQRLLPSPLKDAVEVSTWRRCYTMQEVNSALSKIQLVGYSQKIPMDQASLKNSDVLVLTGLTQIPTANPDGMVGEFCSNLALTVRNGGNVLVPCYPSGVIYDLLECLYQYIDSAGLSSVPLYFISPVANSSLEFSQIFAE

SEQ ID NO: 40720 - protein, 525 aa, Homo sapiens
  Payload ID: 8286
  Gene Symbol: INTS9
  Gene Name: integrator complex subunit 9
  ENSP ID: ENSP00000427952
MKLYCLSGHPTLPCNVLKFKSTTIMLDCGLDMTSTLNFLPLPLVQSPRLSNLPGWSLKDGNAFLDKELKECSGHVFVDSVPEFCLPETELIDLSTVDVILISNYHCMMALPYITEHTGFTGTVYATEPTVQIGRLLMEELVNFIERVPKAQSASLWKNKDIQRLLPSPLKDAVEVSTWRRCYTMQEVNSALSKIQLVGYSQKIELFGAVQVTPLSSGYALGSSNWIIQSHYEKVSYVSGSSLLTTHPQPMDQASLKNSDVLVLTGLTQIPTANPDGMVGEFCSNLALTVRNGGNVLVPCYPSGVIYDLLECLYQYIDSAGLSSVPLYFISPVANSSLEFSQIFAEWLCHNKQSKVYLPEPPFPHAELIQTNKLKHYPSIHGDFSNDFRQPCVVFTGHPSLRFGDVVHFMELWGKSSLNTVIFTEPDFSYLEALAPYQPLAMKCIYCPIDTRLNFIQVSKLLKEVQPLHVVCPEQYTQPPPAQSHRMDLMIDCQPPAMSYRRAEVLALPFKRRYEKIEIMPETAVM

SEQ ID NO: 40721 - protein, 170 aa, Homo sapiens
  Payload ID: 8286
  Gene Symbol: INTS9
  Gene Name: integrator complex subunit 9
  ENSP ID: ENSP00000428135
MKLYCLSGHPTLPCNVLKFKSTTIMLDCGLDMTSTLNFLPLPLVQSPRLSNLPGWSLKDGNAFLDKELKECSGHVFVDSVPEFCLPETELIDLSTVDVILISNYHCMMALPYITEHTGFTGTVYATEPTVQIGRLLMEELVNFIERVPKAQSASLWKNKDIQRSFLVRSR

SEQ ID NO: 40722 - protein, 658 aa, Homo sapiens
  Payload ID: 8286
  Gene Symbol: INTS9
  Gene Name: integrator complex subunit 9
  Uniprot ID: Q9NV88
  ENSP ID: ENSP00000429065
MKLYCLSGHPTLPCNVLKFKSTTIMLDCGLDMTSTLNFLPLPLVQSPRLSNLPGWSLKDGNAFLDKELKECSGHVFVDSVPEFCLPETELIDLSTVDVILISNYHCMMALPYITEHTGFTGTVYATEPTVQIGRLLMEELVNFIERVPKAQSASLWKNKDIQRLLPSPLKDAVEVSTWRRCYTMQEVNSALSKIQLVGYSQKIELFGAVQVTPLSSGYALGSSNWIIQSHYEKVSYVSGSSLLTTHPQPMDQASLKNSDVLVLTGLTQIPTANPDGMVGEFCSNLALTVRNGGNVLVPCYPSGVIYDLLECLYQYIDSAGLSSVPLYFISPVANSSLEFSQIFAEWLCHNKQSKVYLPEPPFPHAELIQTNKLKHYPSIHGDFSNDFRQPCVVFTGHPSLRFGDVVHFMELWGKSSLNTVIFTEPDFSYLEALAPYQPLAMKCIYCPIDTRLNFIQVSKLLKEVQPLHVVCPEQYTQPPPAQSHRMDLMIDCQPPAMSYRRAEVLALPFKRRYEKIEIMPELADSLVPMEIKPGISLATVSAVLHTKDNKHLLQPPPRPAQPTSGKKRKRVSDDVPDCKVLKPLLSGSIPVEQFVQTLEKHGFSDIKVEDTAKGHIVLLQEAETLIQIEEDSTHIICDNDEMLRVRLRDLVLKFLQKF

SEQ ID NO: 40723 - protein, 87 aa, Homo sapiens
  Payload ID: 8286
  Gene Symbol: INTS9
  Gene Name: integrator complex subunit 9
  ENSP ID: ENSP00000429188
MLDCGLDMTSTLNFLPLPLVQSPRLSNLPGWSLKDGNAFLDKELKECSGHVFVDSVPEFCLPETELIDLSTVDVILISNYHCMMALP

SEQ ID NO: 40724 - protein, 223 aa, Homo sapiens
  Payload ID: 8286
  Gene Symbol: INTS9
  Gene Name: integrator complex subunit 9
  ENSP ID: ENSP00000429539
  MOD_RES (1)..(1): Any amino acid
XPTLPCNVLKFKSTTIMLDCGLDMTSTLNFLPLPLVQSPRLSNLPGWSLKDGNAFLDKELKECSGHVFVDSVPEFCLPETELIDLSTVDVILISNYHCMMALPYITEHTGFTGTVYATEPTVQIGRLLPSPLKDAVEVSTWRRCYTMQEVNSALSKIQLVGYSQKIELFGAVQVTPLSSGYALGSSNWIIQSHYEKVSYVSGSSLLTTHPQPMDQASLKNSDV

SEQ ID NO: 40725 - protein, 150 aa, Homo sapiens
  Payload ID: 8286
  Gene Symbol: INTS9
  Gene Name: integrator complex subunit 9
  ENSP ID: ENSP00000429691
  MOD_RES (1)..(1): Any amino acid
XPMEIKPGISLATVSAVLHTKDNKHLLQPPPRPAQPTSGKKRKRVSDDVPDCKVLKPLLSGSIPVEQFVQTLEKISQMCSLPSPPLSFLLEQHGFSDIKVEDTAKGHIVLLQEAETLIQIEEDSTHIICDNDEMLRVRLRDLVLKFLQKF

SEQ ID NO: 40726 - protein, 25 aa, Homo sapiens
  Payload ID: 8286
  Gene Symbol: INTS9
  Gene Name: integrator complex subunit 9
  ENSP ID: ENSP00000430067
IMLDCGLDMTSTLNFLPLPLVQRRS

SEQ ID NO: 40727 - protein, 38 aa, Homo sapiens
  Payload ID: 8286
  Gene Symbol: INTS9
  Gene Name: integrator complex subunit 9
  ENSP ID: ENSP00000430083
MKLSQAVQSSWLVPEGWKCFLGQDGANRSVYSRCDSHL

SEQ ID NO: 40728 - protein, 634 aa, Homo sapiens
  Payload ID: 8286
  Gene Symbol: INTS9
  Gene Name: integrator complex subunit 9
  Uniprot ID: Q9NV88
  ENSP ID: ENSP00000430943
MLDCGLDMTSTLNFLPLPLVQSPRLSNLPGWSLKDGNAFLDKELKECSGHVFVDSVPEFCLPETELIDLSTVDVILISNYHCMMALPYITEHTGFTGTVYATEPTVQIGRLLMEELVNFIERVPKAQSASLWKNKDIQRLLPSPLKDAVEVSTWRRCYTMQEVNSALSKIQLVGYSQKIELFGAVQVTPLSSGYALGSSNWIIQSHYEKVSYVSGSSLLTTHPQPMDQASLKNSDVLVLTGLTQIPTANPDGMVGEFCSNLALTVRNGGNVLVPCYPSGVIYDLLECLYQYIDSAGLSSVPLYFISPVANSSLEFSQIFAEWLCHNKQSKVYLPEPPFPHAELIQTNKLKHYPSIHGDFSNDFRQPCVVFTGHPSLRFGDVVHFMELWGKSSLNTVIFTEPDFSYLEALAPYQPLAMKCIYCPIDTRLNFIQVSKLLKEVQPLHVVCPEQYTQPPPAQSHRMDLMIDCQPPAMSYRRAEVLALPFKRRYEKIEIMPELADSLVPMEIKPGISLATVSAVLHTKDNKHLLQPPPRPAQPTSGKKRKRVSDDVPDCKVLKPLLSGSIPVEQFVQTLEKHGFSDIKVEDTAKGHIVLLQEAETLIQIEEDSTHIICDNDEMLRVRLRDLVLKFLQKF

SEQ ID NO: 40729 - protein, 612 aa, Homo sapiens
  Payload ID: 8287
  Gene Symbol: ITFG1
  Gene Name: integrin alpha FG-GAP repeat containing 1
  Uniprot ID: Q8TB96
  ENSP ID: ENSP00000319918
MAAAGRLPSSWALFSPLLAGLALLGVGPVPARALHNVTAELFGAEAWGTLAAFGDLNSDKQTDLFVLRERNDLIVFLADQNAPYFKPKVKVSFKNHSALITSVVPGDYDGDSQMDVLLTYLPKNYAKSELGAVIFWGQNQTLDPNNMTILNRTFQDEPLIMDFNGDLIPDIFGITNESNQPQILLGGNLSWHPALTTTSKMRIPHSHAFIDLTEDFTADLFLTTLNATTSTFQFEIWENLDGNFSVSTILEKPQNMMVVGQSAFADFDGDGHMDHLLPGCEDKNCQKSTIYLVRSGMKQWVPVLQDFSNKGTLWGFVPFVDEQQPTEIPIPITLHIGDYNMDGYPDALVILKNTSGSNQQAFLLENVPCNNASCEEARRMFKVYWELTDLNQIKDAMVATFFDIYEDGILDIVVLSKGYTKNDFAIHTLKNNFEADAYFVKVIVLSGLCSNDCPRKITPFGVNQPGPYIMYTTVDANGYLKNGSAGQLSQSAHLALQLPYNVLGLGRSANFLDHLYVGIPRPSGEKSIRKQEWTAIIPNSQLIVIPYPHNVPRSWSAKLYLTPSNIVLLTAIALIGVCVFILAIIGILHWQEKKADDREKRQEAHRFHFDAM

SEQ ID NO: 40730 - protein, 464 aa, Homo sapiens
  Payload ID: 8287
  Gene Symbol: ITFG1
  Gene Name: integrin alpha FG-GAP repeat containing 1
  ENSP ID: ENSP00000441062
MDVLLTYLPKNYAKSELGAVIFWGQNQTLDPNNMTILNRTFQDEPLIMDFNGDLIPDIFGITNESNQPQILLGGNLSWHPALTTTSKMRIPHSHAFIDLTEDFTADLFLTTLNATTSTFQFEIWENLDGNFSVSTILEKPQNMMVVGQSAFADFDGDGHMDHLLPGCEDKNCQKSTIYLVRSGMKQWVPVLQDFSNKGTLWGFVPFVDEQQPTEIPIPITLHIGDYNMDGYPDALVILKNTSGSNQQAFLLENVPCNNASCEEARRMFKVYWELTDLNQIKDAMVATFFDIYEDGILDIVVLSKGYTKNDFAIHTLKNNFEADAYFVKVIVLSGLCSNDCPRKITPFGVNQPGPYIMYTTVDANGYLKNGSAGQLSQSAHLALQLPYNVLGLGRSANFLDHLYVGIPRPSGEKSIRKQEWTAIIPNSQLIVIPYPHNVPRSSHRCLCFHLGNNWHFTLAGKESR

SEQ ID NO: 40731 - protein, 73 aa, Homo sapiens
  Payload ID: 8287
  Gene Symbol: ITFG1
  Gene Name: integrin alpha FG-GAP repeat containing 1
  ENSP ID: ENSP00000455630
MDVLLTYLPKNYAKSELGAVIFWGQNQTLDPNNMTILNRTFQDEPLIMDFNGDLIPDIFGITNESNQPQILLG

SEQ ID NO: 40732 - protein, 178 aa, Homo sapiens
  Payload ID: 8287
  Gene Symbol: ITFG1
  Gene Name: integrin alpha FG-GAP repeat containing 1
  ENSP ID: ENSP00000457665
VLSKGYTKNDFAIHTLKNNFEADAYFVKVIVLSGLCSNDCPRKITPFGVNQPGPYIMYTTVDANGYLKNGSGRSANFLDHLYVGIPRPSGEKSIRKQEWTAIIPNSQLIVIPYPHNVPRSWSAKLYLTPSNIVLLTAIALIGVCVFILAIIGILHWQEKKADDREKRQEAHRFHFDAM

SEQ ID NO: 40733 - protein, 113 aa, Homo sapiens
  Payload ID: 8287
  Gene Symbol: ITFG1
  Gene Name: integrin alpha FG-GAP repeat containing 1
  ENSP ID: ENSP00000459192
  MOD_RES (1)..(1): Any amino acid
XKPKVKVSFKNHSALITSVVPGDYDGDSQMDVLLTYLPKNYAKSELGAVIFWGQNQTLDPNNMTILNRTFQDEPLIMDFNGDLIPDIFGITNESNQPQILLGGHTTLNAPHLF

SEQ ID NO: 40734 - protein, 447 aa, Homo sapiens
  Payload ID: 8288
  Gene Symbol: ITFG2
  Gene Name: integrin alpha FG-GAP repeat containing 2
  Uniprot ID: Q969R8
  ENSP ID: ENSP00000228799
MRSVSYVQRVALEFSGSLFPHAICLGDVDNDTLNELVVGDTSGKVSVYKNDDSRPWLTCSCQGMLTCVGVGDVCNKGKNLLVAVSAEGWFHLFDLTPAKVLDASGHHETLIGEEQRPVFKQHIPANTKVMLISDIDGDGCRELVVGYTDRVVRAFRWEELGEGPEHLTGQLVSLKKWMLEGQVDSLSVTLGPLGLPELMVSQPGCAYAILLCTWKKDTGSPPASEGPTDGSRETPAARDVVLHQTSGRIHNKNVSTHLIGNIKQGHGTESSGSGLFALCTLDGTLKLMEEMEEADKLLWSVQVDHQLFALEKLDVTGNGHEEVVACAWDGQTYIIDHNRTVVRFQVDENIRAFCAGLYACKEGRNSPCLVYVTFNQKIYVYWEVQLERMESTNLVKLLETKPEYHSLLQELGVDPDDLPVTRALLHQTLYHPDQPPQCAPSSLQDPT

SEQ ID NO: 40735 - protein, 131 aa, Homo sapiens
  Payload ID: 8288
  Gene Symbol: ITFG2
  Gene Name: integrin alpha FG-GAP repeat containing 2
  ENSP ID: ENSP00000439324
GNGHEEVVACAWDGQTYIIDHNRTVVRFQVDENIRAFCAGLYACKEGRNSPCLVYVTFNQKIYVYWEVQLERMESTNLVKLLETKPEYHSLLQELGVDPDDLPVTRALLHQTLYHPDQPPQCAPSSLQDPT

SEQ ID NO: 40736 - protein, 17 aa, Homo sapiens
  Payload ID: 8288
  Gene Symbol: ITFG2
  Gene Name: integrin alpha FG-GAP repeat containing 2
  ENSP ID: ENSP00000440015
  MOD_RES (1)..(1): Any amino acid
XLVVGDTSGKVSVVLAG

SEQ ID NO: 40737 - protein, 57 aa, Homo sapiens
  Payload ID: 8288
  Gene Symbol: ITFG2
  Gene Name: integrin alpha FG-GAP repeat containing 2
  ENSP ID: ENSP00000442023
  MOD_RES (1)..(1): Any amino acid
XTNLVKLLETKPEYHSLLQELGVDPDDLPVTRALLHQTLYHPDQPPQCAPSSLQDPT

SEQ ID NO: 40738 - protein, 147 aa, Homo sapiens
  Payload ID: 8288
  Gene Symbol: ITFG2
  Gene Name: integrin alpha FG-GAP repeat containing 2
  Uniprot ID: Q969R8
  ENSP ID: ENSP00000443329
MRSVSYVQRVALEFSGSLFPHAICLGDVDNDTLNELVVGDTSGKVSVYKNDDSRPWLTCSCQGMLTCVGVGDVCNKGKNLLVAVSAEGWFHLFDLTPAKVLDASGHHETLIGEEQRPVFKQHIPANTKVMLISDIGGHAYLCRQPGE

SEQ ID NO: 40739 - protein, 59 aa, Homo sapiens
  Payload ID: 8288
  Gene Symbol: ITFG2
  Gene Name: integrin alpha FG-GAP repeat containing 2
  ENSP ID: ENSP00000444331
  MOD_RES (1)..(1): Any amino acid
XYWEVQLERMESTNLVKLLETKPEYHSLLQELGVGESQKSQWPECPGDPQHAAGAGRGS

SEQ ID NO: 40740 - protein, 56 aa, Homo sapiens
  Payload ID: 8288
  Gene Symbol: ITFG2
  Gene Name: integrin alpha FG-GAP repeat containing 2
  ENSP ID: ENSP00000445769
MRSVSYVQRVALEFSGSLFPHAICLGDVDNDTMEMGVVSWWWATQTVWCELSAGRS

SEQ ID NO: 40741 - protein, 347 aa, Homo sapiens
  Payload ID: 8289
  Gene Symbol: ITGB1BP2
  Gene Name: integrin beta 1 binding protein (melusin) 2
  Uniprot ID: Q9UKP3
  ENSP ID: ENSP00000362935
MSLLCRNKGCGQHFDPNTNLPDSCCHHPGVPIFHDALKGWSCCRKRTVDFSEFLNIKGCTMGPHCAEKLPEAPQPEGPATSSSLQEQKPLNVIPKSAETLRRERPKSELPLKLLPLNISQALEMALEQKELDQEPGAGLDSLIRTGSSCQNPGCDAVYQGPESDATPCTYHPGAPRFHEGMKSWSCCGIQTLDFGAFLAQPGCRVGRHDWGKQLPASCRHDWHQTDSLVVVTVYGQIPLPAFNWVKASQTELHVHIVFDGNRVFQAQMKLWGVINVEQSSVFLMPSRVEISLVKADPGSWAQLEHPDALAKKARAGVVLEMDEEESDDSDDDLSWTEEEEEEEAMGE

SEQ ID NO: 40742 - protein, 329 aa, Homo sapiens
  Payload ID: 8289
  Gene Symbol: ITGB1BP2
  Gene Name: integrin beta 1 binding protein (melusin) 2
  Uniprot ID: Q9UKP3
  ENSP ID: ENSP00000440289
MSTDSCCHHPGVPIFHDALKGWSCCRKRTVDFSEFLNIKGCTMGPHCAEKLPEAPQPEGPATSSSLQEQKPLNVIPKSAETLRRERPKSELPLKLLPLNISQALEMALEQKELDQEPGAGLDSLIRTGSSCQNPGCDAVYQGPESDATPCTYHPGAPRFHEGMKSWSCCGIQTLDFGAFLAQPGCRVGRHDWGKQLPASCRHDWHQTDSLVVVTVYGQIPLPAFNWVKASQTELHVHIVFDGNRVFQAQMKLWGVINVEQSSVFLMPSRVEISLVKADPGSWAQLEHPDALAKKARAGVVLEMDEEESDDSDDDLSWTEEEEEEEAMGE

SEQ ID NO: 40743 - protein, 150 aa, Homo sapiens
  Payload ID: 8290
  Gene Symbol: ITGB1BP1
  Gene Name: integrin beta 1 binding protein 1
  Uniprot ID: O14713
  ENSP ID: ENSP00000238091
MFRKGKKRHSSSSSQSSEISTKSKSVDSSLGGLSRSSTVASLDTDSTKSSGQSNNNSDTCAEFRIKYVGAIEKLKLSEGKGLEGPLDLINYIDVAQQDGKLPFVPPEEEFIMGVSKYGIKVSTSDQYEQAQAICKVLSTAFDSVLTSEKP

SEQ ID NO: 40744 - protein, 200 aa, Homo sapiens
  Payload ID: 8290
  Gene Symbol: ITGB1BP1
  Gene Name: integrin beta 1 binding protein 1
  Uniprot ID: O14713
  ENSP ID: ENSP00000347504
MFRKGKKRHSSSSSQSSEISTKSKSVDSSLGGLSRSSTVASLDTDSTKSSGQSNNNSDTCAEFRIKYVGAIEKLKLSEGKGLEGPLDLINYIDVAQQDGKLPFVPPEEEFIMGVSKYGIKVSTSDQYDVLHRHALYLIIRMVCYDDGLGAGKSLLALKTTDASNEEYSLWVYQCNSLEQAQAICKVLSTAFDSVLTSEKP

SEQ ID NO: 40745 - protein, 184 aa, Homo sapiens
  Payload ID: 8290
  Gene Symbol: ITGB1BP1
  Gene Name: integrin beta 1 binding protein 1
  ENSP ID: ENSP00000352743
MFRKGKKRHSSSSSQSSEISTKSKSVDSSLGGLSRSSTVASLDTDSTKSSGQSNNNSDTCAEFRIKYVGAIEKLKLSEGKGLEGPLDLINYIDVAQQDGKLPFVPPEEEFIMGVSKYGIKVSTSDQYDVLHRHALYLIIRMVCYDDGLGAGKSLLALKTTDASNEEYSLWVYQCNSLVRLRYFG

SEQ ID NO: 40746 - protein, 200 aa, Homo sapiens; identical to SEQ ID NO: 40744
  Payload ID: 8290
  Gene Symbol: ITGB1BP1
  Gene Name: integrin beta 1 binding protein 1
  Uniprot ID: O14713
  ENSP ID: ENSP00000353850

SEQ ID NO: 40747 - protein, 184 aa, Homo sapiens; identical to SEQ ID NO: 40745
  Payload ID: 8290
  Gene Symbol: ITGB1BP1
  Gene Name: integrin beta 1 binding protein 1
  ENSP ID: ENSP00000389704

SEQ ID NO: 40748 - protein, 84 aa, Homo sapiens
  Payload ID: 8290
  Gene Symbol: ITGB1BP1
  Gene Name: integrin beta 1 binding protein 1
  ENSP ID: ENSP00000417850
MFRKGKKRHSSSSSQSSEISTKSKSVDSSLGGLSRSSTVASLDTDSTKSSGQSNNNSDTCAEFRIKYVGAIEKLKLSEGKGLEG

SEQ ID NO: 40749 - protein, 114 aa, Homo sapiens
  Payload ID: 8290
  Gene Symbol: ITGB1BP1
  Gene Name: integrin beta 1 binding protein 1
  ENSP ID: ENSP00000417940
MFRKGKKRHSSSSSQSSEISTKSKSVDSSLGGLSRSSTVASLDTDSTKSSGQSNNNSDTCAEFRIKYVGAIEKLKLSEGKGLEGPLDLINYIDVAQQDGKLPFVPPEEEFIMGV

SEQ ID NO: 40750 - protein, 86 aa, Homo sapiens
  Payload ID: 8290
  Gene Symbol: ITGB1BP1
  Gene Name: integrin beta 1 binding protein 1
  ENSP ID: ENSP00000418526
MFRKGKKRHSSSSSQSSEISTKSKSVDSSLGGLSRSSTVASLDTDSTKSSGQSNNNSDTCAEFRIKYVGAIEKLKLSEGKGLEGPL

SEQ ID NO: 40751 - protein, 65 aa, Homo sapiens
  Payload ID: 8290
  Gene Symbol: ITGB1BP1
  Gene Name: integrin beta 1 binding protein 1
  ENSP ID: ENSP00000418947
MFRKGKKRHSSSSSQSSEISTKSKSVDSSLGGLSRSSTVASLDTDSTKSSGQSNNNSDTCAEFRI

SEQ ID NO: 40752 - protein, 38 aa, Homo sapiens
  Payload ID: 8290
  Gene Symbol: ITGB1BP1
  Gene Name: integrin beta 1 binding protein 1
  ENSP ID: ENSP00000419452
MFRKGKKRHSSSSSQSSEISTKSKDKATIIQIPVQNFE

SEQ ID NO: 40753 - protein, 150 aa, Homo sapiens; identical to SEQ ID NO: 40743
  Payload ID: 8290
  Gene Symbol: ITGB1BP1
  Gene Name: integrin beta 1 binding protein 1
  Uniprot ID: O14713
  ENSP ID: ENSP00000419524

SEQ ID NO: 40754 - protein, 96 aa, Homo sapiens
  Payload ID: 8290
  Gene Symbol: ITGB1BP1
  Gene Name: integrin beta 1 binding protein 1
  ENSP ID: ENSP00000419814
MFRKGKKRHSSSSSQSSEISTKSKSVDSSLGGLSRSSTVASLDTDSTKSSGQSNNNSDTCAEFRIKYVGAIEKLKLSEGKGLEGPLDLINYIDVAQ

SEQ ID NO: 40755 - protein, 136 aa, Homo sapiens
  Payload ID: 8290
  Gene Symbol: ITGB1BP1
  Gene Name: integrin beta 1 binding protein 1
  ENSP ID: ENSP00000420770
MFRKGKKRHSSSSSQSSEISTKSKSVDSSLGGLSRSSTVASLDTDSTKSSGQSNNNSDTCAEFRIKYVGAIEKLKLSEGKGLEGPLDLINYIDVAQQDGKLPFVPPEEEFIMGVSKYGIKVSTSDQYDVLHRHALY

SEQ ID NO: 40756 - protein, 107 aa, Homo sapiens
  Payload ID: 8290
  Gene Symbol: ITGB1BP1
  Gene Name: integrin beta 1 binding protein 1
  ENSP ID: ENSP00000433814
MFRKGKKRHSSSSSQSSEISTKSKSVDSSLGGLSRSSTVASLDTDSTKSSGQSNNNSDTCAEFRIKYVGAIEKLKLSEGKGLEGPLDLINYIDVAQVKKKNSVTLWL

SEQ ID NO: 40757 - protein, 177 aa, Homo sapiens
  Payload ID: 8291
  Gene Symbol: ITGB3BP
  Gene Name: integrin beta 3 binding protein (beta3-endonexin)
  Uniprot ID: Q13352
  ENSP ID: ENSP00000271002
MPVKRSLKLDGLLEENSFDPSKITRKKSVITYSPTTGTCQMSLFASPTSSEEQKHRNGLSNEKRKKLNHPSLTESKESTTKDNDEFMMLLSKVEKLSEEIMEIMQNLSSIQALEGSRELENLIGISCASHFLKREMQKTKELMTKVNKQKLFEKSTGLPHKASRHLDSYEFLKAILN

SEQ ID NO: 40758 - protein, 216 aa, Homo sapiens
  Payload ID: 8291
  Gene Symbol: ITGB3BP
  Gene Name: integrin beta 3 binding protein (beta3-endonexin)
  Uniprot ID: Q13352
  ENSP ID: ENSP00000360133
MPFAPVAQARVQWHDFRSLQHLLPAFKRFSCLSLGSSWDYSVKRSLKLDGLLEENSFDPSKITRKKSVITYSPTTGTCQMSLFASPTSSEEQKHRNGLSNEKRKKLNHPSLTESKESTTKDNDEFMMLLSKVEKLSEEIMEIMQNLSSIQALEGSRELENLIGISCASHFLKREMQKTKELMTKVNKQKLFEKSTGLPHKASRHLDSYEFLKAILN

SEQ ID NO: 40759 - protein, 170 aa, Homo sapiens
  Payload ID: 8291
  Gene Symbol: ITGB3BP
  Gene Name: integrin beta 3 binding protein (beta3-endonexin)
  Uniprot ID: Q13352
  ENSP ID: ENSP00000432904
MPVKRSLKLDGLLEENSFDPSKITRKKSVITYSPTTGTCQMSLFASPTSSEEQKHRNGLSNEKRKKLNHPSLTESKESTTKDNDEFMMLLSKVEKLSEEIMEIMQNLSSIQALEGSRELENLIGISCASHFLKREMQKTKELMTKVNKQKLFEKSTGLPHKGQPQMSQPL

SEQ ID NO: 40760 - protein, 1179 aa, Homo sapiens
  Payload ID: 8292
  Gene Symbol: ITGA1
  Gene Name: integrin, alpha 1
  Uniprot ID: P56199
  ENSP ID: ENSP00000282588
MAPRPRARPGVAVACCWLLTVVLRCCVSFNVDVKNSMTFSGPVEDMFGYTVQQYENEEGKWVLIGSPLVGQPKNRTGDVYKCPVGRGESLPCVKLDLPVNTSIPNVTEVKENMTFGSTLVTNPNGGFLACGPLYAYRCGHLHYTTGICSDVSPTFQVVNSIAPVQECSTQLDIVIVLDGSNSIYPWDSVTAFLNDLLERMDIGPKQTQVGIVQYGENVTHEFNLNKYSSTEEVLVAAKKIVQRGGRQTMTALGIDTARKEAFTEARGARRGVKKVMVIVTDGESHDNHRLKKVIQDCEDENIQRFSIAILGSYNRGNLSTEKFVEEIKSIASEPTEKHFFNVSDELALVTIVKTLGERIFALEATADQSAASFEMEMSQTGFSAHYSQDWVMLGAVGAYDWNGTVVMQKASQIIIPRNTTFNVESTKKNEPLASYLGYTVNSATASSGDVLYIAGQPRYNHTGQVIIYRMEDGNIKILQTLSGEQIGSYFGSILTTTDIDKDSNTDILLVGAPMYMGTEKEEQGKVYVYALNQTRFEYQMSLEPIKQTCCSSRQHNSCTTENKNEPCGARFGTAIAAVKDLNLDGFNDIVIGAPLEDDHGGAVYIYHGSGKTIRKEYAQRIPSGGDGKTLKFFGQSIHGEMDLNGDGLTDVTIGGLGGAALFWSRDVAVVKVTMNFEPNKVNIQKKNCHMEGKETVCINATVCFDVKLKSKEDTIYEADLQYRVTLDSLRQISRSFFSGTQERKVQRNITVRKSECTKHSFYMLDKHDFQDSVRITLDFNLTDPENGPVLDDSLPNSVHEYIPFAKDCGNKEKCISDLSLHVATTEKDLLIVRSQNDKFNVSLTVKNTKDSAYNTRTIVHYSPNLVFSGIEAIQKDSCESNHNITCKVGYPFLRRGEMVTFKILFQFNTSYLMENVTIYLSATSDSEEPPETLSDNVVNISIPVKYEVGLQFYSSASEYHISIAANETVPEVINSTEDIGNEINIFYLIRKSGSFPMPELKLSISFPNMTSNGYPVLYPTGLSSSENANCRPHIFEDPFSINSGKKMTTSTDHLKRGTILDCNTCKFATITCNLTSSDISQVNVSLILWKPTFIKSYFSSLNLTIRGELRSENASLVLSSSNQKRELAIQISKDGLPGRVPLWVILLSAFAGLLLLMLLILALWKIGFFKRPLKKKMEK

SEQ ID NO: 40761 - protein, 1167 aa, Homo sapiens
  Payload ID: 8293
  Gene Symbol: ITGA10
  Gene Name: integrin, alpha 10
  Uniprot ID: O75578
  ENSP ID: ENSP00000358310
MELPFVTHLFLPLVFLTGLCSPFNLDEHHPRLFPGPPEAEFGYSVLQHVGGGQRWMLVGAPWDGPSGDRRGDVYRCPVGGAHNAPCAKGHLGDYQLGNSSHPAVNMHLGMSLLETDGDGGFMACAPLWSRACGSSVFSSGICARVDASFQPQGSLAPTAQRCPTYMDVVIVLDGSNSIYPWSEVQTFLRRLVGKLFIDPEQIQVGLVQYGESPVHEWSLGDFRTKEEVVRAAKNLSRREGRETKTAQAIMVACTEGFSQSHGGRPEAARLLVVVTDGESHDGEELPAALKACEAGRVTRYGIAVLGHYLRRQRDPSSFLREIRTIASDPDERFFFNVTDEAALTDIVDALGDRIFGLEGSHAENESSFGLEMSQIGFSTHRLKDGILFGMVGAYDWGGSVLWLEGGHRLFPPRMALEDEFPPALQNHAAYLGYSVSSMLLRGGRRLFLSGAPRFRHRGKVIAFQLKKDGAVRVAQSLQGEQIGSYFGSELCPLDTDRDGTTDVLLVAAPMFLGPQNKETGRVYVYLVGQQSLLTLQGTLQPEPPQDARFGFAMGALPDLNQDGFADVAVGAPLEDGHQGALYLYHGTQSGVRPHPAQRIAAASMPHALSYFGRSVDGRLDLDGDDLVDVAVGAQGAAILLSSRPIVHLTPSLEVTPQAISVVQRDCRRRGQEAVCLTAALCFQVTSRTPGRWDHQFYMRFTASLDEWTAGARAAFDGSGQRLSPRRLRLSVGNVTCEQLHFHVLDTSDYLRPVALTVTFALDNTTKPGPVLNEGSPTSIQKLVPFSKDCGPDNECVTDLVLQVNMDIRGSRKAPFVVRGGRRKVLVSTTLENRKENAYNTSLSLIFSRNLHLASLTPQRESPIKVECAAPSAHARLCSVGHPVFQTGAKVTFLLEFEFSCSSLLSQVFVKLTASSDSLERNGTLQDNTAQTSAYIQYEPHLLFSSESTLHRYEVHPYGTLPVGPGPEFKTTLRVQNLGCYVVSGLIISALLPAVAHGGNYFLSLSQVITNNASCIVQNLTEPPGPPVHPEELQHTNRLNGSNTQCQVVRCHLGQLAKGTEVSVGLLRLVHNEFFRRAKFKSLTVVSTFELGTEEGSVLQLTEASRWSESLLEVVQTRPILISLWILIGSVLGGLLLLALLVFCLWKLGFFAHKKIPEEEKREEKLEQ

SEQ ID NO: 40762 - protein, 1024 aa, Homo sapiens
  Payload ID: 8293
  Gene Symbol: ITGA10
  Gene Name: integrin, alpha 10
  Uniprot ID: O75578
  ENSP ID: ENSP00000439894
MELPFVTHLFLPLVFLTGCPTYMDVVIVLDGSNSIYPWSEVQTFLRRLVGKLFIDPEQIQVGLVQYGESPVHEWSLGDFRTKEEVVRAAKNLSRREGRETKTAQAIMVACTEGFSQSHGGRPEAARLLVVVTDGESHDGEELPAALKACEAGRVTRYGIAVLGHYLRRQRDPSSFLREIRTIASDPDERFFFNVTDEAALTDIVDALGDRIFGLEGSHAENESSFGLEMSQIGFSTHRLKDGILFGMVGAYDWGGSVLWLEGGHRLFPPRMALEDEFPPALQNHAAYLGYSVSSMLLRGGRRLFLSGAPRFRHRGKVIAFQLKKDGAVRVAQSLQGEQIGSYFGSELCPLDTDRDGTTDVLLVAAPMFLGPQNKETGRVYVYLVGQQSLLTLQGTLQPEPPQDARFGFAMGALPDLNQDGFADVAVGAPLEDGHQGALYLYHGTQSGVRPHPAQRIAAASMPHALSYFGRSVDGRLDLDGDDLVDVAVGAQGAAILLSSRPIVHLTPSLEVTPQAISVVQRDCRRRGQEAVCLTAALCFQVTSRTPGRWDHQFYMRFTASLDEWTAGARAAFDGSGQRLSPRRLRLSVGNVTCEQLHFHVLDTSDYLRPVALTVTFALDNTTKPGPVLNEGSPTSIQKLVPFSKDCGPDNECVTDLVLQVNMDIRGSRKAPFVVRGGRRKVLVSTTLENRKENAYNTSLSLIFSRNLHLASLTPQRESPIKVECAAPSAHARLCSVGHPVFQTGAKVTFLLEFEFSCSSLLSQVFVKLTASSDSLERNGTLQDNTAQTSAYIQYEPHLLFSSESTLHRYEVHPYGTLPVGPGPEFKTTLRVQNLGCYVVSGLIISALLPAVAHGGNYFLSLSQVITNNASCIVQNLTEPPGPPVHPEELQHTNRLNGSNTQCQVVRCHLGQLAKGTEVSVGLLRLVHNEFFRRAKFKSLTVVSTFELGTEEGSVLQLTEASRWSESLLEVVQTRPILISLWILIGSVLGGLLLLALLVFCLWKLGFFAHKKIPEEEKREEKLEQ

SEQ ID NO: 40763 - protein, 1188 aa, Homo sapiens
  Payload ID: 8294
  Gene Symbol: ITGA11
  Gene Name: integrin, alpha 11
  Uniprot ID: Q9UKX5
  ENSP ID: ENSP00000327290
MDLPRGLVVAWALSLWPGFTDTFNMDTRKPRVIPGSRTAFFGYTVQQHDISGNKWLVVGAPLETNGYQKTGDVYKCPVIHGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFLNEIKYIASDPDDKHFFNVTDEAALKDIVDALGDRIFSLEGTNKNETSFGLEMSQTGFSSHVVEDGVLLGAVGAYDWNGAVLKETSAGKVIPLRESYLKEFPEELKNHGAYLGYTVTSVVSSRQGRVYVAGAPRFNHTGKVILFTMHNNRSLTIHQAMRGQQIGSYFGSEITSVDIDGDGVTDVLLVGAPMYFNEGRERGKVYVYELRQNLFVYNGTLKDSHSYQNARFGSSIASVRDLNQDSYNDVVVGAPLEDNHAGAIYIFHGFRGSILKTPKQRITASELATGLQYFGCSIHGQLDLNEDGLIDLAVGALGNAVILWSRPVVQINASLHFEPSKINIFHRDCKRSGRDATCLAAFLCFTPIFLAPHFQTTTVGIRYNATMDERRYTPRAHLDEGGDRFTNRAVLLSSGQELCERINFHVLDTADYVKPVTFSVEYSLEDPDHGPMLDDGWPTTLRVSVPFWNGCNEDEHCVPDLVLDARSDLPTAMEYCQRVLRKPAQDCSAYTLSFDTTVFIIESTRQRVAVEATLENRGENAYSTVLNISQSANLQFASLIQKEDSDGSIECVNEERRLQKQVCNVSYPFFRAKAKVAFRLDFEFSKSIFLHHLEIELAAGSDSNERDSTKEDNVAPLRFHLKYEADVLFTRSSSLSHYEVKPNSSLERYDGIGPPFSCIFRIQNLGLFPIHGMMMKITIPIATRSGNRLLKLRDFLTDEANTSCNIWGNSTEYRPTPVEEDLRRAPQLNHSNSDVVSINCNIRLVPNQEINFHLLGNLWLRSLKALKYKSMKIMVNAALQRQFHSPFIFREEDPSRQIVFEISKQEDWQVPIWIIVGSTLGGLLLLALLVLALWKLGFFRSARRRREPGLDPTPKVLE

SEQ ID NO: 40764 - protein, 1189 aa, Homo sapiens
  Payload ID: 8294
  Gene Symbol: ITGA11
  Gene Name: integrin, alpha 11
  Uniprot ID: Q9UKX5
  ENSP ID: ENSP00000403392
MDLPRGLVVAWALSLWPGFTDTFNMDTRKPRVIPGSRTAFFGYTVQQHDISGNKWLVVGAPLETNGYQKTGDVYKCPVIHGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFLNEIKYIASDPDDKHFFNVTDEAALKDIVDALGDRIFSLEGTNKNETSFGLEMSQTGFSSHVVEDGVLLGAVGAYDWNGAVLKETSAGKVIPLRESYLKEFPEELKNHGAYLGYTVTSVVSSRQGRVYVAGAPRFNHTGKVILFTMHNNRSLTIHQAMRGQQIGSYFGSEITSVDIDGDGVTDVLLVGAPMYFNEGRERGKVYVYELRQNLFVYNGTLKDSHSYQNARFGSSIASVRDLNQDSYNDVVVGAPLEDNHAGAIYIFHGFRGSILKTPKQRITASELATGLQYFGCSIHGQLDLNEDGLIDLAVGALGNAVILWSRPVVQINASLHFEPSKINIFHRDCKRSGRDATCLAAFLCFTPIFLAPHFQTTTVGIRYNATMDERRYTPRAHLDEGGDRFTNRAVLLSSGQELCERINFHVLDTADYVKPVTFSVEYSLEDPDHGPMLDDGWPTTLRVSVPFWNGCNEDEHCVPDLVLDARSDLPTAMEYCQRVLRKPAQDCSAYTLSFDTTVFIIESTRQRVAVEATLENRGENAYSTVLNISQSANLQFASLIQKEDSDGSIECVNEERRLQKQVCNVSYPFFRAKAKVAFRLDFEFSKSIFLHHLEIELAAGSDSNERDSTKEDNVAPLRFHLKYEADVLFTRSSSLSHYEVKPNSSLERYDGIGPPFSCIFRIQNLGLFPIHGMMMKITIPIATRSGNRLLKLRDFLTDEVANTSCNIWGNSTEYRPTPVEEDLRRAPQLNHSNSDVVSINCNIRLVPNQEINFHLLGNLWLRSLKALKYKSMKIMVNAALQRQFHSPFIFREEDPSRQIVFEISKQEDWQVPIWIIVGSTLGGLLLLALLVLALWKLGFFRSARRRREPGLDPTPKVLE

SEQ ID NO: 40765 - protein, 1181 aa, Homo sapiens
  Payload ID: 8295
  Gene Symbol: ITGA2
  Gene Name: integrin, alpha 2 (CD49B, alpha 2 subunit of VLA-2 receptor)
  Uniprot ID: P17301
  ENSP ID: ENSP00000296585
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKEGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTRSTNINFYEISSDGNVPSIVHSFEDVGPKFIFSLKVTTGSVPVSMATVIIHIPQYTKEKNPLMYLTGVQTDKAGDISCNADINPLKIGQTSSSVSFKSENFRHTKELNCRTASCSNVTCWLKDVHMKGEYFVNVTTRIWNGTFASSTFQTVQLTAAAEINTYNPEIYVIEDNTVTIPLMIMKPDEKAEVPTGVIIGSIIAGILLLLALVAILWKLGFFKRKYEKMTKNPDEIDETTELSS

SEQ ID NO: 40766 - protein, 54 aa, Homo sapiens
  Payload ID: 8295
  Gene Symbol: ITGA2
  Gene Name: integrin, alpha 2 (CD49B, alpha 2 subunit of VLA-2 receptor)
  ENSP ID: ENSP00000422095
MGPERTGAAPLPLLLVLALSQGYWLVHPGVAFLRTEWEMCINVLLTYPLPHVKN

SEQ ID NO: 40767 - protein, 942 aa, Homo sapiens
  Payload ID: 8295
  Gene Symbol: ITGA2
  Gene Name: integrin, alpha 2 (CD49B, alpha 2 subunit of VLA-2 receptor)
  ENSP ID: ENSP00000422145
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKEGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTR

SEQ ID NO: 40768 - protein, 815 aa, Homo sapiens
  Payload ID: 8295
  Gene Symbol: ITGA2
  Gene Name: integrin, alpha 2 (CD49B, alpha 2 subunit of VLA-2 receptor)
  ENSP ID: ENSP00000424397
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKEGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQLMGQK

SEQ ID NO: 40769 - protein, 641 aa, Homo sapiens
  Payload ID: 8295
  Gene Symbol: ITGA2
  Gene Name: integrin, alpha 2 (CD49B, alpha 2 subunit of VLA-2 receptor)
  ENSP ID: ENSP00000424642
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKEGILGQHQFLEGPEGIENTRFGSAIAALSDINMDGFNDVIVGSPLENQNSGAVYIYNGHQGTIRTKYSQLLCTIISCQTCSFRKSWDPMEPLGAISSTLGGPWMAMEI

SEQ ID NO: 40770 - protein, 175 aa, Homo sapiens
  Payload ID: 8295
  Gene Symbol: ITGA2
  Gene Name: integrin, alpha 2 (CD49B, alpha 2 subunit of VLA-2 receptor)
  ENSP ID: ENSP00000426489
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQRGVNSVCQ

SEQ ID NO: 40771 - protein, 1039 aa, Homo sapiens
  Payload ID: 8296
  Gene Symbol: ITGA2B
  Gene Name: integrin, alpha 2b (platelet glycoprotein IIb of IIb/IIIa complex, antigen CD41)
  Uniprot ID: P08514
  ENSP ID: ENSP00000262407
MARALCPLQALWLLEWVLLLLGPCAAPPAWALNLDPVQLTFYAGPNGSQFGFSLDFHKDSHGRVAIVVGAPRTLGPSQEETGGVFLCPWRAEGGQCPSLLFDLRDETRNVGSQTLQTFKARQGLGASVVSWSDVIVACAPWQHWNVLEKTEEAEKTPVGSCFLAQPESGRRAEYSPCRGNTLSRIYVENDFSWDKRYCEAGFSSVVTQAGELVLGAPGGYYFLGLLAQAPVADIFSSYRPGILLWHVSSQSLSFDSSNPEYFDGYWGYSVAVGEFDGDLNTTEYVVGAPTWSWTLGAVEILDSYYQRLHRLRGEQMASYFGHSVAVTDVNGDGRHDLLVGAPLYMESRADRKLAEVGRVYLFLQPRGPHALGAPSLLLTGTQLYGRFGSAIAPLGDLDRDGYNDIAVAAPYGGPSGRGQVLVFLGQSEGLRSRPSQVLDSPFPTGSAFGFSLRGAVDIDDNGYPDLIVGAYGANQVAVYRAQPVVKASVQLLVQDSLNPAVKSCVLPQTKTPVSCFNIQMCVGATGHNIPQKLSLNAELQLDRQKPRQGRRVLLLGSQQAGTTLNLDLGGKHSPICHTTMAFLRDEADFRDKLSPIVLSLNVSLPPTEAGMAPAVVLHGDTHVQEQTRIVLDCGEDDVCVPQLQLTASVTGSPLLVGADNVLELQMDAANEGEGAYEAELAVHLPQGAHYMRALSNVEGFERLICNQKKENETRVVLCELGNPMKKNAQIGIAMLVSVGNLEEAGESVSFQLQIRSKNSQNPNSKIVLLDVPVRAEAQVELRGNSFPASLVVAAEEGEREQNSLDSWGPKVEHTYELHNNGPGTVNGLHLSIHLPGQSQPSDLLYILDIQPQGGLQCFPQPPVNPLKVDWGLPIPSPSPIHPAHHKRDRRQIFLPEPEQPSRLQDPVLVSCDSAPCTVVQCDLQEMARGQRAMVTVLAFLWLPSLYQRPLDQFVLQSHAWFNVSSLPYAVPPLSLPRGEAQVWTQLLRALEERAIPIWWVLVGVLGGLLLLTILVLAMWKVGFFKRNRPPLEEDDEEGE

SEQ ID NO: 40772 - protein, 32 aa, Homo sapiens
  Payload ID: 8296
  Gene Symbol: ITGA2B
  Gene Name: integrin, alpha 2b (platelet glycoprotein IIb of IIb/IIIa complex, antigen CD41)
  ENSP ID: ENSP00000465534
  MOD_RES (1)..(1): Any amino acid
XVPPLSLPRGEAQVGFFKRNRPPLEEDDEEGE

SEQ ID NO: 40773 - protein, 104 aa, Homo sapiens
  Payload ID: 8296
  Gene Symbol: ITGA2B
  Gene Name: integrin, alpha 2b (platelet glycoprotein IIb of IIb/IIIa complex, antigen CD41)
  ENSP ID: ENSP00000467269
  MOD_RES (1)..(1): Any amino acid
XNSFPASLVVAAEEGEREQNSLDSWGPKVEHTYELHNNGPGTVNGLHLSIHLPGQSQPSDLLYILDIQPQGGLQCFPQPPVNPLKVGFFKRNRPPLEEDDEEGE

SEQ ID NO: 40774 - protein, 1066 aa, Homo sapiens
  Payload ID: 8297
  Gene Symbol: ITGA3
  Gene Name: integrin, alpha 3 (antigen CD49C, alpha 3 subunit of VLA-3 receptor)
  Uniprot ID: P26006
  ENSP ID: ENSP00000007722
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCDFFKRTRYYQIMPKYHAVRIREEERYPPPGSTLPTKKHWVTSWQTRDQYY

SEQ ID NO: 40775 - protein, 1051 aa, Homo sapiens
  Payload ID: 8297
  Gene Symbol: ITGA3
  Gene Name: integrin, alpha 3 (antigen CD49C, alpha 3 subunit of VLA-3 receptor)
  Uniprot ID: P26006
  ENSP ID: ENSP00000315190
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRARTRALYEAKRQKAEMKSQPSETERLTDDY

SEQ ID NO: 40776 - protein, 142 aa, Homo sapiens
  Payload ID: 8297
  Gene Symbol: ITGA3
  Gene Name: integrin, alpha 3 (antigen CD49C, alpha 3 subunit of VLA-3 receptor)
  ENSP ID: ENSP00000422826
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLETAT

SEQ ID NO: 40777 - protein, 84 aa, Homo sapiens
  Payload ID: 8297
  Gene Symbol: ITGA3
  Gene Name: integrin, alpha 3 (antigen CD49C, alpha 3 subunit of VLA-3 receptor)
  ENSP ID: ENSP00000425980
  MOD_RES (1)..(1): Any amino acid
XINQDGFQDIAVGAPFEGLGKVYIYHSSSKGLLRQPQQVIHGEKLGLPGLATFGYSLSGQMDVDENFYPDLLVGSLSDHIVLLR

SEQ ID NO: 40778 - protein, 221 aa, Homo sapiens
  Payload ID: 8297
  Gene Symbol: ITGA3
  Gene Name: integrin, alpha 3 (antigen CD49C, alpha 3 subunit of VLA-3 receptor)
  ENSP ID: ENSP00000426142
  MOD_RES (1)..(1): Any amino acid
XSNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQPDPTLTMRQGPRGGVLSYPWLSEPAWLCPLPHGLCPKAHLRS

SEQ ID NO: 40779 - protein, 117 aa, Homo sapiens
  Payload ID: 8297
  Gene Symbol: ITGA3
  Gene Name: integrin, alpha 3 (antigen CD49C, alpha 3 subunit of VLA-3 receptor)
  ENSP ID: ENSP00000466652
WDLSEYSYKDPEDQGNLYIDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPA

SEQ ID NO: 40780 - protein, 29 aa, Homo sapiens
  Payload ID: 8297
  Gene Symbol: ITGA3
  Gene Name: integrin, alpha 3 (antigen CD49C, alpha 3 subunit of VLA-3 receptor)
  ENSP ID: ENSP00000467851
  MOD_RES (1)..(1): Any amino acid
XPVVTNVTVKARVWNSTFIEHPAQDLTQK

SEQ ID NO: 40781 - protein, 614 aa, Homo sapiens
  Payload ID: 8298
  Gene Symbol: ITGA4
  Gene Name: integrin, alpha 4 (antigen CD49D, alpha 4 subunit of VLA-4 receptor)
  ENSP ID: ENSP00000233573
MAWEARREPGPRRAAVRETVMLLLCLGVPTGRPYNVDTESALLYQGPHNTLFGYSVVLHSHGANRWLLVGAPTANWLANASVINPGAIYRCRIGKNPGQTCEQLQLGSPNGEPCGKTCLEERDNQWLGVTLSRQPGENGSIVTCGHRWKNIFYIKNENKLPTGGCYGVPPDLRTELSKRIAPCYQDYVKKFGENFASCQAGISSFYTKDLIVMGAPGSSYWTGSLFVYNITTNKYKAFLDKQNQVKFGSYLGYSVGAGHFRSQHTTEVVGGAPQHEQIGKAYIFSIDEKELNILHEMKGKKLGSYFGASVCAVDLNADGFSDLLVGAPMQSTIREEGRVFVYINSGSGAVMNAMETNLVGSDKYAARFGESIVNLGDIDNDGFEDVAIGAPQEDDLQGAIYIYNGRADGISSTFSQRIEGLQISKSLSMFGQSISGQIDADNNGYVDVAVGAFRSDSAVLLRTRPVVIVDASLSHPESVNRTKFDCVENGWPSVCIDLTLCFSYKGKEVPGYIVLFYNMSLDVNRKAESPPRFYFSSNGTSDVITGSIQVSSREANCRTHQAFMRKDVRDILTPIQIEAAYHLGPHVISKRSTEEFPPLQPILQQKKEKDIMKK

SEQ ID NO: 40782 - protein, 195 aa, Homo sapiens
  Payload ID: 8298
  Gene Symbol: ITGA4
  Gene Name: integrin, alpha 4 (antigen CD49D, alpha 4 subunit of VLA-4 receptor)
  Uniprot ID: P13612
  ENSP ID: ENSP00000340149
MAWEARREPGPRRAAVRETVMLLLCLGVPTGRPYNVDTESALLYQGPHNTLFGYSVVLHSHGANRWLLVGAPTANWLANASVINPGAIYRCRIGKNPGQTCEQLQLGSPNGEPCGKTCLEERDNQWLGVTLSRQPGENGSIVTCGHRWKNIFYIKNENKLPTGGCYGVPPDLRTELSKRIAPCYQGSISKYRART

SEQ ID NO: 40783 - protein, 1032 aa, Homo sapiens [sequence omitted]

SEQ ID NO: 40784 - protein, 1049 aa, Homo sapiens
  Payload ID: 8299
  Gene Symbol: ITGA5
  Gene Name: integrin, alpha 5 (fibronectin receptor, alpha polypeptide)
  Uniprot ID: P08648
  ENSP ID: ENSP00000293379
MGSRTPESPLHAVQLRWGPRRRPPLLPLLLLLLPPPPRVGGFNLDAEAPAVLSGPPGSFFGFSVEFYRPGTDGVSVLVGAPKANTSQPGVLQGGAVYLCPWGASPTQCTPIEFDSKGSRLLESSLSSSEGEEPVEYKSLQWFGATVRAHGSSILACAPLYSWRTEKEPLSDPVGTCYLSTDNFTRILEYAPCRSDFSWAAGQGYCQGGFSAEFTKTGRVVLGGPGSYFWQGQILSATQEQIAESYYPEYLINLVQGQLQTRQASSIYDDSYLGYSVAVGEFSGDDTEDFVAGVPKGNLTYGYVTILNGSDIRSLYNFSGEQMASYFGYAVAATDVNGDGLDDLLVGAPLLMDRTPDGRPQEVGRVYVYLQHPAGIEPTPTLTLTGHDEFGRFGSSLTPLGDLDQDGYNDVAIGAPFGGETQQGVVFVFPGGPGGLGSKPSQVLQPLWAASHTPDFFGSALRGGRDLDGNGYPDLIVGSFGVDKAVVYRGRPIVSASASLTIFPAMFNPEERSCSLEGNPVACINLSFCLNASGKHVADSIGFTVELQLDWQKQKGGVRRALFLASRQATLTQTLLIQNGAREDCREMKIYLRNESEFRDKLSPIHIALNFSLDPQAPVDSHGLRPALHYQSKSRIEDKAQILLDCGEDNICVPDLQLEVFGEQNHVYLGDKNALNLTFHAQNVGEGGAYEAELRVTAPPEAEYSGLVRHPGNFSSLSCDYFAVNQSRLLVCDLGNPMKAGASLWGGLRFTVPHLRDTKKTIQFDFQILSKNLNNSQSDVVSFRLSVEAQAQVTLNGVSKPEAVLFPVSDWHPRDQPQKEEDLGPAVHHVYELINQGPSSISQGVLELSCPQALEGQQLLYVTRVTGLNCTTNHPINPKGLELDPEGSLHHQQKREAPSRSSASSGPQILKCPEAECFRLRCELGPLHQQESQSLQLHFRVWAKTFLQREHQPFSLQCEAVYKALKMPYRILPRQLPQKERQVATAVQWTKAEGSYGVPLWIIILAILFGLLLLGLLIYILYKLGFFKRSLPYGTAMEKAQLKPPATSDA

SEQ ID NO: 40785 - protein, 137 aa, Homo sapiens
  Payload ID: 8299
  Gene Symbol: ITGA5
  Gene Name: integrin, alpha 5 (fibronectin receptor, alpha polypeptide)
  ENSP ID: ENSP00000405865
MGSRTPESPLHAVQLRWGPRRRPPLLPLLLLLLPPPPRVGGFNLDAEAPAVLSGPPGSFFGFSVEFYRPGTDGLSAPGVLTVQLRGRGACGVQVLAVVRGNSSSPWLLHLGMRSTVQLAHREGATERPRGHLLPLHR

SEQ ID NO: 40786 - protein, 120 aa, Homo sapiens
  Payload ID: 8299
  Gene Symbol: ITGA5
  Gene Name: integrin, alpha 5 (fibronectin receptor, alpha polypeptide)
  ENSP ID: ENSP00000447347
  MOD_RES (1)..(1): Any amino acid
XLLPLLLLLLPPPPRVGGFNLDAEAPAVLSGPPGSFFGFSVEFYRPGTDGVSVLVGAPKANTSQPGVLQGGAVYLCPWGASPTQCTPIEFDSKGMRSTVQLAHREGATERPRGHLLPLHR

SEQ ID NO: 40787 - protein, 119 aa, Homo sapiens
  Payload ID: 8299
  Gene Symbol: ITGA5
  Gene Name: integrin, alpha 5 (fibronectin receptor, alpha polypeptide)
  ENSP ID: ENSP00000450267
  MOD_RES (1)..(1): Any amino acid
XREAPSRSSASSGPQILREHQPFSLQCEAVYKALKMPYRILPRQLPQKERQVATAVQWTKAEGSYGVPLWIIILAILFGLLLLGLLIYILYKLGFFKRSLPYGTAMEKAQLKPPATSDA

SEQ ID NO: 40788 - protein, 1073 aa, Homo sapiens
  Payload ID: 8300
  Gene Symbol: ITGA6
  Gene Name: integrin, alpha 6
  Uniprot ID: P23229
  ENSP ID: ENSP00000264107
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 40789 - protein, 954 aa, Homo sapiens
  Payload ID: 8300
  Gene Symbol: ITGA6
  Gene Name: integrin, alpha 6
  Uniprot ID: P23229
  ENSP ID: ENSP00000386614
MGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGLLFLTSVSYTDPDQFVYKTRPPREQPDTFPDVMMNSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 40790 - protein, 1091 aa, Homo sapiens
  Payload ID: 8300
  Gene Symbol: ITGA6
  Gene Name: integrin, alpha 6
  Uniprot ID: P23229
  ENSP ID: ENSP00000386896
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRSRYDDSVPRYHAVRIRKEEREIKDEKYIDNLEKKQWITKWNENESYS

SEQ ID NO: 40791 - protein, 258 aa, Homo sapiens
  Payload ID: 8300
  Gene Symbol: ITGA6
  Gene Name: integrin, alpha 6
  ENSP ID: ENSP00000388435
TSNQDNLAPITAKAKVVIELLLSVSGVAKPSQVYFGGTVVGEQAMKSEDEVGSLIEYEFRESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRSRYDDSVPRYHAVRIRKEEREIKDEKYIDNLEKKQWITKWNENESYS

SEQ ID NO: 40792 - protein, 1086 aa, Homo sapiens
  Payload ID: 8300
  Gene Symbol: ITGA6
  Gene Name: integrin, alpha 6
  Uniprot ID: P23229
  ENSP ID: ENSP00000394169
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGLLFLTSVSYTDPDQFVYKTRPPREQPDTFPDVMMNSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRSRYDDSVPRYHAVRIRKEEREIKDEKYIDNLEKKQWITKWNENESYS

SEQ ID NO: 40793 - protein, 1130 aa, Homo sapiens
  Payload ID: 8300
  Gene Symbol: ITGA6
  Gene Name: integrin, alpha 6
  Uniprot ID: P23229
  ENSP ID: ENSP00000406694
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGLLFLTSVSYTDPDQFVYKTRPPREQPDTFPDVMMNSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRSRYDDSVPRYHAVRIRKEEREIKDEKYIDNLEKKQWITKWNENESYS

SEQ ID NO: 40794 - protein, 231 aa, Homo sapiens
  Payload ID: 8300
  Gene Symbol: ITGA6
  Gene Name: integrin, alpha 6
  ENSP ID: ENSP00000413470
MGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDG

SEQ ID NO: 40795 - protein, 1137 aa, Homo sapiens
  Payload ID: 8301
  Gene Symbol: ITGA7
  Gene Name: integrin, alpha 7
  Uniprot ID: Q13683
  ENSP ID: ENSP00000257879
MAGARSRDPWGASGICYLFGSLLVELLFSRAVAFNLDVMGALRKEGEPGSLFGFSVALHRQLQPRPQSWLLVGAPQALALPGQQANRTGGLFACPLSLEETDCYRVDIDQGADMQKESKENQWLGVSVRSQGPGGKIVTCAHRYEARQRVDQILETRDMIGRCFVLSQDLAIRDELDGGEWKFCEGRPQGHEQFGFCQQGTAAAFSPDSHYLLFGAPGTYNWKGLLFVTNIDSSDPDQLVYKTLDPADRLPGPAGDLALNSYLGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVRARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKMGFFKRAKHPEATVPQYHAVKIPREDRQQFKEEKTGTILRNNWGSPRREGPDAHPILAADGHPELGPDGHPGPGTA

SEQ ID NO: 40796 - protein, 1131 aa, Homo sapiens
  Payload ID: 8301
  Gene Symbol: ITGA7
  Gene Name: integrin, alpha 7
  ENSP ID: ENSP00000343009
MAGARSRDPWGASGICYLFGSLLVELLFSRAVAFNLDVMGALRKEGEPGSLFGFSVALHRQLQPRPQSWLLVGAPQALALPGQQANRTGGLFACPLSLEETDCYRVDIDQGADMQKESKENQWLGVSVRSQGPGGKIVTCAHRYEARQRVDQILETRDMIGRCFVLSQDLAIRDELDGGEWKFCEGRPQGHEQFGFCQQGTAAAFSPDSHYLLFGAPGTYNWKGLLFVTNIDSSDPDQLVYKTLDPADRLPGPAGDLALNSYLGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVRARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKMGFFKRAKHPEATVPQYHAVKIPREDRQQFKEEKTGTILRNNWGSPRREGPDAHPILAADGHPELGPDGHPGPGTA

SEQ ID NO: 40797 - protein, 1044 aa, Homo sapiens
  Payload ID: 8301
  Gene Symbol: ITGA7
  Gene Name: integrin, alpha 7
  Uniprot ID: Q13683
  ENSP ID: ENSP00000393844
MAPFATPMVQALTTTRIQRQAEGFQCWRECGTRRSPFEGKETCAHRYEARQRVDQILETRDMIGRCFVLSQDLAIRDELDGGEWKFCEGRPQGHEQFGFCQQGTAAAFSPDSHYLLFGAPGTYNWKGTARVELCAQGSADLAHLDDGPYEAGGEKEQDPRLIPVPANSYFGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVRARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKMGFFKRAKHPEATVPQYHAVKIPREDRQQFKEEKTGTILRNNWGSPRREGPDAHPILAADGHPELGPDGHPGPGTA

SEQ ID NO: 40798 - protein, 153 aa, Homo sapiens
  Payload ID: 8301
  Gene Symbol: ITGA7
  Gene Name: integrin, alpha 7
  ENSP ID: ENSP00000450578
MIGRCFVLSQDLAIRDELDGGEWKFCEGRPQGHEQFGFCQQGTAAAFSPDSHYLLFGAPGTYNWKGLLFVTNIDSSDPDQLVYKTLDPADRLPGPAGDLALNSYLGFSIDSGKGLVRAEELSFVAGAPRANHKGAVVILRKDSASRLVPEVML

SEQ ID NO: 40799 - protein, 98 aa, Homo sapiens
  Payload ID: 8301
  Gene Symbol: ITGA7
  Gene Name: integrin, alpha 7
  ENSP ID: ENSP00000450679
MVQALTTTRIQRQAEGFQCWRGFSIDSGKGLVRAEELSFVAGAPRANHKGAVVILRKDSASRLVPEVMLSGERLTSGFGYSLAVADLNSDGYCSGCPL

SEQ ID NO: 40800 - protein, 109 aa, Homo sapiens
  Payload ID: 8301
  Gene Symbol: ITGA7
  Gene Name: integrin, alpha 7
  ENSP ID: ENSP00000450693
  MOD_RES (1)..(1): Any amino acid
XVKDKLRAIVVTLSYSLQTPRLRRQAPGQGLPPVAPILNAHQPSTQRAEIHFLKQGCGEDKICQSNLQLVRARFCTRVSDTEFQPLPMRSHSACPMRMPPMLSVSWGTP

SEQ ID NO: 40801 - protein, 48 aa, Homo sapiens
  Payload ID: 8301
  Gene Symbol: ITGA7
  Gene Name: integrin, alpha 7
  ENSP ID: ENSP00000450798
MVQALTTTRIQRQAEGFQCWRGCWWVLPRPWLFLGSRRIALEASSLAR

SEQ ID NO: 40802 - protein, 205 aa, Homo sapiens
  Payload ID: 8301
  Gene Symbol: ITGA7
  Gene Name: integrin, alpha 7
  ENSP ID: ENSP00000451039
  MOD_RES (1)..(1): Any amino acid
XCAACLGPSLEQHLSGGVLSCEVPGSDCPGQHHSEVLHKELDAPRCLHSDPSDGILGPHGCGGRRSALVGHPPGCTGWAAGASTAGAAPVEVWLLPSEQPELIFSHQLSPGLSGCAAFSHGSWGSRDCGMGFFKRAKHPEATVPQYHAVKIPREDRQQFKEEKTGTILRNNWGSPRREGPDAHPILAADGHPELGPDGHPGPGTA

SEQ ID NO: 40803 - protein, 55 aa, Homo sapiens
  Payload ID: 8301
  Gene Symbol: ITGA7
  Gene Name: integrin, alpha 7
  ENSP ID: ENSP00000451311
MAPFATPMVQALTTTRIQRQAEGFQCWRGCWWVLPRPWLFLGSRRIALEASSLAR

SEQ ID NO: 40804 - protein, 35 aa, Homo sapiens
  Payload ID: 8301
  Gene Symbol: ITGA7
  Gene Name: integrin, alpha 7
  ENSP ID: ENSP00000452043
  MOD_RES (1)..(1): Any amino acid
XEGFQCWRGCWWVLPRPWLFLGSRRIALEASSLAR

SEQ ID NO: 40805 - protein, 1141 aa, Homo sapiens
  Payload ID: 8301
  Gene Symbol: ITGA7
  Gene Name: integrin, alpha 7
  Uniprot ID: Q13683
  ENSP ID: ENSP00000452120
MAGARSRDPWGASGICYLFGSLLVELLFSRAVAFNLDVMGALRKEGEPGSLFGFSVALHRQLQPRPQSWLLVGAPQALALPGQQANRTGGLFACPLSLEETDCYRVDIDQGADMQKESKENQWLGVSVRSQGPGGKIVTCAHRYEARQRVDQILETRDMIGRCFVLSQDLAIRDELDGGEWKFCEGRPQGHEQFGFCQQGTAAAFSPDSHYLLFGAPGTYNWKGTARVELCAQGSADLAHLDDGPYEAGGEKEQDPRLIPVPANSYFGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVRARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKMGFFKRAKHPEATVPQYHAVKIPREDRQQFKEEKTGTILRNNWGSPRREGPDAHPILAADGHPELGPDGHPGPGTA

SEQ ID NO: 40806 - protein, 1181 aa, Homo sapiens
  Payload ID: 8301
  Gene Symbol: ITGA7
  Gene Name: integrin, alpha 7
  Uniprot ID: Q13683
  ENSP ID: ENSP00000452387
MAGARSRDPWGASGICYLFGSLLVELLFSRAVAFNLDVMGALRKEGEPGSLFGFSVALHRQLQPRPQSWLLVGAPQALALPGQQANRTGGLFACPLSLEETDCYRVDIDQGADMQKESKENQWLGVSVRSQGPGGKIVTCAHRYEARQRVDQILETRDMIGRCFVLSQDLAIRDELDGGEWKFCEGRPQGHEQFGFCQQGTAAAFSPDSHYLLFGAPGTYNWKGTARVELCAQGSADLAHLDDGPYEAGGEKEQDPRLIPVPANSYFGLLFVTNIDSSDPDQLVYKTLDPADRLPGPAGDLALNSYLGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVRARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKMGFFKRAKHPEATVPQYHAVKIPREDRQQFKEEKTGTILRNNWGSPRREGPDAHPILAADGHPELGPDGHPGPGTA

SEQ ID NO: 40807 - protein, 48 aa, Homo sapiens; identical to SEQ ID NO: 40801
  Payload ID: 8301
  Gene Symbol: ITGA7
  Gene Name: integrin, alpha 7
  ENSP ID: ENSP00000452467

SEQ ID NO: 40808 - protein, 1063 aa, Homo sapiens
  Payload ID: 8302
  Gene Symbol: ITGA8
  Gene Name: integrin, alpha 8
  Uniprot ID: P53708
  ENSP ID: ENSP00000367316
MSPGASRGPRGSQAPLIAPLCCAAAALGMLLWSPACQAFNLDVEKLTVYSGPKGSYFGYAVDFHIPDARTASVLVGAPKANTSQPDIVEGGAVYYCPWPAEGSAQCRQIPFDTTNNRKIRVNGTKEPIEFKSNQWFGATVKAHKGKVVACAPLYHWRTLKPTPEKDPVGTCYVAIQNFSAYAEFSPCRNSNADPEGQGYCQAGFSLDFYKNGDLIVGGPGSFYWQGQVITASVADIIANYSFKDILRKLAGEKQTEVAPASYDDSYLGYSVAAGEFTGDSQQELVAGIPRGAQNFGYVSIINSTDMTFIQNFTGEQMASYFGYTVVVSDVNSDGLDDVLVGAPLFMEREFESNPREVGQIYLYLQVSSLLFRDPQILTGTETFGRFGSAMAHLGDLNQDGYNDIAIGVPFAGKDQRGKVLIYNGNKDGLNTKPSQVLQGVWASHAVPSGFGFTLRGDSDIDKNDYPDLIVGAFGTGKVAVYRARPVVTVDAQLLLHPMIINLENKTCQVPDSMTSAACFSLRVCASVTGQSIANTIVLMAEVQLDSLKQKGAIKRTLFLDNHQAHRVFPLVIKRQKSHQCQDFIVYLRDETEFRDKLSPINISLNYSLDESTFKEGLEVKPILNYYRENIVSEQAHILVDCGEDNLCVPDLKLSARPDKHQVIIGDENHLMLIINARNEGEGAYEAELFVMIPEEADYVGIERNNKGFRPLSCEYKMENVTRMVVCDLGNPMVSGTNYSLGLRFAVPRLEKTNMSINFDLQIRSSNKDNPDSNFVSLQINITAVAQVEIRGVSHPPQIVLPIHNWEPEEEPHKEEEVGPLVEHIYELHNIGPSTISDTILEVGWPFSARDEFLLYIFHIQTLGPLQCQPNPNINPQDIKPAASPEDTPELSAFLRNSTIPHLVRKRDVHVVEFHRQSPAKILNCTNIECLQISCAVGRLEGGESAVLKVRSRLWAHTFLQRKNDPYALASLVSFEVKKMPYTDQPAKLPEGSIVIKTSVIWATPNVSFSIPLWVIILAILLGLLVLAILTLALWKCGFFDRARPPQEDMTDREQLTNDKTPEA

SEQ ID NO: 40809 - protein, 1035 aa, Homo sapiens
  Payload ID: 8303
  Gene Symbol: ITGA9
  Gene Name: integrin, alpha 9
  Uniprot ID: Q13797
  ENSP ID: ENSP00000264741
MGGPAAPRGAGRLRALLLALVVAGIPAGAYNLDPQRPVHFQGPADSFFGYAVLEHFHDNTRWVLVGAPKADSKYSPSVKSPGAVFKCRVHTNPDRRCTELDMARGKNRGTSCGKTCREDRDDEWMGVSLARQPKADGRVLACAHRWKNIYYEADHILPHGFCYIIPSNLQAKGRTLIPCYEEYKKKYGEEHGSCQAGIAGFFTEELVVMGAPGSFYWAGTIKVLNLTDNTYLKLNDEVIMNRRYTYLGYAVTAGHFSHPSTIDVVGGAPQDKGIGKVYIFRADRRSGTLIKIFQASGKKMGSYFGSSLCAVDLNGDGLSDLLVGAPMFSEIRDEGQVTVYINRGNGALEEQLALTGDGAYNAHFGESIASLDDLDNDGFPDVAIGAPKEDDFAGAVYIYHGDAGGIVPQYSMKLSGQKINPVLRMFGQSISGGIDMDGNGYPDVTVGAFMSDSVVLLRARPVITVDVSIFLPGSINITAPQCHDGQQPVNCLNVTTCFSFHGKHVPGEIGLNYVLMADVAKKEKGQMPRVYFVLLGETMGQVTEKLQLTYMEETCRHYVAHVKRRVQDVISPIVFEAAYSLSEHVTGEEERELPPLTPVLRWKKGQKIAQKNQTVFERNCRSEDCAADLQLQGKLLLSSMDEKTLYLALGAVKNISLNISISNLGDDAYDANVSFNVSRELFFINMWQKEEMGISCELLESDFLKCSVGFPFMRSKSKYEFSVIFDTSHLSGEEEVLSFIVTAQSGNTERSESLHDNTLVLMVPLMHEVDTSITGIMSPTSFVYGESVDAANFIQLDDLECHFQPINITLQVYNTGPSTLPGSSVSISFPNRLSSGGAEMFHVQEMVVGQEKGNCSFQKNPTPCIIPQEQENIFHTIFAFFTKSGRKVLDCEKPGISCLTAHCNFSALAKEESRTIDIYMLLNTEILKKDSSSVIQFMSRAKVKVDPALRVVEIAHGNPEEVTVVFEALHNLEPRGYVVGWIIAISLLVGILIFLLLAVLLWKMGFFRRRYKEIIEAEKNRKENEDSWDWVQKNQ

SEQ ID NO: 40810 - protein, 632 aa, Homo sapiens
  Payload ID: 8303
  Gene Symbol: ITGA9
  Gene Name: integrin, alpha 9
  ENSP ID: ENSP00000397258
MGGPAAPRGAGRLRALLLALVVAGIPAGAYNLDPQRPVHFQGPADSFFGYAVLEHFHDNTRWVLVGAPKADSKYSPSVKSPGAVFKCRVHTNPDRRCTELDMARGKNRGTSCGKTCREDRDDEWMGVSLARQPKADGRVLACAHRWKNIYYEADHILPHGFCYIIPSNLQAKGRTLIPCYEEYKKKYGEEHGSCQAGIAGFFTEELVVMGAPGSFYWAGTIKVLNLTDNTYLKLNDEVIMNRRYTYLGYAVTAGHFSHPSTIDVVGGAPQDKGIGKVYIFRADRRSGTLIKIFQASGKKMGSYFGSSLCAVDLNGDGLSDLLVGAPMFSEIRDEGQVTVYINRGNGALEEQLALTGDGAYNAHFGESIASLDDLDNDGFPDVAIGAPKEDDFAGAVYIYHGDAGGIVPQYSMKLSGQKINPVLRMFGQSISGGIDMDGNGYPDVTVGAFMSDSVVLLRARPVITVDVSIFLPGSINITAPQCHDGQQPVNCLNVTTCFSFHGKHVPGEIGLNYVLMADVAKKEKGQMPRVYFVLLGETMGQVTEKLQLTYMEETCRHYVAHVKRRVQDVISPIVFEAAYSLSEHVTGEEERELPPLTPVLRWKKGQKIAQKNQVRTLKLILSTQGGSCTEQK

SEQ ID NO: 40811 - protein, 69 aa, Homo sapiens
  Payload ID: 8303
  Gene Symbol: ITGA9
  Gene Name: integrin, alpha 9
  ENSP ID: ENSP00000406533
  MOD_RES (1)..(1): Any amino acid
XKKDSSSVIQFMSRAKVKVDPALRVVEIAHGNPEEVTMGFFRRRYKEIIEAEKNRKENEDSWDWVQKNQ

SEQ ID NO: 40812 - protein, 1161 aa, Homo sapiens
  Payload ID: 8304
  Gene Symbol: ITGAD
  Gene Name: integrin, alpha D
  Uniprot ID: Q13349
  ENSP ID: ENSP00000373854
MTFGTVLLLSVLASYHGFNLDVEEPTIFQEDAGGFGQSVVQFGGSRLVVGAPLEVVAANQTGRLYDCAAATGMCQPIPLHIRPEAVNMSLGLTLAASTNGSRLLACGPTLHRVCGENSYSKGSCLLLGSRWEIIQTVPDATPECPHQEMDIVFLIDGSGSIDQNDFNQMKGFVQAVMGQFEGTDTLFALMQYSNLLKIHFTFTQFRTSPSQQSLVDPIVQLKGLTFTATGILTVVTQLFHHKNGARKSAKKILIVITDGQKYKDPLEYSDVIPQAEKAGIIRYAIGVGHAFQGPTARQELNTISSAPPQDHVFKVDNFAALGSIQKQLQEKIYAVEGTQSRASSSFQHEMSQEGFSTALTMDGLFLGAVGSFSWSGGAFLYPPNMSPTFINMSQENVDMRDSYLGYSTELALWKGVQNLVLGAPRYQHTGKAVIFTQVSRQWRKKAEVTGTQIGSYFGASLCSVDVDSDGSTDLILIGAPHYYEQTRGGQVSVCPLPRGRVQWQCDAVLRGEQGHPWGRFGAALTVLGDVNEDKLIDVAIGAPGEQENRGAVYLFHGASESGISPSHSQRIASSQLSPRLQYFGQALSGGQDLTQDGLMDLAVGARGQVLLLRSLPVLKVGVAMRFSPVEVAKAVYRCWEEKPSALEAGDATVCLTIQKSSLDQLGDIQSSVRFDLALDPGRLTSRAIFNETKNPTLTRRKTLGLGIHCETLKLLLPDCVEDVVSPIILHLNFSLVREPIPSPQNLRPVLAVGSQDLFTASLPFEKNCGQDGLCEGDLGVTLSFSGLQTLTVGSSLELNVIVTVWNAGEDSYGTVVSLYYPAGLSHRRVSGAQKQPHQSALRLACETVPTEDEGLRSSRCSVNHPIFHEGSNGTFIVTFDVSYKATLGDRMLMRASASSENNKASSSKATFQLELPVKYAVYTMISRQEESTKYFNFATSDEKKMKEAEHRYRVNNLSQRDLAISINFWVPVLLNGVAVWDVVMEAPSQSLPCVSERKPPQHSDFLTQISRSPMLDCSIADCLQFRCDVPSFSVQEELDFTLKGNLSFGWVRETLQKKVLVVSVAEITFDTSVYSQLPGQEAFMRAQMEMVLEEDEVYNAIPIIMGSSVGALLLLALITATLYKLGFFKRHYKEMLEDKPEDTATFSGDDFSCVAPNVPLS

SEQ ID NO: 40813 - protein, 1179 aa, Homo sapiens
  Payload ID: 8305
  Gene Symbol: ITGAE
  Gene Name: integrin, alpha E (antigen CD103, human mucosal lymphocyte antigen 1
  alpha polypeptide)
  Uniprot ID: P38570
  ENSP ID: ENSP00000263087
MWLFHTLLCIASLALLAAFNVDVARPWLTPKGGAPFVLSSLLHQDPSTNQTWLLVTSPRTKRTPGPLHRCSLVQDEILCHPVEHVPIPKGRHRGVTVVRSHHGVLICIQVLVRRPHSLSSELTGTCSLLGPDLRPQAQANFFDLENLLDPDARVDTGDCYSNKEGGGEDDVNTARQRRALEKEEEEDKEEEEDEEEEEAGTEIAIILDGSGSIDPPDFQRAKDFISNMMRNFYEKCFECNFALVQYGGVIQTEFDLRDSQDVMASLARVQNITQVGSVTKTASAMQHVLDSIFTSSHGSRRKASKVMVVLTDGGIFEDPLNLTTVINSPKMQGVERFAIGVGEEFKSARTARELNLIASDPDETHAFKVTNYMALDGLLSKLRYNIISMEGTVGDALHYQLAQIGFSAQILDERQVLLGAVGAFDWSGGALLYDTRSRRGRFLNQTAAAAADAEAAQYSYLGYAVAVLHKTCSLSYIAGAPRYKHHGAVFELQKEGREASFLPVLEGEQMGSYFGSELCPVDIDMDGSTDFLLVAAPFYHVHGEEGRVYVYRLSEQDGSFSLARILSGHPGFTNARFGFAMAAMGDLSQDKLTDVAIGAPLEGFGADDGASFGSVYIYNGHWDGLSASPSQRIRASTVAPGLQYFGMSMAGGFDISGDGLADITVGTLGQAVVFRSRPVVRLKVSMAFTPSALPIGFNGVVNVRLCFEISSVTTASESGLREALLNFTLDVDVGKQRRRLQCSDVRSCLGCLREWSSGSQLCEDLLLMPTEGELCEEDCFSNASVKVSYQLQTPEGQTDHPQPILDRYTEPFAIFQLPYEKACKNKLFCVAELQLATTVSQQELVVGLTKELTLNINLTNSGEDSYMTSMALNYPRNLQLKRMQKPPSPNIQCDDPQPVASVLIMNCRIGHPVLKRSSAHVSVVWQLEENAFPNRTADITVTVTNSNERRSLANETHTLQFRHGFVAVLSKPSIMYVNTGQGLSHHKEFLFHVHGENLFGAEYQLQICVPTKLRGLQVVAVKKLTRTQASTVCTWSQERACAYSSVQHVEEWHSVSCVIASDKENVTVAAEISWDHSEELLKDVTELQILGEISFNKSLYEGLNAENHRTKITVVFLKDEKYHSLPIIIKGSVGGLLVLIVILVILFKCGFFKRKYQQLNLESIRKAQLKSENLLEEEN

SEQ ID NO: 40814 - protein, 139 aa, Homo sapiens
  Payload ID: 8305
  Gene Symbol: ITGAE
  Gene Name: integrin, alpha E (antigen CD103, human mucosal lymphocyte antigen 1
  alpha polypeptide)
  ENSP ID: ENSP00000467977
  MOD_RES (1)..(1): Any amino acid
XHPQPILDRYTEPFAIFQLPYEKACKNKLFCVAELQLATTVSQQELVVGLTKELTLNINLTNSGEDSYMTSMALNYPRNLQLKRMQKAHVSVVWQLEENAFPNRTADITVTVTKPSIMYVNTGQGLSHHKEFLFHVHGE

SEQ ID NO: 40815 - protein, 1170 aa, Homo sapiens
  Payload ID: 8306
  Gene Symbol: ITGAL
  Gene Name: integrin, alpha L (antigen CD11A (p180), lymphocyte function-associated antigen 1
  alpha polypeptide)
  Uniprot ID: P20701
  ENSP ID: ENSP00000349252
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILACDPGLSRTCDQNTYLSGLCYLFRQNLQGPMLQGRPGFQECIKGNVDLVFLFDGSMSLQPDEFQKILDFMKDVMKKLSNTSYQFAAVQFSTSYKTEFDFSDYVKRKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLIPQFQGRLVANLTYTLQLDGHRTRRRGLFPGGRHELRRNIAVTTSMSCTDFSFHFPVCVQDLISPINVSLNFSLWEEEGTPRDQRAQGKDIPPILRPSLHSETWEIPFEKNCGEDKKCEANLRVSFSPARSRALRLTAFASLSVELSLSNLEEDAYWVQLDLHFPPGLSFRKVEMLKPHSQIPVSCEELPEESRLLSRALSCNVSSPIFKAGHSVALQMMFNTLVNSSWGDSVELHANVTCNNEDSDLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 40816 - protein, 1086 aa, Homo sapiens
  Payload ID: 8306
  Gene Symbol: ITGAL
  Gene Name: integrin, alpha L (antigen CD11A (p180), lymphocyte function-associated antigen 1
  alpha polypeptide)
  Uniprot ID: P20701
  ENSP ID: ENSP00000350886
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILFAAVQFSTSYKTEFDFSDYVKRKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLIPQFQGRLVANLTYTLQLDGHRTRRRGLFPGGRHELRRNIAVTTSMSCTDFSFHFPVCVQDLISPINVSLNFSLWEEEGTPRDQRAGKDIPPILRPSLHSETWEIPFEKNCGEDKKCEANLRVSFSPARSRALRLTAFASLSVELSLSNLEEDAYWVQLDLHFPPGLSFRKVEMLKPHSQIPVSCEELPEESRLLSRALSCNVSSPIFKAGHSVALQMMFNTLVNSSWGDSVELHANVTCNNEDSDLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 40817 - protein, 404 aa, Homo sapiens
  Payload ID: 8306
  Gene Symbol: ITGAL
  Gene Name: integrin, alpha L (antigen CD11A (p180), lymphocyte function-associated antigen 1
  alpha polypeptide)
  ENSP ID: ENSP00000409377
MKDSCITVMAMALLSGFFFFAPASSYNLDVRGARSFSPPRAGRHFGYRVLQIKSLIPQFQGRLVANLTYTLQLDGHRTRRRGLFPGGRHELRRNIAVTTSMSCTDFSFHFPMMFNTLVNSSWGDSVELHANVTCNNEDSDLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 40818 - protein, 162 aa, Homo sapiens
  Payload ID: 8306
  Gene Symbol: ITGAL
  Gene Name: integrin, alpha L (antigen CD11A (p180), lymphocyte function-associated antigen 1
  alpha polypeptide)
  ENSP ID: ENSP00000454342
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILACDPGLSRTCDQNTYLSGLCYLFRQNLQGPMLQGRPGFQVCCCSVFHKLQNRI

SEQ ID NO: 40819 - protein, 55 aa, Homo sapiens
  Payload ID: 8306
  Gene Symbol: ITGAL
  Gene Name: integrin, alpha L (antigen CD11A (p180), lymphocyte function-associated antigen 1
  alpha polypeptide)
  ENSP ID: ENSP00000454908
MKDSCITVMAMALLSGFFFFAPASSYNLDVRGARSFSPPRAGRHFGYRVLQVGNG

SEQ ID NO: 40820 - protein, 90 aa, Homo sapiens
  Payload ID: 8306
  Gene Symbol: ITGAL
  Gene Name: integrin, alpha L (antigen CD11A (p180), lymphocyte function-associated antigen 1
  alpha polypeptide)
  ENSP ID: ENSP00000456521
MKDSCITVMAMALLSGFFFFERPNGKLYPQALGRAFRALGGPGVAPSIFPEVNALEGKRRVRVAWGATSGWAWDRPPAGHVQGRGSLGRS

SEQ ID NO: 40821 - protein, 203 aa, Homo sapiens
  Payload ID: 8306
  Gene Symbol: ITGAL
  Gene Name: integrin, alpha L (antigen CD11A (p180), lymphocyte function-associated antigen 1
  alpha polypeptide)
  ENSP ID: ENSP00000456888
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILFAAVQFSTSYKTEFDFSDYVKRKDPDALLKHVKHMLLLTNTFGAINYVATEVFREELGARPDATKVLIIITDGEATDSGNIDAAKDIIRYIIGV

SEQ ID NO: 40822 - protein, 109 aa, Homo sapiens
  Payload ID: 8306
  Gene Symbol: ITGAL
  Gene Name: integrin, alpha L (antigen CD11A (p180), lymphocyte function-associated antigen 1
  alpha polypeptide)
  ENSP ID: ENSP00000457785
MKDSCITVMAMALLSGFFFFAPASSYNLDVRGARSFSPPRAGRHFGYRVLQLDGHRTRRRGLFPGGRHELRRNIAVTTSMSCTDFSFHFPIQSPASNCFCQPLCGAEPE

SEQ ID NO: 40823 - protein, 38 aa, Homo sapiens
  Payload ID: 8306
  Gene Symbol: ITGAL
  Gene Name: integrin, alpha L (antigen CD11A (p180), lymphocyte function-associated antigen 1
  alpha polypeptide)
  ENSP ID: ENSP00000458739
  MOD_RES (1)..(1): Any amino acid
XKEGVNITICFQIKSLIPQFQAGWPPDQKTGVVPRRET

SEQ ID NO: 40824 - protein, 41 aa, Homo sapiens
  Payload ID: 8306
  Gene Symbol: ITGAL
  Gene Name: integrin, alpha L (antigen CD11A (p180), lymphocyte function-associated antigen 1
  alpha polypeptide)
  ENSP ID: ENSP00000461006
MTLATDPTDGSILACDPGLSRTCDQNTYLSGLCYLFRQNLQ

SEQ ID NO: 40825 - protein, 1152 aa, Homo sapiens
  Payload ID: 8307
  Gene Symbol: ITGAM
  Gene Name: integrin, alpha M (complement component 3 receptor 3 subunit)
  Uniprot ID: P11215
  ENSP ID: ENSP00000287497
MALRVLLLTALTLCHGFNLDTENAMTFQENARGFGQSVVQLQGSRVVVGAPQEIVAANQRGSLYQCDYSTGSCEPIRLQVPVEAVNMSLGLSLAATTSPPQLLACGPTVHQTCSENTYVKGLCFLFGSNLRQQPQKFPEALRGCPQEDSDIAFLIDGSGSIIPHDFRRMKEFVSTVMEQLKKSKTLFSLMQYSEEFRIHFTFKEFQNNPNPRSLVKPITQLLGRTHTATGIRKVVRELFNITNGARKNAFKILVVITDGEKFGDPLGYEDVIPEADREGVIRYVIGVGDAFRSEKSRQELNTIASKPPRDHVFQVNNFEALKTIQNQLREKIFAIEGTQTGSSSSFEHEMSQEGFSAAITSNGPLLSTVGSYDWAGGVFLYTSKEKSTFINMTRVDSDMNDAYLGYAAAIILRNRVQSLVLGAPRYQHIGLVAMFRQNTGMWESNANVKGTQIGAYFGASLCSVDVDSNGSTDLVLIGAPHYYEQTRGGQVSVCPLPRGRARWQCDAVLYGEQGQPWGRFGAALTVLGDVNGDKLTDVAIGAPGEEDNRGAVYLFHGTSGSGISPSHSQRIAGSKLSPRLQYFGQSLSGGQDLTMDGLVDLTVGAQGHVLLLRSQPVLRVKAIMEFNPREVARNVFECNDQVVKGKEAGEVRVCLHVQKSTRDRLREGQIQSVVTYDLALDSGRPHSRAVFNETKNSTRRQTQVLGLTQTCETLKLQLPNCIEDPVSPIVLRLNFSLVGTPLSAFGNLRPVLAEDAQRLFTALFPFEKNCGNDNICQDDLSITFSFMSLDCLVVGGPREFNVTVTVRNDGEDSYRTQVTFFFPLDLSYRKVSTLQNQRSQRSWRLACESASSTEVSGALKSTSCSINHPIFPENSEVTFNITFDVDSKASLGNKLLLKANVTSENNMPRTNKTEFQLELPVKYAVYMVVTSHGVSTKYLNFTASENTSRVMQHQYQVSNLGQRSLPISLVFLVPVRLNQTVIWDRPQVTFSENLSSTCHTKERLPSHSDFLAELRKAPVVNCSIAVCQRIQCDIPFFGIQEEFNATLKGNLSFDWYIKTSHNHLLIVSTAEILFNDSVFTLLPGQGAFVRSQTETKVEPFEVPNPLPLIVGSSVGGLLLLALITAALYKLGFFKRQYKDMMSEGGPPGAEPQ

SEQ ID NO: 40826 - protein, 1153 aa, Homo sapiens
  Payload ID: 8307
  Gene Symbol: ITGAM
  Gene Name: integrin, alpha M (complement component 3 receptor 3 subunit)
  Uniprot ID: P11215
  ENSP ID: ENSP00000441691
MALRVLLLTALTLCHGFNLDTENAMTFQENARGFGQSVVQLQGSRVVVGAPQEIVAANQRGSLYQCDYSTGSCEPIRLQVPVEAVNMSLGLSLAATTSPPQLLACGPTVHQTCSENTYVKGLCFLFGSNLRQQPQKFPEALRGCPQEDSDIAFLIDGSGSIIPHDFRRMKEFVSTVMEQLKKSKTLFSLMQYSEEFRIHFTFKEFQNNPNPRSLVKPITQLLGRTHTATGIRKVVRELFNITNGARKNAFKILVVITDGEKFGDPLGYEDVIPEADREGVIRYVIGVGDAFRSEKSRQELNTIASKPPRDHVFQVNNFEALKTIQNQLREKIFAIEGTQTGSSSSFEHEMSQEGFSAAITSNGPLLSTVGSYDWAGGVFLYTSKEKSTFINMTRVDSDMNDAYLGYAAAIILRNRVQSLVLGAPRYQHIGLVAMFRQNTGMWESNANVKGTQIGAYFGASLCSVDVDSNGSTDLVLIGAPHYYEQTRGGQVSVCPLPRGQRARWQCDAVLYGEQGQPWGRFGAALTVLGDVNGDKLTDVAIGAPGEEDNRGAVYLFHGTSGSGISPSHSQRIAGSKLSPRLQYFGQSLSGGQDLTMDGLVDLTVGAQGHVLLLRSQPVLRVKAIMEFNPREVARNVFECNDQVVKGKEAGEVRVCLHVQKSTRDRLREGQIQSVVTYDLALDSGRPHSRAVFNETKNSTRRQTQVLGLTQTCETLKLQLPNCIEDPVSPIVLRLNFSLVGTPLSAFGNLRPVLAEDAQRLFTALFPFEKNCGNDNICQDDLSITFSFMSLDCLVVGGPREFNVTVTVRNDGEDSYRTQVTFFFPLDLSYRKVSTLQNQRSQRSWRLACESASSTEVSGALKSTSCSINHPIFPENSEVTFNITFDVDSKASLGNKLLLKANVTSENNMPRTNKTEFQLELPVKYAVYMVVTSHGVSTKYLNFTASENTSRVMQHQYQVSNLGQRSLPISLVFLVPVRLNQTVIWDRPQVTFSENLSSTCHTKERLPSHSDFLAELRKAPVVNCSIAVCQRIQCDIPFFGIQEEFNATLKGNLSFDWYIKTSHNHLLIVSTAEILFNDSVFTLLPGQGAFVRSQTETKVEPFEVPNPLPLIVGSSVGGLLLLALITAALYKLGFFKRQYKDMMSEGGPPGAEPQ

SEQ ID NO: 40827 - protein, 165 aa, Homo sapiens
  Payload ID: 8307
  Gene Symbol: ITGAM
  Gene Name: integrin, alpha M (complement component 3 receptor 3 subunit)
  ENSP ID: ENSP00000454568
  MOD_RES (1)..(1): Any amino acid
XTIASKPPRDHVFQVNNFEALKTIQNQLREKIFAIEGTQTGSSSSFEHEMSQEGFSAAITSNGPLLSTVGSYDWAGGVFLYTSKEKSTFINMTRVDSDMNDAYLDRRLLRGLPLLRGRGQQRQHRPGPHRGPPLLRADPRGPGVRVPLAQGGQIQSVVTYDLALD

SEQ ID NO: 40828 - protein, 117 aa, Homo sapiens
  Payload ID: 8307
  Gene Symbol: ITGAM
  Gene Name: integrin, alpha M (complement component 3 receptor 3 subunit)
  ENSP ID: ENSP00000461850
ATLKGNLSFDWYIKTSHNHLLIVSTAEILFNDSVFTLLPGQGAFVRSQTETKVEPFEVPNPLPLIVGSSVGGLLLLALITAALYKVLPAAPPPPPFILSGLALQLRASVSPAGLPAV

SEQ ID NO: 40829 - protein, 1048 aa, Homo sapiens
  Payload ID: 8308
  Gene Symbol: ITGAV
  Gene Name: integrin, alpha V
  Uniprot ID: P06756
  ENSP ID: ENSP00000261023
MAFPPRRRLRLGPRGLPLLLSGLLLPLCRAFNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDCGEDNVCKPKLEVSVDSDQKKIYIGDDNPLTLIVKAQNQGEGAYEAELIVSIPLQADFIGVVRNNEALARLSCAFKTENQTRQVVCDLGNPMKAGTQLLAGLRFSVHQQSEMDTSVKFDLQIQSSNLFDKVSPVVSHKVDLAVLAAVEIRGVSSPDHVFLPIPNWEHKENPETEEDVGPVVQHIYELRNNGPSSFSKAMLHLQWPYKYNNNTLLYILHYDIDGPMNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVTTNVTWGIQPAPMPVPVWVIILAVLAGLLLLAVLVFVMYRMGFFKRVRPPQEEQEREQLQPHENGEGNSET

SEQ ID NO: 40830 - protein, 1012 aa, Homo sapiens
  Payload ID: 8308
  Gene Symbol: ITGAV
  Gene Name: integrin, alpha V
  Uniprot ID: P06756
  ENSP ID: ENSP00000364042
MAFPPRRRLRLGPRGLPLLLSGLLLPLCRAFNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSRQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDCGEDNVCKPKLEVSVDSDQKKIYIGDDNPLTLIVKAQNQGEGAYEAELIVSIPLQADFIGVVRNNEALARLSCAFKTENQTRQVVCDLGNPMKAGTQLLAGLRFSVHQQSEMDTSVKFDLQIQSSNLFDKVSPVVSHKVDLAVLAAVEIRGVSSPDHVFLPIPNWEHKENPETEEDVGPVVQHIYELRNNGPSSFSKAMLHLQWPYKYNNNTLLYILHYDIDGPMNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVTTNVTWGIQPAPMPVPVWVIILAVLAGLLLLAVLVFVMYRMGFFKRVRPPQEEQEREQLQPHENGEGNSET

SEQ ID NO: 40831 - protein, 136 aa, Homo sapiens
  Payload ID: 8308
  Gene Symbol: ITGAV
  Gene Name: integrin, alpha V
  ENSP ID: ENSP00000389442
  MOD_RES (1)..(1): Any amino acid
XNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVSHWFRQIE

SEQ ID NO: 40832 - protein, 1002 aa, Homo sapiens
  Payload ID: 8308
  Gene Symbol: ITGAV
  Gene Name: integrin, alpha V
  Uniprot ID: P06756
  ENSP ID: ENSP00000404291
MLLGTLLLILYILMLCRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDCGEDNVCKPKLEVSVDSDQKKIYIGDDNPLTLIVKAQNQGEGAYEAELIVSIPLQADFIGVVRNNEALARLSCAFKTENQTRQVVCDLGNPMKAGTQLLAGLRFSVHQQSEMDTSVKFDLQIQSSNLFDKVSPVVSHKVDLAVLAAVEIRGVSSPDHVFLPIPNWEHKENPETEEDVGPVVQHIYELRNNGPSSFSKAMLHLQWPYKYNNNTLLYILHYDIDGPMNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVTTNVTWGIQPAPMPVPVWVIILAVLAGLLLLAVLVFVMYRMGFFKRVRPPQEEQEREQLQPHENGEGNSET

SEQ ID NO: 40833 - protein, 1163 aa, Homo sapiens
  Payload ID: 8309
  Gene Symbol: ITGAX
  Gene Name: integrin, alpha X (complement component 3 receptor 4 subunit)
  Uniprot ID: P20702
  ENSP ID: ENSP00000268296
MTRTRAALLLFTALATSLGFNLDTEELTAFRVDSAGFGDSVVQYANSWVVVGAPQKITAANQTGGLYQCGYSTGACEPIGLQVPPEAVNMSLGLSLASTTSPSQLLACGPTVHHECGRNMYLTGLCFLLGPTQLTQRLPVSRQECPRQEQDIVFLIDGSGSISSRNFATMMNFVRAVISQFQRPSTQFSLMQFSNKFQTHFTFEEFRRSSNPLSLLASVHQLQGFTYTATAIQNVVHRLFHASYGARRDAAKILIVITDGKKEGDSLDYKDVIPMADAAGIIRYAIGVGLAFQNRNSWKELNDIASKPSQEHIFKVEDFDALKDIQNQLKEKIFAIEGTETTSSSSFELEMAQEGFSAVFTPDGPVLGAVGSFTWSGGAFLYPPNMSPTFINMSQENVDMRDSYLGYSTELALWKGVQSLVLGAPRYQHTGKAVIFTQVSRQWRMKAEVTGTQIGSYFGASLCSVDVDSDGSTDLVLIGAPHYYEQTRGGQVSVCPLPRGWRRWWCDAVLYGEQGHPWGRFGAALTVLGDVNGDKLTDVVIGAPGEEENRGAVYLFHGVLGPSISPSHSQRIAGSQLSSRLQYFGQALSGGQDLTQDGLVDLAVGARGQVLLLRTRPVLWVGVSMQFIPAEIPRSAFECREQVVSEQTLVQSNICLYIDKRSKNLLGSRDLQSSVTLDLALDPGRLSPRATFQETKNRSLSRVRVLGLKAHCENFNLLLPSCVEDSVTPITLRLNFTLVGKPLLAFRNLRPMLAADAQRYFTASLPFEKNCGADHICQDNLGISFSFPGLKSLLVGSNLELNAEVMVWNDGEDSYGTTITFSHPAGLSYRYVAEGQKQGQLRSLHLTCDSAPVGSQGTWSTSCRINHLIFRGGAQITFLATFDVSPKAVLGDRLLLTANVSSENNTPRTSKTTFQLELPVKYAVYTVVSSHEQFTKYLNFSESEEKESHVAMHRYQVNNLGQRDLPVSINFWVPVELNQEAVWMDVEVSHPQNPSLRCSSEKIAPPASDFLAHIQKNPVLDCSIAGCLRFRCDVPSFSVQEELDFTLKGNLSFGWVRQILQKKVSVVSVAEITFDTSVYSQLPGQEAFMRAQTTTVLEKYKVHNPTPLIVGSSIGGLLLLALITAVLYKVGFFKRQYKEMMEEANGQIAPENGTQTPSPPSEK

SEQ ID NO: 40834 - protein, 1169 aa, Homo sapiens
  Payload ID: 8309
  Gene Symbol: ITGAX
  Gene Name: integrin, alpha X (complement component 3 receptor 4 subunit)
  ENSP ID: ENSP00000454623
MTRTRAALLLFTALATSLGFNLDTEELTAFRVDSAGFGDSVVQYANSWVVVGAPQKITAANQTGGLYQCGYSTGACEPIGLQVPPEAVNMSLGLSLASTTSPSQLLACGPTVHHECGRNMYLTGLCFLLGPTQLTQRLPVSRQECPRQEQDIVFLIDGSGSISSRNFATMMNFVRAVISQFQRPSTQFSLMQFSNKFQTHFTFEEFRRSSNPLSLLASVHQLQGFTYTATAIQNVVHRLFHASYGARRDAAKILIVITDGKKEGDSLDYKDVIPMADAAGIIRYAIGVGLAFQNRNSWKELNDIASKPSQEHIFKVEDFDALKDIQNQLKEKIFAIEGTETTSSSSFELEMAQEGFSAVFTPDGPVLGAVGSFTWSGGAFLYPPNMSPTFINMSQENVDMRDSYLGYSTELALWKGVQSLVLGAPRYQHTGKAVIFTQVSRQWRMKAEVTGTQIGSYFGASLCSVDVDSDGSTDLVLIGAPHYYEQTRGGQVSVCPLPRGWRRWWCDAVLYGEQGHPWGRFGAALTVLGDVNGDKLTDVVIGAPGEEENRGAVYLFHGVLGPSISPSHSQRIAGSQLSSRLQYFGQALSGGQDLTQDGLVDLAVGARGQVLLLRTRPVLWVGVSMQFIPAEIPRSAFECREQVVSEQTLVQSNICLYIDKRSKNLLGSRDLQSSVTLDLALDPGRLSPRATFQETKNRSLSRVRVLGLKAHCENFNLLLPSCVEDSVTPITLRLNFTLVGKPLLAFRNLRPMLAADAQRYFTASLPFEKNCGADHICQDNLGISFSFPGLKSLLVGSNLELNAEVMVWNDGEDSYGTTITFSHPAGLSYRYVAEGQKQGQLRSLHLTCDSAPVGSQGTWSTSCRINHLIFRGGAQITFLATFDVSPKAVLGDRLLLTANVSSENNTPRTSKTTFQLELPVKYAVYTVVSSHEQFTKYLNFSESEEKESHVAMHRYQVNNLGQRDLPVSINFWVPVELNQEAVWMDVEVSHPQNPSLRCSSEKIAPPASDFLAHIQKNPVLDCSIAGCLRFRCDVPSFSVQEELDFTLKGNLSFGWVRQILQKKVSVVSVAEITFDTSVYSQLPGQEAFMRAQTTTVLEKYKVHNPTPLIVGSSIGGLLLLALITAVLYKVGFFKRQYKEMMEEANGQIAPENGTQTPSPPTPHYPQDNV

SEQ ID NO: 40835 - protein, 181 aa, Homo sapiens
  Payload ID: 8309
  Gene Symbol: ITGAX
  Gene Name: integrin, alpha X (complement component 3 receptor 4 subunit)
  ENSP ID: ENSP00000483860
MTRTRAALLLFTALATSLGFNLDTEELTAFRVDSAGFGDSVVQYANSWVVVGAPQKITAANQTGGLYQCGYSTGACEPIGLQVPPEAVNMSLGLSLASTTSPSQLLLTQRLPVSRQGECRDHQGFEELTHIQLGVRWARDSLARVDQKEGIWKKSYHVLQWFLTLLPAHPADRPHAAGPFL

SEQ ID NO: 40836 - protein, 798 aa, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  Uniprot ID: P05556
  ENSP ID: ENSP00000303351
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 40837 - protein, 798 aa, Homo sapiens; identical to SEQ ID NO: 40836
  Payload ID: 8310
  Gene Symbol: ITGB1
  Gene Name: integrin, beta 1 (fibronectin receptor, beta polypeptide, antigen CD29 includes MDF2, MSK12)
  Uniprot ID: P05556
  ENSP ID: ENSP00000379350

SEQ ID NO: 40838 - protein, 801 aa, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  Uniprot ID: P05556
  ENSP ID: ENSP00000388694
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTQENPIYKSPINNFKNPNYGRKAGL

SEQ ID NO: 40839 - protein, 136 aa, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENSP ID: ENSP00000398029
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFK

SEQ ID NO: 40840 - protein, 49 aa, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENSP ID: ENSP00000400544
MNLQPIFWIGLISSVCCVFAQTDENRCLKANAKSCGECIQAGPNCGWCT

SEQ ID NO: 40841 - protein, 89 aa, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENSP ID: ENSP00000404546
MNLQPIFWIGLISSVCCVFAQTDENRCLKANAKSCGECIQAGPNCGWCTNSTFLQEGMPTSARCDDLEALKKKGCPPDDIENPRGSKDI

SEQ ID NO: 40842 - protein, 124 aa, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENSP ID: ENSP00000417243
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLR

SEQ ID NO: 40843 - protein, 70 aa, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENSP ID: ENSP00000417508
  MOD_RES (1)..(1): Any amino acid
XVAGVVAGIVLIGLALLLIWKLLMIIHDRREFAKFEKEKMNAKWDTQENPIYKSPINNFKNPNYGRKAGL

SEQ ID NO: 40844 - protein, 163 aa, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENSP ID: ENSP00000417537
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVK

SEQ ID NO: 40845 - protein, 108 aa, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENSP ID: ENSP00000417799
  MOD_RES (1)..(1): Any amino acid
XDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGV

SEQ ID NO: 40846 - protein, 152 aa, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENSP ID: ENSP00000418725
MNLQPIFWIGLISSVCCVFAQTDENRCLKANAKSCGECIQAGPNCGWCTNSVSKTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLM

SEQ ID NO: 40847 - protein, 98 aa, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENSP ID: ENSP00000420282
MPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSM

SEQ ID NO: 40848 - protein, 14 aa, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENSP ID: ENSP00000420416
MPTSARCDDLEALK

SEQ ID NO: 40849 - protein, 31 aa, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENSP ID: ENSP00000420792
MPTSARCDDLEALKKKGCPPDDIENPRGSKD

SEQ ID NO: 40850 - protein, 143 aa, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENSP ID: ENSP00000431326
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPI

SEQ ID NO: 40851 - protein, 104 aa, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENSP ID: ENSP00000436214
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAE

SEQ ID NO: 40852 - protein, 769 aa, Homo sapiens
  Payload ID: 8311
  Gene Symbol: ITGB2
  Gene Name: integrin, beta 2 (complement component 3 receptor 3 and 4 subunit)
  Uniprot ID: P05107
  ENSP ID: ENSP00000303242
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVHLIKNAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 40853 - protein, 322 aa, Homo sapiens
  Payload ID: 8311
  Gene Symbol: ITGB2
  Gene Name: integrin, beta 2 (complement component 3 receptor 3 and 4 subunit)
  ENSP ID: ENSP00000317697
GRLGKDLATGVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYE

SEQ ID NO: 40854 - protein, 769 aa, Homo sapiens; identical to SEQ ID NO: 40852
  Payload ID: 8311
  Gene Symbol: ITGB2
  Gene Name: integrin, beta 2 (complement component 3 receptor 3 and 4 subunit)
  Uniprot ID: P05107
  ENSP ID: ENSP00000347279

SEQ ID NO: 40855 - protein, 108 aa, Homo sapiens
  Payload ID: 8311
  Gene Symbol: ITGB2
  Gene Name: integrin, beta 2 (complement component 3 receptor 3 and 4 subunit)
  ENSP ID: ENSP00000380944
MLGLRPPLLALVGLLSLGCVLSQECTKFKVSSCRECIESGPGCTWCQKLGAALGPPAHATAASSPRRRSRVAPVCPRTEQGGQAPGGNYLGQAGFFPSPFWRFSAPLK

SEQ ID NO: 40856 - protein, 769 aa, Homo sapiens; identical to SEQ ID NO: 40852
  Payload ID: 8311
  Gene Symbol: ITGB2
  Gene Name: integrin, beta 2 (complement component 3 receptor 3 and 4 subunit)
  Uniprot ID: P05107
  ENSP ID: ENSP00000380948

SEQ ID NO: 40857 - protein, 769 aa, Homo sapiens; identical to SEQ ID NO: 40852
  Payload ID: 8311
  Gene Symbol: ITGB2
  Gene Name: integrin, beta 2 (complement component 3 receptor 3 and 4 subunit)
  Uniprot ID: P05107
  ENSP ID: ENSP00000380950

SEQ ID NO: 40858 - protein, 712 aa, Homo sapiens
  Payload ID: 8311
  Gene Symbol: ITGB2
  Gene Name: integrin, beta 2 (complement component 3 receptor 3 and 4 subunit)
  ENSP ID: ENSP00000380952
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVHLIKNAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 40859 - protein, 769 aa, Homo sapiens; identical to SEQ ID NO: 40852
  Payload ID: 8311
  Gene Symbol: ITGB2
  Gene Name: integrin, beta 2 (complement component 3 receptor 3 and 4 subunit)
  Uniprot ID: P05107
  ENSP ID: ENSP00000380955

SEQ ID NO: 40860 - protein, 71 aa, Homo sapiens
  Payload ID: 8311
  Gene Symbol: ITGB2
  Gene Name: integrin, beta 2 (complement component 3 receptor 3 and 4 subunit)
  ENSP ID: ENSP00000427732
MLGLRPPLLALVGLLSLGCGRPRAPTHQPASSLSPLSGVHEVQGQQLPGMHRVGARLHLVPEAELHRAGGS

SEQ ID NO: 40861 - protein, 49 aa, Homo sapiens
  Payload ID: 8311
  Gene Symbol: ITGB2
  Gene Name: integrin, beta 2 (complement component 3 receptor 3 and 4 subunit)
  ENSP ID: ENSP00000428125
MRGCAADDIMDPTSLAETQEDHNGGQKQLSPQKVTLYLRPGQAAAFNVT

SEQ ID NO: 40862 - protein, 120 aa, Homo sapiens
  Payload ID: 8311
  Gene Symbol: ITGB2
  Gene Name: integrin, beta 2 (complement component 3 receptor 3 and 4 subunit)
  ENSP ID: ENSP00000428413
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFR

SEQ ID NO: 40863 - protein, 93 aa, Homo sapiens
  Payload ID: 8311
  Gene Symbol: ITGB2
  Gene Name: integrin, beta 2 (complement component 3 receptor 3 and 4 subunit)
  ENSP ID: ENSP00000428434
MLGLRPPLLALVGLLSLGCVLSQECTKFKVSSCRECIESGPGCTWCQKLGAALGPPAHATAASSPRRRSRVAPVCPRTEQGGQAPELHRAGGS

SEQ ID NO: 40864 - protein, 166 aa, Homo sapiens
  Payload ID: 8311
  Gene Symbol: ITGB2
  Gene Name: integrin, beta 2 (complement component 3 receptor 3 and 4 subunit)
  ENSP ID: ENSP00000428503
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRI

SEQ ID NO: 40865 - protein, 70 aa, Homo sapiens
  Payload ID: 8311
  Gene Symbol: ITGB2
  Gene Name: integrin, beta 2 (complement component 3 receptor 3 and 4 subunit)
  ENSP ID: ENSP00000428870
MLGLRPPLLALVGLLSLGCVLSQECTKFKVSSCRECIESGPGCTWCQKLNFTGPGDPDSIRCDTRPQLLM

SEQ ID NO: 40866 - protein, 160 aa, Homo sapiens
  Payload ID: 8311
  Gene Symbol: ITGB2
  Gene Name: integrin, beta 2 (complement component 3 receptor 3 and 4 subunit)
  ENSP ID: ENSP00000428979
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEI

SEQ ID NO: 40867 - protein, 49 aa, Homo sapiens
  Payload ID: 8311
  Gene Symbol: ITGB2
  Gene Name: integrin, beta 2 (complement component 3 receptor 3 and 4 subunit)
  ENSP ID: ENSP00000429683
MLGLRPPLLALVGLLSLGCVLSQECTKFKVSSCRECIESGPGCTWCQKL

SEQ ID NO: 40868 - protein, 37 aa, Homo sapiens
  Payload ID: 8311
  Gene Symbol: ITGB2
  Gene Name: integrin, beta 2 (complement component 3 receptor 3 and 4 subunit)
  ENSP ID: ENSP00000430901
MRGCAADDIMDPTSLAETQEDHNGGQKQLSPQKVTLY

SEQ ID NO: 40869 - protein, 378 aa, Homo sapiens
  Payload ID: 8311
  Gene Symbol: ITGB2
  Gene Name: integrin, beta 2 (complement component 3 receptor 3 and 4 subunit)
  ENSP ID: ENSP00000480700
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVHLIKNAYNKLSSRVFLDHNALPDTLKVTYDSFCSNGVTHRNQPRGDCDGVQINVPITFQVKVTATECIQEQSFVIGRWASRT

SEQ ID NO: 40870 - protein, 788 aa, Homo sapiens
  Payload ID: 8312
  Gene Symbol: ITGB3
  Gene Name: integrin, beta 3 (platelet glycoprotein IIIa, antigen CD61)
  Uniprot ID: P05106
  ENSP ID: ENSP00000452786
MRARPRPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 40871 - protein, 443 aa, Homo sapiens
  Payload ID: 8312
  Gene Symbol: ITGB3
  Gene Name: integrin, beta 3 (platelet glycoprotein IIIa, antigen CD61)
  ENSP ID: ENSP00000461626
MRARPRPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVRWAGQGLCPGASVGTQPPFFLL

SEQ ID NO: 40872 - protein, 35 aa, Homo sapiens
  Payload ID: 8312
  Gene Symbol: ITGB3
  Gene Name: integrin, beta 3 (platelet glycoprotein IIIa, antigen CD61)
  ENSP ID: ENSP00000465586
LKSCMGLKIGDTVRWAGQGLCPGASVGTQPPFFLL

SEQ ID NO: 40873 - protein, 1822 aa, Homo sapiens
  Payload ID: 8313
  Gene Symbol: ITGB4
  Gene Name: integrin, beta 4
  Uniprot ID: P16144
  ENSP ID: ENSP00000200181
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTGCGWKFEPLLGEELDLRRVTWRLPPELIPRLSASSGRSSDAEAPHGPPDDGGAGGKGGSLPRSATPGPPGEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 40874 - protein, 1805 aa, Homo sapiens
  Payload ID: 8313
  Gene Symbol: ITGB4
  Gene Name: integrin, beta 4
  Uniprot ID: P16144
  ENSP ID: ENSP00000400217
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHGLPPIWEHGRSRLPLSWALGSRSRAQMKGFPPSRGPRDSIILAGRPAAPSWGPDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 40875 - protein, 1752 aa, Homo sapiens
  Payload ID: 8313
  Gene Symbol: ITGB4
  Gene Name: integrin, beta 4
  Uniprot ID: P16144
  ENSP ID: ENSP00000405536
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 40876 - protein, 63 aa, Homo sapiens
  Payload ID: 8313
  Gene Symbol: ITGB4
  Gene Name: integrin, beta 4
  ENSP ID: ENSP00000462494
  MOD_RES (1)..(1): Any amino acid
XARTTEGFGPEREGIITIESQDGGPFPQLGSRAGLFQHPLQSEYSSITTTHTSATEPFLVGEH

SEQ ID NO: 40877 - protein, 1752 aa, Homo sapiens; identical to SEQ ID NO: 40875
  Payload ID: 8313
  Gene Symbol: ITGB4
  Gene Name: integrin, beta 4
  Uniprot ID: P16144
  ENSP ID: ENSP00000463651

SEQ ID NO: 40878 - protein, 114 aa, Homo sapiens
  Payload ID: 8313
  Gene Symbol: ITGB4
  Gene Name: integrin, beta 4
  ENSP ID: ENSP00000463788
SNSMSDDLDNLKKMGQNLARVLSQLTSDYTIGFGKFVDKVSVPQTDMRPEKLKEPWPNSDPPFSFKNVISLTEDVDEFRNKLQGERISATPSLHPWGPSPPACTEQGLGVSWEA

SEQ ID NO: 40879 - protein, 201 aa, Homo sapiens
  Payload ID: 8313
  Gene Symbol: ITGB4
  Gene Name: integrin, beta 4
  ENSP ID: ENSP00000464259
  MOD_RES (1)..(1): Any amino acid
XTNSLHRMTTTSAAAYGTHLSPHVPHRVLSTSSTLTRDYNSLTRSEHSHSTTLPRDYSTLTSVSSHGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVP

SEQ ID NO: 40880 - protein, 799 aa, Homo sapiens
  Payload ID: 8314
  Gene Symbol: ITGB5
  Gene Name: integrin, beta 5
  Uniprot ID: P18084
  ENSP ID: ENSP00000296181
MPRAPAPLYACLLGLCALLPRLAGLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLREPECGNTPNAMTILLAVVGSILLVGLALLAIWKLLVTIHDRREFAKFQSERSRARYEMASNPLYRKPISTHTVDFTFNKFNKSYNGTVD

SEQ ID NO: 40881 - protein, 40 aa, Homo sapiens
  Payload ID: 8314
  Gene Symbol: ITGB5
  Gene Name: integrin, beta 5
  ENSP ID: ENSP00000418079
MTPQEIAVNLRPEQWPRVPDGGLTRDAQCLGNGLTQCCMW

SEQ ID NO: 40882 - protein, 263 aa, Homo sapiens
  Payload ID: 8314
  Gene Symbol: ITGB5
  Gene Name: integrin, beta 5
  ENSP ID: ENSP00000418367
  MOD_RES (1)..(1): Any amino acid
XYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGT

SEQ ID NO: 40883 - protein, 79 aa, Homo sapiens
  Payload ID: 8314
  Gene Symbol: ITGB5
  Gene Name: integrin, beta 5
  ENSP ID: ENSP00000419198
MTPQEIAVNLRPGDKTTFQLQVRQVEDYPVDLYYLMDLSLSMKDDLDNIRSLGTKLAEEMRKLTSNFRLGFGSFVDKDI

SEQ ID NO: 40884 - protein, 401 aa, Homo sapiens
  Payload ID: 8314
  Gene Symbol: ITGB5
  Gene Name: integrin, beta 5
  ENSP ID: ENSP00000420814
  MOD_RES (1)..(1): Any amino acid
XKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLRE

SEQ ID NO: 40885 - protein, 59 aa, Homo sapiens
  Payload ID: 8314
  Gene Symbol: ITGB5
  Gene Name: integrin, beta 5
  ENSP ID: ENSP00000476655
MTPQEIAVNLRPGDKTTFQLQVRQVEDYPVDLYYLMDLSLSMKDDLDNIRSLGTKLAEE

SEQ ID NO: 40886 - protein, 139 aa, Homo sapiens
  Payload ID: 8314
  Gene Symbol: ITGB5
  Gene Name: integrin, beta 5
  ENSP ID: ENSP00000477230
MTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPE

SEQ ID NO: 40887 - protein, 323 aa, Homo sapiens
  Payload ID: 8314
  Gene Symbol: ITGB5
  Gene Name: integrin, beta 5
  ENSP ID: ENSP00000477446
IRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCR

SEQ ID NO: 40888 - protein, 788 aa, Homo sapiens
  Payload ID: 8315
  Gene Symbol: ITGB6
  Gene Name: integrin, beta 6
  Uniprot ID: P18564
  ENSP ID: ENSP00000283249
MGIELLCLFFLFLGRNDHVQGGCALGGAETCEDCLLIGPQCAWCAQENFTHPSGVGERCDTPANLLAKGCQLNFIENPVSQVEILKNKPLSVGRQKNSSDIVQIAPQSLILKLRPGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVIPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQKEVEVNSSKCHHGNGSFQCGVCACHPGHMGPRCECGEDMLSTDSCKEAPDHPSCSGRGDCYCGQCICHLSPYGNIYGPYCQCDNFSCVRHKGLLCGGNGDCDCGECVCRSGWTGEYCNCTTSTDSCVSEDGVLCSGRGDCVCGKCVCTNPGASGPTCERCPTCGDPCNSKRSCIECHLSAAGQAREECVDKCKLAGATISEEEDFSKDGSVSCSLQGENECLITFLITTDNEGKTIIHSINEKDCPKPPNIPMIMLGVSLAILLIGVVLLCIWKLLVSFHDRKEVAKFEAERSKAKWQTGTNPLYRGSTSTFKNVTYKHREKQKVDLSTDC

SEQ ID NO: 40889 - protein, 788 aa, Homo sapiens; identical to SEQ ID NO: 40888
  Payload ID: 8315
  Gene Symbol: ITGB6
  Gene Name: integrin, beta 6
  Uniprot ID: P18564
  ENSP ID: ENSP00000386367

SEQ ID NO: 40890 - protein, 70 aa, Homo sapiens
  Payload ID: 8315
  Gene Symbol: ITGB6
  Gene Name: integrin, beta 6
  ENSP ID: ENSP00000386477
MGIELLCLFFLFLGRNDHVQGGCALGGAETCEDCLLIGPQCAWCAQENFTHPSGVGERWCADSAGACPPD

SEQ ID NO: 40891 - protein, 681 aa, Homo sapiens
  Payload ID: 8315
  Gene Symbol: ITGB6
  Gene Name: integrin, beta 6
  Uniprot ID: P18564
  ENSP ID: ENSP00000386828
MGIELLCLFFLFLGRNDHVQGGCALGGAETCEDCLLIGPQCAWCAQENFTHPSGVGERCDTPANLLAKGCQLNFIENPVSQVEILKNKPLSVGRQKNSSDIVQIAPQSLILKLRPGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVIPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQKEVEVNSSKCHHGNGSFQCGVCACHPGHMGPRCECGEDMLSTDSCKEAPDHPSCSGRGDCYCGQCICHLSPYGNIYGPYCQCDNFSCVRHKGLLCGDFSKDGSVSCSLQGENECLITFLITTDNEGKTIIHSINEKDCPKPPNIPMIMLGVSLAILLIGVVLLCIWKLLVSFHDRKEVAKFEAERSKAKWQTGTNPLYRGSTSTFKNVTYKHREKQKVDLSTDC

SEQ ID NO: 40892 - protein, 746 aa, Homo sapiens
  Payload ID: 8315
  Gene Symbol: ITGB6
  Gene Name: integrin, beta 6
  ENSP ID: ENSP00000408024
MITYKNFTHPSGVGERCDTPANLLAKGCQLNFIENPVSQVEILKNKPLSVGRQKNSSDIVQIAPQSLILKLRPGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVIPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQKEVEVNSSKCHHGNGSFQCGVCACHPGHMGPRCECGEDMLSTDSCKEAPDHPSCSGRGDCYCGQCICHLSPYGNIYGPYCQCDNFSCVRHKGLLCGGNGDCDCGECVCRSGWTGEYCNCTTSTDSCVSEDGVLCSGRGDCVCGKCVCTNPGASGPTCERCPTCGDPCNSKRSCIECHLSAAGQAREECVDKCKLAGATISEEEDFSKDGSVSCSLQGENECLITFLITTDNEGKTIIHSINEKDCPKPPNIPMIMLGVSLAILLIGVVLLCIWKLLVSFHDRKEVAKFEAERSKAKWQTGTNPLYRGSTSTFKNVTYKHREKQKVDLSTDC

SEQ ID NO: 40893 - protein, 693 aa, Homo sapiens
  Payload ID: 8315
  Gene Symbol: ITGB6
  Gene Name: integrin, beta 6
  ENSP ID: ENSP00000481183
MGIELLCLFFLFLGRNDHVQGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVIPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQKEVEVNSSKCHHGNGSFQCGVCACHPGHMGPRCECGEDMLSTDSCKEAPDHPSCSGRGDCYCGQCICHLSPYGNIYGPYCQCDNFSCVRHKGLLCGGNGDCDCGECVCRSGWTGEYCNCTTSTDSCVSEDGVLCSGRGDCVCGKCVCTNPGASGPTCERCPTCGDPCNSKRSCIECHLSAAGQAREECVDKCKLAGATISEEEDFSKDGSVSCSLQGENECLITFLITTDNEGKTIIHSINEKDCPKPPNIPMIMLGVSLAILLIGVVLLCIWKLLVSFHDRKEVAKFEAERSKAKWQTGTNPLYRGSTSTFKNVTYKHREKQKVDLSTDC

SEQ ID NO: 40894 - protein, 798 aa, Homo sapiens
  Payload ID: 8316
  Gene Symbol: ITGB7
  Gene Name: integrin, beta 7
  Uniprot ID: P26010
  ENSP ID: ENSP00000267082
MVALPMVLVLLLVLSRGESELDAKIPSTGDATEWRNPHLSMLGSCQPAPSCQKCILSHPSCAWCKQLNFTASGEAEARRCARREELLARGCPLEELEEPRGQQEVLQDQPLSQGARGEGATQLAPQRVRVTLRPGEPQQLQVRFLRAEGYPVDLYYLMDLSYSMKDDLERVRQLGHALLVRLQEVTHSVRIGFGSFVDKTVLPFVSTVPSKLRHPCPTRLERCQSPFSFHHVLSLTGDAQAFEREVGRQSVSGNLDSPEGGFDAILQAALCQEQIGWRNVSRLLVFTSDDTFHTAGDGKLGGIFMPSDGHCHLDSNGLYSRSTEFDYPSVGQVAQALSAANIQPIFAVTSAALPVYQELSKLIPKSAVGELSEDSSNVVQLIMDAYNSLSSTVTLEHSSLPPGVHISYESQCEGPEKREGKAEDRGQCNHVRINQTVTFWVSLQATHCLPEPHLLRLRALGFSEELIVELHTLCDCNCSDTQPQAPHCSDGQGHLQCGVCSCAPGRLGRLCECSVAELSSPDLESGCRAPNGTGPLCSGKGHCQCGRCSCSGQSSGHLCECDDASCERHEGILCGGFGRCQCGVCHCHANRTGRACECSGDMDSCISPEGGLCSGHGRCKCNRCQCLDGYYGALCDQCPGCKTPCERHRDCAECGAFRTGPLATNCSTACAHTNVTLALAPILDDGWCKERTLDNQLFFFLVEDDARGTVVLRVRPQEKGADHTQAIVLGCVGGIVAVGLGLVLAYRLSVEIYDRREYSRFEKEQQQLNWKQDSNPLYKSAITTTINPRFQEADSPTL

SEQ ID NO: 40895 - protein, 798 aa, Homo sapiens; identical to SEQ ID NO: 40894
  Payload ID: 8316
  Gene Symbol: ITGB7
  Gene Name: integrin, beta 7
  Uniprot ID: P26010
  ENSP ID: ENSP00000408741

SEQ ID NO: 40896 - protein, 471 aa, Homo sapiens
  Payload ID: 8316
  Gene Symbol: ITGB7
  Gene Name: integrin, beta 7
  ENSP ID: ENSP00000437375
MVALPMVLVLLLVLSRGESELDAKIPSTGDATEWRNPHLSMLGSCQPAPSCQKCILSHPSCAWCKQLNFTASGEAEARRCARREELLARGCPLEELEEPRGQQEVLQDQPLSQGARGEGATQLAPQRVRVTLRPGEPQQLQVRFLRAEGYPVDLYYLMDLSYSMKDDLERVRQLGHALLVRLQEVTHSVRIGFGSFVDKTVLPFVSTVPSKLRHPCPTRLERCQSPFSFHHVLSLTGDAQAFEREVGRQSVSGNLDSPEGGFDAILQAALCQEQIGWRNVSRLLVFTSDDTFHTAGDGKLGGIFMPSDGHCHLDSNGLYSRSTEFDYPSVGQVAQALSAANIQPIFAVTSAALPVYQELSKLIPKSAVGELSEDSSNVVQLIMDAYNSLSSTVTLEHSSLPPGVHISYESQCEGPEKREGKAEDRGQCNHVRINQTGLCRVWGLQDWPTGHQLQYSLCPYQCDPGLGPYLG

SEQ ID NO: 40897 - protein, 88 aa, Homo sapiens
  Payload ID: 8316
  Gene Symbol: ITGB7
  Gene Name: integrin, beta 7
  ENSP ID: ENSP00000446703
MVALPMVLVLLLVLSRGESELDAKIPSTGDATEWRNPHLSMLGSCQPAPSCQKCILSHPSCAWCKQLNFTASGEAEARRCARREELLA

SEQ ID NO: 40898 - protein, 158 aa, Homo sapiens
  Payload ID: 8316
  Gene Symbol: ITGB7
  Gene Name: integrin, beta 7
  ENSP ID: ENSP00000450366
MVALPMVLVLLLVLSRGESELDAKIPSTGDATEWRNPHLSMLGSCQPAPSCQKCILSHPSCAWCKQLNFTASGEAEARRCARREELLARGCPLEELEEPRGQQEVLQDQPLSQGARGEGATQLAPQRVRVTLRPGEPQQLQVRFLRAEGYPVDLYYLM

SEQ ID NO: 40899 - protein, 650 aa, Homo sapiens
  Payload ID: 8316
  Gene Symbol: ITGB7
  Gene Name: integrin, beta 7
  Uniprot ID: P26010
  ENSP ID: ENSP00000455374
MVALPMVLVLLLVLSRGESELDAKIPSTGDATEWRNPHLSMLGSCQPAPSCQKCILSHPSCAWCKQLNFTASGEAEARRCARREELLARGCPLEELEEPRGQQEVLQDQPLSQGARGEGATQLAPQRVRVTLRPGEPQQLQVRFLRAEGYPVDLYYLMDLSYSMKDDLERVRQLGHALLVRLQEVTHSVRIGFGSFVDKTVLPFVSTVPSKLRHPCPTRLERCQSPFSFHHVLSLTGDAQAFEREVGRQSVSGNLDSPEGGFDAILQAALCQEQIGWRNVSRLLVFTSDDTFHTAGDGKLGGIFMPSDGHCHLDSNGLYSRSTEFDYPSVGQVAQALSAANIQPIFAVTSAALPVYQELSKLIPKSAVGELSEDSSNVVQLIMDAYNSLSSTVTLEHSSLPPGVHISYESQCEGPEKREGKAEDRGQCNHVRINQTVTFWVSLQATHCLPEPHLLRLRALGFSEELIVELHTLCDCNCSDTQPQAPHCSDGQGHLQCGVCRDCAECGAFRTGPLATNCSTACAHTNVTLALAPILDDGWCKERTLDNQLFFFLVEDDARGTVVLRVRPQEKGADHTQAIVLGCVGGIVAVGLGLVLAYRLSVEIYDRREYSRFEKEQQQLNWKQDSNPLYKSAITTTINPRFQEADSPTL

SEQ ID NO: 40900 - protein, 93 aa, Homo sapiens
  Payload ID: 8316
  Gene Symbol: ITGB7
  Gene Name: integrin, beta 7
  ENSP ID: ENSP00000456305
MVALPMVLVLLLVLSRGESELDAKIPSTGDATEWRNPHLSMLGSCQPAPSCQKCILSHPSCAWCKQLNFTASGEAEARRCARREELLARGCPL

SEQ ID NO: 40901 - protein, 117 aa, Homo sapiens
  Payload ID: 8316
  Gene Symbol: ITGB7
  Gene Name: integrin, beta 7
  ENSP ID: ENSP00000456446
  MOD_RES (1)..(1): Any amino acid
XSTACAHTNVTLALAPILDDGWCKERTLDNQLFFFLVEDDARGTVVLRVRPQEKGADHTQAIVLGCVGGIVAVGLGLVLAYRLSVEIYDRREYSRFEKEQQQLNWKQLLGFGSRLAS

SEQ ID NO: 40902 - protein, 769 aa, Homo sapiens
  Payload ID: 8317
  Gene Symbol: ITGB8
  Gene Name: integrin, beta 8
  Uniprot ID: P26012
  ENSP ID: ENSP00000222573
MCGSALAFFTAAFVCLQNDRRGPASFLWAAWVFSLVLGLGQGEDNRCASSNAASCARCLALGPECGWCVQEDFISGGSRSERCDIVSNLISKGCSVDSIEYPSVHVIIPTENEINTQVTPGEVSIQLRPGAEANFMLKVHPLKKYPVDLYYLVDVSASMHNNIEKLNSVGNDLSRKMAFFSRDFRLGFGSYVDKTVSPYISIHPERIHNQCSDYNLDCMPPHGYIHVLSLTENITEFEKAVHRQKISGNIDTPEGGFDAMLQAAVCESHIGWRKEAKRLLLVMTDQTSHLALDSKLAGIVVPNDGNCHLKNNVYVKSTTMEHPSLGQLSEKLIDNNINVIFAVQGKQFHWYKDLLPLLPGTIAGEIESKAANLNNLVVEAYQKLISEVKVQVENQVQGIYFNITAICPDGSRKPGMEGCRNVTSNDEVLFNVTVTMKKCDVTGGKNYAIIKPIGFNETAKIHIHRNCSCQCEDNRGPKGKCVDETFLDSKCFQCDENKCHFDEDQFSSESCKSHKDQPVCSGRGVCVCGKCSCHKIKLGKVYGKYCEKDDFSCPYHHGNLCAGHGECEAGRCQCFSGWEGDRCQCPSAAAQHCVNSKGQVCSGRGTCVCGRCECTDPRSIGRFCEHCPTCYTACKENWNCMQCLHPHNLSQAILDQCKTSCALMEQQHYVDQTSECFSSPSYLRIFFIIFIVTFLIGLLKVLIIRQVILQWNSNKIKSSSDYRVSASKKDKLILQSVCTRAVTYRREKPEEIKMDISKLNAHETFRCNF

SEQ ID NO: 40903 - protein, 634 aa, Homo sapiens
  Payload ID: 8317
  Gene Symbol: ITGB8
  Gene Name: integrin, beta 8
  Uniprot ID: P26012
  ENSP ID: ENSP00000441561
MLKVHPLKKYPVDLYYLVDVSASMHNNIEKLNSVGNDLSRKMAFFSRDFRLGFGSYVDKTVSPYISIHPERIHNQCSDYNLDCMPPHGYIHVLSLTENITEFEKAVHRQKISGNIDTPEGGFDAMLQAAVCESHIGWRKEAKRLLLVMTDQTSHLALDSKLAGIVVPNDGNCHLKNNVYVKSTTMEHPSLGQLSEKLIDNNINVIFAVQGKQFHWYKDLLPLLPGTIAGEIESKAANLNNLVVEAYQKLISEVKVQVENQVQGIYFNITAICPDGSRKPGMEGCRNVTSNDEVLFNVTVTMKKCDVTGGKNYAIIKPIGFNETAKIHIHRNCSCQCEDNRGPKGKCVDETFLDSKCFQCDENKCHFDEDQFSSESCKSHKDQPVCSGRGVCVCGKCSCHKIKLGKVYGKYCEKDDFSCPYHHGNLCAGHGECEAGRCQCFSGWEGDRCQCPSAAAQHCVNSKGQVCSGRGTCVCGRCECTDPRSIGRFCEHCPTCYTACKENWNCMQCLHPHNLSQAILDQCKTSCALMEQQHYVDQTSECFSSPSYLRIFFIIFIVTFLIGLLKVLIIRQVILQWNSNKIKSSSDYRVSASKKDKLILQSVCTRAVTYRREKPEEIKMDISKLNAHETFRCNF

SEQ ID NO: 40904 - protein, 401 aa, Homo sapiens
  Payload ID: 8318
  Gene Symbol: ITGBL1
  Gene Name: integrin, beta-like 1 (with EGF-like repeat domains)
  Uniprot ID: O95965
  ENSP ID: ENSP00000365332
MNLVAVMGAFNKGHGKCDCGKCKCDQGWYGDACQYPTNCDLTKKKSNQMCKNSQDIICSNAGTCHCGRCKCDNSDGSGLVYGKFCECDDRECIDDETEEICGGHGKCYCGNCYCKAGWHGDKCEFQCDITPWESKRRCTSPDGKICSNRGTCVCGECTCHDVDPTGDWGDIHGDTCECDERDCRAVYDRYSDDFCSGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTGNGICSCGNCECWDGWNGNACEIWLGSEYP

SEQ ID NO: 40905 - protein, 494 aa, Homo sapiens
  Payload ID: 8318
  Gene Symbol: ITGBL1
  Gene Name: integrin, beta-like 1 (with EGF-like repeat domains)
  Uniprot ID: O95965
  ENSP ID: ENSP00000365351
MRPPGFRNFLLLASSLLFAGLSAVPQSFSPSLRSWPGAACRLSRAESERRCRAPGQPPGAALCHGRGRCDCGVCICHVTEPGMFFGPLCECHEWVCETYDGSTCAGHGKCDCGKCKCDQGWYGDACQYPTNCDLTKKKSNQMCKNSQDIICSNAGTCHCGRCKCDNSDGSGLVYGKFCECDDRECIDDETEEICGGHGKCYCGNCYCKAGWHGDKCEFQCDITPWESKRRCTSPDGKICSNRGTCVCGECTCHDVDPTGDWGDIHGDTCECDERDCRAVYDRYSDDFCSGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTGNGICSCGNCECWDGWNGNACEIWLGSEYP

SEQ ID NO: 40906 - protein, 353 aa, Homo sapiens
  Payload ID: 8318
  Gene Symbol: ITGBL1
  Gene Name: integrin, beta-like 1 (with EGF-like repeat domains)
  Uniprot ID: O95965
  ENSP ID: ENSP00000439903
MCKNSQDIICSNAGTCHCGRCKCDNSDGSGLVYGKFCECDDRECIDDETEEICGGHGKCYCGNCYCKAGWHGDKCEFQCDITPWESKRRCTSPDGKICSNRGTCVCGECTCHDVDPTGDWGDIHGDTCECDERDCRAVYDRYSDDFCSGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTGNGICSCGNCECWDGWNGNACEIWLGSEYP

SEQ ID NO: 40907 - protein, 208 aa, Homo sapiens
  Payload ID: 8318
  Gene Symbol: ITGBL1
  Gene Name: integrin, beta-like 1 (with EGF-like repeat domains)
  ENSP ID: ENSP00000475328
  MOD_RES (1)..(1): Any amino acid
XCEGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTGNGICSCGNCECWDGWNGNACEIWLGSEYP

SEQ ID NO: 40908 - protein, 401 aa, Homo sapiens
  Payload ID: 8318
  Gene Symbol: ITGBL1
  Gene Name: integrin, beta-like 1 (with EGF-like repeat domains)
  ENSP ID: ENSP00000481065
MSGCARPTTGAPVQAMVSVGKCKCDQGWYGDACQYPTNCDLTKKKSNQMCKNSQDIICSNAGTCHCGRCKCDNSDGSGLVYGKFCECDDRECIDDETEEICGGHGKCYCGNCYCKAGWHGDKCEFQCDITPWESKRRCTSPDGKICSNRGTCVCGECTCHDVDPTGDWGDIHGDTCECDERDCRAVYDRYSDDFCSGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTGNGICSCGNCECWDGWNGNACEIWLGSEYP

SEQ ID NO: 40909 - protein, 445 aa, Homo sapiens
  Payload ID: 8318
  Gene Symbol: ITGBL1
  Gene Name: integrin, beta-like 1 (with EGF-like repeat domains)
  ENSP ID: ENSP00000481484
MRPPGFRNFLLLASSLLFAGLSAVPQSFSPSLRSWPGAACRLSRAESERRCRAPGQPPGAALCHGRGRCDCGVCICHVTEPGMFFGPLCECHEWVCETYDGSTCAGTCHCGRCKCDNSDGSGLVYGKFCECDDRECIDDETEEICGGHGKCYCGNCYCKAGWHGDKCEFQCDITPWESKRRCTSPDGKICSNRGTCVCGECTCHDVDPTGDWGDIHGDTCECDERDCRAVYDRYSDDFCSGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTGNGICSCGNCECWDGWNGNACEIWLGSEYP

SEQ ID NO: 40910 - protein, 317 aa, Homo sapiens
  Payload ID: 8319
  Gene Symbol: IBSP
  Gene Name: integrin-binding sialoprotein
  Uniprot ID: P21815
  ENSP ID: ENSP00000226284
MKTALILLSILGMACAFSMKNLHRRVKIEDSEENGVFKYRPRYYLYKHAYFYPHLKRFPVQGSSDSSEENGDDSSEEEEEEEETSNEGENNEESNEDEDSEAENTTLSATTLGYGEDATPGTGYTGLAAIQLPKKAGDITNKATKEKESDEEEEEEEEGNENEESEAEVDENEQGINGTSTNSTEAENGNGSSGGDNGEEGEEESVTGANAEDTTETGRQGKGTSKTTTSPNGGFEPTTPPQVYRTTSPPFGKTTTVEYEGEYEYTGANEYDNGYEIYESENGEPRGDNYRAYEDEYSYFKGQGYDGYDGQNYYHHQ

SEQ ID NO: 40911 - protein, 452 aa, Homo sapiens
  Payload ID: 8320
  Gene Symbol: ILK
  Gene Name: integrin-linked kinase
  Uniprot ID: Q13418
  ENSP ID: ENSP00000299421
MDDIFTQCREGNAVAVRLWLDNTENDLNQGDDHGFSPLHWACREGRSAVVEMLIMRGARINVMNRGDDTPLHLAASHGHRDIVQKLLQYKADINAVNEHGNVPLHYACFWGQDQVAEDLVANGALVSICNKYGEMPVDKAKAPLRELLRERAEKMGQNLNRIPYKDTFWKGTTRTRPRNGTLNKHSGIDFKQLNFLTKLNENHSGELWKGRWQGNDIVVKVLKVRDWSTRKSRDFNEECPRLRIFSHPNVLPVLGACQSPPAPHPTLITHWMPYGSLYNVLHEGTNFVVDQSQAVKFALDMARGMAFLHTLEPLIPRHALNSRSVMIDEDMTARISMADVKFSFQCPGRMYAPAWVAPEALQKKPEDTNRRSADMWSFAVLLWELVTREVPFADLSNMEIGMKVALEGLRPTIPPGISPHVCKLMKICMNEDPAKRPKFDMIVPILEKMQDK

SEQ ID NO: 40912 - protein, 452 aa, Homo sapiens; identical to SEQ ID NO: 40911
  Payload ID: 8320
  Gene Symbol: ILK
  Gene Name: integrin-linked kinase
  Uniprot ID: Q13418
  ENSP ID: ENSP00000379975

SEQ ID NO: 40913 - protein, 452 aa, Homo sapiens; identical to SEQ ID NO: 40911
  Payload ID: 8320
  Gene Symbol: ILK
  Gene Name: integrin-linked kinase
  Uniprot ID: Q13418
  ENSP ID: ENSP00000403487

SEQ ID NO: 40914 - protein, 36 aa, Homo sapiens
  Payload ID: 8320
  Gene Symbol: ILK
  Gene Name: integrin-linked kinase
  ENSP ID: ENSP00000432617
MDDIFTQCREGNAVAVRLWLDNTENDLNQGIVLDAL

SEQ ID NO: 40915 - protein, 318 aa, Homo sapiens
  Payload ID: 8320
  Gene Symbol: ILK
  Gene Name: integrin-linked kinase
  Uniprot ID: Q13418
  ENSP ID: ENSP00000434492
MPVDKAKAPLRELLRERAEKMGQNLNRIPYKDTFWKGTTRTRPRNGTLNKHSGIDFKQLNFLTKLNENHSGELWKGRWQGNDIVVKVLKVRDWSTRKSRDFNEECPRLRIFSHPNVLPVLGACQSPPAPHPTLITHWMPYGSLYNVLHEGTNFVVDQSQAVKFALDMARGMAFLHTLEPLIPRHALNSRSVMIDEDMTARISMADVKFSFQCPGRMYAPAWVAPEALQKKPEDTNRRSADMWSFAVLLWELVTREVPFADLSNMEIGMKVALEGLRPTIPPGISPHVCKLMKICMNEDPAKRPKFDMIVPILEKMQDK

SEQ ID NO: 40916 - protein, 391 aa, Homo sapiens
  Payload ID: 8320
  Gene Symbol: ILK
  Gene Name: integrin-linked kinase
  Uniprot ID: Q13418
  ENSP ID: ENSP00000435323
MDDIFTQCREGNAVAVRLWLDNTENDLNQGDDHGFSPLHWACREGRSAVVEMLIMRGARINVMNRGDDTPLHLAASHGHRDIVQKLLQYKADINAVNEHGNVPLHYACFWGQDQVAESGQRRWARISTVFHTRTHSGRGPPALGPLWKGRWQGNDIVVKVLKVRDWSTRKSRDFNEECPRLRIFSHPNVLPVLGACQSPPAPHPTLITHWMPYGSLYNVLHEGTNFVVDQSQAVKFALDMARGMAFLHTLEPLIPRHALNSRSVMIDEDMTARISMADVKFSFQCPGRMYAPAWVAPEALQKKPEDTNRRSADMWSFAVLLWELVTREVPFADLSNMEIGMKVALEGLRPTIPPGISPHVCKLMKICMNEDPAKRPKFDMIVPILEKMQDK

SEQ ID NO: 40917 - protein, 36 aa, Homo sapiens; identical to SEQ ID NO: 40914
  Payload ID: 8320
  Gene Symbol: ILK
  Gene Name: integrin-linked kinase
  ENSP ID: ENSP00000436062

SEQ ID NO: 40918 - protein, 483 aa, Homo sapiens
  Payload ID: 8320
  Gene Symbol: ILK
  Gene Name: integrin-linked kinase
  ENSP ID: ENSP00000439606
MDDIFTQCREGNAVAVRLWLDNTENDLNQGDDHGFSPLHWACREGRSAVVEMLIMRGARINVMNRGDDTPLHLAASHGHRDIVQKLLQYKADINAVNEHGNVPLHYACFWGQDQVAEDLVANGALVSICNKYGEMPVDKAKAPLRELLRGPSPHPLACVLSSLPTCLLPLYHSLGCFSSLERAEKMGQNLNRIPYKDTFWKGTTRTRPRNGTLNKHSGIDFKQLNFLTKLNENHSGELWKGRWQGNDIVVKVLKVRDWSTRKSRDFNEECPRLRIFSHPNVLPVLGACQSPPAPHPTLITHWMPYGSLYNVLHEGTNFVVDQSQAVKFALDMARGMAFLHTLEPLIPRHALNSRSVMIDEDMTARISMADVKFSFQCPGRMYAPAWVAPEALQKKPEDTNRRSADMWSFAVLLWELVTREVPFADLSNMEIGMKVALEGLRPTIPPGISPHVCKLMKICMNEDPAKRPKFDMIVPILEKMQDK

SEQ ID NO: 40919 - protein, 40 aa, Homo sapiens
  Payload ID: 8320
  Gene Symbol: ILK
  Gene Name: integrin-linked kinase
  ENSP ID: ENSP00000479932
MDDIFTQCREGNAVAVRLWLDNTENDLNQGYCSTRQTSMQ

SEQ ID NO: 40920 - protein, 111 aa, Homo sapiens
  Payload ID: 8320
  Gene Symbol: ILK
  Gene Name: integrin-linked kinase
  ENSP ID: ENSP00000480597
REGNAVAVRLWLDNTENDLNQGDDHGFSPLHWACREGRSAVVEMLIMRGARINVMNRGDDTPLHLAASHGHRDIVQKLLQYKADINAVNEHGNVPLHYACFWGQDQVAEDK

SEQ ID NO: 40921 - protein, 36 aa, Homo sapiens; identical to SEQ ID NO: 40914
  Payload ID: 8320
  Gene Symbol: ILK
  Gene Name: integrin-linked kinase
  ENSP ID: ENSP00000487498

SEQ ID NO: 40922 - protein, 392 aa, Homo sapiens
  Payload ID: 8321
  Gene Symbol: ILKAP
  Gene Name: integrin-linked kinase-associated serine/threonine phosphatase
  Uniprot ID: Q9H0C8
  ENSP ID: ENSP00000254654
MDLFGDLPEPERSPRPAAGKEAQKGPLLFDDLPPASSTDSGSGGPLLFDDLPPASSGDSGSLATSISQMVKTEGKGAKRKTSEEEKNGSEELVEKKVCKASSVIFGLKGYVAERKGEREEMQDAHVILNDITEECRPPSSLITRVSYFAVFDGHGGIRASKFAAQNLHQNLIRKFPKGDVISVEKTVKRCLLDTFKHTDEEFLKQASSQKPAWKDGSTATCVLAVDNILYIANLGDSRAILCRYNEESQKHAALSLSKEHNPTQYEERMRIQKAGGNVRDGRVLGVLEVSRSIGDGQYKRCGVTSVPDIRRCQLTPNDRFILLACDGLFKVFTPEEAVNFILSCLEDEKIQTREGKSAADARYEAACNRLANKAVQRGSADNVTVMVVRIGH

SEQ ID NO: 40923 - protein, 212 aa, Homo sapiens
  Payload ID: 8321
  Gene Symbol: ILKAP
  Gene Name: integrin-linked kinase-associated serine/threonine phosphatase
  ENSP ID: ENSP00000395301
MDLFGDLPEPERSPRPAAGKEAQKGPLLFDDLPPASSTDSGSGGPLLFDDLPPASSGDSGSLATSISQMVKTEGKGAKRKTSEEEKNGSEELVEKKVSSSVIFGLKGYVAERKGEREEMQDAHVILNDITEECRPPSSLITRVSYFAVFDGHGGIRASKFAAQNLHQNLIRKFPKGDVISVEKTVKRCLLDTFKHTDEEFLKQASSQKPAWK

SEQ ID NO: 40924 - protein, 203 aa, Homo sapiens
  Payload ID: 8321
  Gene Symbol: ILKAP
  Gene Name: integrin-linked kinase-associated serine/threonine phosphatase
  ENSP ID: ENSP00000406254
EKTVKRCLLDTFKHTDEEFLKQASSQKPAWKDGSTATCVLAVDNILYIANLGDSRAILCRYNEESQKHAALSLSKEHNPTQYEERMRIQKAGGNVRDGRVLGVLEVSRSIGDGQYKRCGVTSVPDIRRCQLTPNDRFILLACDGLFKVFTPEEAVNFILSCLEVRNLTRGWWLSQLCLSFQRSRSSETPFPPIVGQPLCPFSV

SEQ ID NO: 40925 - protein, 162 aa, Homo sapiens
  Payload ID: 8321
  Gene Symbol: ILKAP
  Gene Name: integrin-linked kinase-associated serine/threonine phosphatase
  ENSP ID: ENSP00000477533
MDLFGDLPEPERSPRPAAGKEAQKGPLLFDDLPPASSTDSGSGGPLLFDDLPPASSGDSGSLATSISQMVKTEGKGAKRKTSEEEKNGSEELVEKKVCKASSVIFGLKGYVAERKGEREEMQDAHVILNDITEECRPPSSLMRCNQCRENREEMPFGHFQAY

SEQ ID NO: 40926 - protein, 274 aa, Homo sapiens
  Payload ID: 8321
  Gene Symbol: ILKAP
  Gene Name: integrin-linked kinase-associated serine/threonine phosphatase
  ENSP ID: ENSP00000477542
MDLFGDLPEPERSPRPAAGKEAQKGPLLFDDLPPASSTDSGSGGPLLFDDLPPASSGDSGDVISVEKTVKRCLLDTFKHTDEEFLKQASSQKPAWKDGSTATCVLAVDNILYIANLGDSRAILCRYNEESQKHAALSLSKEHNPTQYEERMRIQKAGGNVRDGRVLGVLEVSRSIGDGQYKRCGVTSVPDIRRCQLTPNDRFILLACDGLFKVFTPEEAVNFILSCLEDEKIQTREGKSAADARYEAACNRLANKAVQRGSADNVTVMVVRIGH

SEQ ID NO: 40927 - protein, 313 aa, Homo sapiens
  Payload ID: 8322
  Gene Symbol: ITLN1
  Gene Name: intelectin 1 (galactofuranose binding)
  Uniprot ID: Q8WWA0
  ENSP ID: ENSP00000323587
MNQLSFLLFLIATTRGWSTDEANTYFKEWTCSSSPSLPRSCKEIKDECPSAFDGLYFLRTENGVIYQTFCDMTSGGGGWTLVASVHENDMRGKCTVGDRWSSQQGSKAVYPEGDGNWANYNTFGSAEAATSDDYKNPGYYDIQAKDLGIWHVPNKSPMQHWRNSSLLRYRTDTGFLQTLGHNLFGIYQKYPVKYGEGKCWTDNGPVIPVVYDFGDAQKTASYYSPYGQREFTAGFVQFRVFNNERAANALCAGMRVTGCNTEHHCIGGGGYFPEASPQQCGDFSGFDWSGYGTHVGYSSSREITEAAVLLFYR

SEQ ID NO: 40928 - protein, 325 aa, Homo sapiens
  Payload ID: 8323
  Gene Symbol: ITLN2
  Gene Name: intelectin 2
  Uniprot ID: Q8WWU7
  ENSP ID: ENSP00000357008
MLSMLRTMTRLCFLLFFSVATSGCSAAAASSLEMLSREFETCAFSFSSLPRSCKEIKERCHSAGDGLYFLRTKNGVVYQTFCDMTSGGGGWTLVASVHENDMRGKCTVGDRWSSQQGNKADYPEGDGNWANYNTFGSAEAATSDDYKNPGYYDIQAKDLGIWHVPNKSPMQHWRNSALLRYRTNTGFLQRLGHNLFGIYQKYPVKYRSGKCWNDNGPAIPVVYDFGDAKKTASYYSPYGQREFVAGFVQFRVFNNERAANALCAGIKVTGCNTEHHCIGGGGFFPQGKPRQCGDFSAFDWDGYGTHVKSSCSREITEAAVLLFYR

SEQ ID NO: 40929 - protein, 437 aa, Homo sapiens
  Payload ID: 8324
  Gene Symbol: IPCEF1
  Gene Name: interaction protein for cytohesin exchange factors 1
  Uniprot ID: Q8WWN9
  ENSP ID: ENSP00000265198
MTSYMAIDGSALVPLRQKPRRKTQGFLTMSRRRISCKDLGHADCQGWLYKKKEKGSFLSNKWKKFWVILKGSSLYWYSNQMAEKADGFVNLPDFTVERASECKKKHAFKISHPQIKTFYFAAENVQEMNVWLNKLGSAVIHQESTTKDEECYSESEQEDPEIAAETPPPPHASQTQSLTAQQASSSSPSLSGTSYSFSSLENTVKTPSSFPSSLSKERQSLPDTVNSLSAAEDEGQPITFAVQVHSPVPSEAGIHKALENSFVTSESGFLNSLSSDDTSSLSSNHDHLTVPDKPAGSKIMDKEETKVSEDDEMEKLYKSLEQASLSPLGDRRPSTKKELRKSFVKRCKNPSINEKLHKIRTLNSTLKCKEHDLAMINQLLDDPKLTARKYREWKVMNTLLIQDIYQQQRASPAPDDTDDTPQELKKSPSSPSVENSI

SEQ ID NO: 40930 - protein, 438 aa, Homo sapiens
  Payload ID: 8324
  Gene Symbol: IPCEF1
  Gene Name: interaction protein for cytohesin exchange factors 1
  Uniprot ID: Q8WWN9
  ENSP ID: ENSP00000356189
MTSYMAIDGSALQVPLRQKPRRKTQGFLTMSRRRISCKDLGHADCQGWLYKKKEKGSFLSNKWKKFWVILKGSSLYWYSNQMAEKADGFVNLPDFTVERASECKKKHAFKISHPQIKTFYFAAENVQEMNVWLNKLGSAVIHQESTTKDEECYSESEQEDPEIAAETPPPPHASQTQSLTAQQASSSSPSLSGTSYSFSSLENTVKTPSSFPSSLSKERQSLPDTVNSLSAAEDEGQPITFAVQVHSPVPSEAGIHKALENSFVTSESGFLNSLSSDDTSSLSSNHDHLTVPDKPAGSKIMDKEETKVSEDDEMEKLYKSLEQASLSPLGDRRPSTKKELRKSFVKRCKNPSINEKLHKIRTLNSTLKCKEHDLAMINQLLDDPKLTARKYREWKVMNTLLIQDIYQQQRASPAPDDTDDTPQELKKSPSSPSVENSI

SEQ ID NO: 40931 - protein, 438 aa, Homo sapiens; identical to SEQ ID NO: 40930
  Payload ID: 8324
  Gene Symbol: IPCEF1
  Gene Name: interaction protein for cytohesin exchange factors 1
  Uniprot ID: Q8WWN9
  ENSP ID: ENSP00000394751

SEQ ID NO: 40932 - protein, 128 aa, Homo sapiens
  Payload ID: 8324
  Gene Symbol: IPCEF1
  Gene Name: interaction protein for cytohesin exchange factors 1
  ENSP ID: ENSP00000428767
MSRRRISCKDLGHADCQGWLYKKKEKGSFLSNKWKKFWVILKGSSLYWYSNQMAEKADGFVNLPDFTVERASECKKKHAFKISHPQIKTFYFAAENVQEMNVWLNKLGSAVIHQESTTKDEECYSESE

SEQ ID NO: 40933 - protein, 108 aa, Homo sapiens
  Payload ID: 8324
  Gene Symbol: IPCEF1
  Gene Name: interaction protein for cytohesin exchange factors 1
  ENSP ID: ENSP00000429972
MSRRRISCKDLGHADCQGWLYKKKEKGSFLSNKWKKFWVILKGSSLYWYSNQMAEKADGFVNLPDFTVERASECKKKHAFKISHPQIKTFYFAAENVQEMNVWLNKLG

SEQ ID NO: 40934 - protein, 409 aa, Homo sapiens
  Payload ID: 8324
  Gene Symbol: IPCEF1
  Gene Name: interaction protein for cytohesin exchange factors 1
  ENSP ID: ENSP00000430287
MSRRRISCKDLGHADCQGWLYKKKEKGSFLSNKWKKFWVILKGSSLYWYSNQMAEKADGFVNLPDFTVERASECKKKHAFKISHPQIKTFYFAAENVQEMNVWLNKLGSAVIHQESTTKDEECYSESEQEDPEIAAETPPPPHASQTQSLTAQQASSSSPSLSGTSYSFSSLENTVKTPSSFPSSLSKERQSLPDTVNSLSAAEDEGQPITFAVQVHSPVPSEAGIHKALENSFVTSESGFLNSLSSDDTSSLSSNHDHLTVPDKPAGSKIMDKEETKVSEDDEMEKLYKSLEQASLSPLGDRRPSTKKELRKSFVKRCKNPSINEKLHKIRTLNSTLKCKEHDLAMINQLLDDPKLTARKYREWKVMNTLLIQDIYQQQRASPAPDDTDDTPQELKKSPSSPSVENSI

SEQ ID NO: 40935 - protein, 78 aa, Homo sapiens
  Payload ID: 8324
  Gene Symbol: IPCEF1
  Gene Name: interaction protein for cytohesin exchange factors 1
  ENSP ID: ENSP00000431004
MTSYMAIDGSALVPLRQKPRRKTQGFLTMSRRRISCKDLGHADCQGWLYKKKEKGSFLSNKWKKFWVILKGSSLYWYS

SEQ ID NO: 40936 - protein, 157 aa, Homo sapiens
  Payload ID: 8324
  Gene Symbol: IPCEF1
  Gene Name: interaction protein for cytohesin exchange factors 1
  ENSP ID: ENSP00000431092
MSRRRISCKDLGHADCQGWLYKKKEKGSFLSNKWKKFWVILKGSSLYWYSNQMAEKADGFVNLPDFTVERASECKKKHAFKISHPQIKTFYFAAENVQEMNVWLNKLGSAVIHQESTTKDEECYSESEQEDPEIAAETPPPPHASQTQSLTAQQASS

SEQ ID NO: 40937 - protein, 2266 aa, Homo sapiens
  Payload ID: 8325
  Gene Symbol: ICE1
  Gene Name: interactor of little elongation complex ELL subunit 1
  Uniprot ID: Q9Y2F5
  ENSP ID: ENSP00000296564
MMPGETHSAAPGTAADLSRCQGCASLQQNLNEYVEALITLKQKIINTDNLLTEYQKKCDELQFARRENSNLHHQVEEMLQKISPLQKCQEELGSLKAELEEKKSSLKLYQDTHQEYARVKEECLKSDAQKKKLEAKVKKLQEAAVKQTQDFKQLRNEKKILEKEFKKTQERLDEFSKQKNEKELRHIGTQISSDSYGSIDKRKVKLLLKELWLCVNTTHRLPGEGSRCVPEKPAKAITSSRVPGEDGTLPPTQGSPLRTSNVQTCLTKLSMEIKEDFLCQNVEKQSSSGTNCSSDHVFNENGNLEVLVQSHRDGGSTEFVDHDHFFDEDLQAAIDFFKLPPPLLSPVPSPPPMSSPHPGSLPSSFAPETYFGEYTDSSDNDSVQLRNSAECVSEDDTTESQNYFGSLRKNKGSGTWEEKPKSHEAIQALNTWEVNKVTTSGLETFTATLRESSATHSLVGEKHWTTASRSMSDRKRDILHETKTQMEVREMDKSVQTEKTIHKLTRGLCIERLSASPAQEKEAAPGKSELCSSPLGKRPLNELMESEGKTVLSKMMGSPKSEFTKWTRINEITSEPDRITVSGHFHRLSRELEKEKEDTQGFTLGESPESEDDDSGDGMDVAGLDIETSFSSSSTLVALSVGSNPQSSSGLDCGNDTDITTKVFSTEPHHSEHKLQTKTLNTLHLQSEPPECSIGGNNLENSLCALSPELGASNFNDQKSSGIEYTKVVKGLTKIHSLPRSVFMKATKDGQCESQDPRIELTLNKPDFTSLIGSQAALIKSGLGFVKSTSWHHSDLLRKGGEESLRAKSEHEQKTSHQLQKAMPFLQNRGPTPKPDLLRENNNPVEFKTTASVLPNQVSVITKQTRPEKVQSAKLEHLRPHRVEPTLVTENSGNKTGMSTVAKCDGERDDTTQNITEVAAVKSISPEVSASRRKLDFNSPGGSSPVENSDCSTNSRLSFSPENILIQNQDIVREAAVQGDGQKQRQPQATDLDSSGTHGSEMLPATEVTVSGGFSVEETSCGDTGRSGGEALAVANDSTSTPQNANGLWKLKSTTPGGALPECFGTTDTTFSSAFCRKHGETQDTSQSSLPGTLHCYTGIREGGDDTEVESEAFSCSEGSEQQDAPDDSQKNLGDTDAAVAEVRPSLEVGYLTSALQDFNISTFSELDRLSTSEVVMFLESCQLGDYSSGDSVSECSSKGTLSKEMNKELKASEIGEKYRKQPCEEETLGTCEEWIESEEDDYSLKNTSQLTQCSLETLSEVLTKIRQELQTNSEDCNGKDTGSLLLLNVNNNMTTENLKEKSPFRETTGSSSHASEPTPQAAALDTEGSSPISGMPQNENPQSRPEARSDAGRQTDGGEEDLPEPVEPSALCSDSVMEPSIEQSSNCEAETTFQCQIATVTSEVINVLINKDQNLVIEKGDNWTIISGVAVLPHVDQVTLCDIPGDIPISQDQGELEAGCIPVTSAEKSPEASHTGPAFQEAPCGNNLSCPQEDVSSSGQSTNFDKSRLRNRPVKPSIWISSQIYDQNFETQIVASDHTYYNSKLEPSGKNKNRSKISNKDQSNKPVKTSASSRVETHQSEVAQSFSGEKANTKTQRSQTQTILANADTSTPTDCSPDTLSKIRQEVGPPLPPLLAPLIATPPRTSQPLSPLISSSSPSSPASPVGQVSPFRETPVPPAMSPWPEDPRRASPPDPSPSPSAASASERVVPSPLQFCAATPKHALPVPGRLPPCASGHAAVGGPQENSVKILDTMYPELSARARTLNILKGNIQLTRGPPADCKNLPGPASAMIGFKTITSAATAFVKTGSSSGGDCNQDKSRDLGTQQDSSGKRTLSTSTLRSAKRLRLDTGSPEPETRGVTAEGIHKNLPGNLPPAEVATTNEERSCSSPAVSAVSQLPLSPKETVESHDKAIANALKKIAEFSFDLLPVIRSHVYVGNISKKPVMRDQEKEVVYEFSTTKKHLAECLLHSILSELKIQKISMDHNYIHALCRVYVGICRQLGDLERARLFCYSLLKEDFPESEKLTLFIANMWHDIFLSQSVINKAMQLVARQRAKGEVLNCLRAFLNWEKNAPVDVGFMVSKLLLTIQLCPKTEFQPSEKFGEDLSDNTWEYIFAIDLLCCHQKWIWTHDNIISKELWPVMDKWIKYRKGHANIAYTPDIIIASILRLIGRLGQLGLKEGFPSAVKNISSVIGMFIQHAHDEDIPWGIQLAAVYALCDLSPSNPAEISKILEAWRREASKSVPSAIVSCLEEVSALSTEELG

SEQ ID NO: 40938 - protein, 145 aa, Homo sapiens
  Payload ID: 8325
  Gene Symbol: ICE1
  Gene Name: interactor of little elongation complex ELL subunit 1
  ENSP ID: ENSP00000485617
MLQKISPLQKCQEELGSLKAELEEKKSSLKLYQDTHQEYARVKEECLKSDAQKKKLEAKVKKLQEAAVKQTQDFKQLRNEKKILEKEFKKTQERLDEFSKQKNEKELRHIGTQISSDSYGSIDKRKVKLLLKELWLCVNTTHRLP

SEQ ID NO: 40939 - protein, 982 aa, Homo sapiens
  Payload ID: 8326
  Gene Symbol: ICE2
  Gene Name: interactor of little elongation complex ELL subunit 2
  Uniprot ID: Q659A1
  ENSP ID: ENSP00000261520
MSSKMVISEPGLNWDISPKNGLKTFFSRENYKDHSMAPSLKELRVLSNRRIGENLNASASSVENEPAVSSATQAKEKVKTTIGMVLLPKPRVPYPRFSRFSQREQRSYVDLLVKYAKIPANSKAVGINKNDYLQYLDMKKHVNEEVTEFLKFLQNSAKKCAQDYNMLSDDARLFTEKILRACIEQVKKYSEFYTLHEVTSLMGFFPFRVEMGLKLEKTLLALGSVKYVKTVFPSMPIKLQLSKDDIATIETSEQTAEAMHYDISKDPNAEKLVSRYHPQIALTSQSLFTLLNNHGPTYKEQWEIPVCIQVIPVAGSKPVKVIYINSPLPQKKMTMRERNQIFHEVPLKFMMSKNTSVPVSAVFMDKPEEFISEMDMSCEVNECRKIESLENLYLDFDDDVTELETFGVTTTKVSKSPSPASTSTVPNMTDAPTAPKAGTTTVAPSAPDISANSRSLSQILMEQLQKEKQLVTGMDGGPEECKNKDDQGFESCEKVSNSDKPLIQDSDLKTSDALQLENSQEIETSNKNDMTIDILHADGERPNVLENLDNSKEKTVGSEAAKTEDTVLCSSDTDEECLIIDTECKNNSDGKTAVVGSNLSSRPASPNSSSGQASVGNQTNTACSPEESCVLKKPIKRVYKKFDPVGEILKMQDELLKPISRKVPELPLMNLENSKQPSVSEQLSGPSDSSSWPKSGWPSAFQKPKGRLPYELQDYVEDTSEYLAPQEGNFVYKLFSLQDLLLLVRCSVQRIETRPRSKKRKKIRRQFPVYVLPKVEYQACYGVEALTESELCRLWTESLLHSNSSFYVGHIDAFTSKLFLLEEITSEELKEKLSALKISNLFNILQHILKKLSSLQEGSYLLSHAAEDSSLLIYKASDGKVTRTAYNLYKTHCGLPGVPSSLSVPWVPLDPSLLLPYHIHHGRIPCTFPPKSLDTTTQQKIGGTRMPTRSHRNPVSMETKSSCLPAQQVETEGVAPHKRKIT

SEQ ID NO: 40940 - protein, 94 aa, Homo sapiens
  Payload ID: 8326
  Gene Symbol: ICE2
  Gene Name: interactor of little elongation complex ELL subunit 2
  ENSP ID: ENSP00000452618
MSSKMVISEPGLNWDISPKNGLKTFFSRENYKDHSMAPSLKELRVLSNRRIGENLNASASSVENEPAVSSATQAKEKVKTTIGMVLLPKPRVPY

SEQ ID NO: 40941 - protein, 61 aa, Homo sapiens
  Payload ID: 8326
  Gene Symbol: ICE2
  Gene Name: interactor of little elongation complex ELL subunit 2
  ENSP ID: ENSP00000452713
MRDISPKNGLKTFFSRENYKDHSMAPSLKELRVLSNRESRGVMWTCWLNTQRFLQIPKLLE

SEQ ID NO: 40942 - protein, 338 aa, Homo sapiens
  Payload ID: 8326
  Gene Symbol: ICE2
  Gene Name: interactor of little elongation complex ELL subunit 2
  ENSP ID: ENSP00000452714
MSSKMVISEPGLNWDISPKNGLKTFFSRENYKDHSMAPSLKELRVLSNRRIGENLNASASSVENEPAVSSATQAKEKVKTTIGMVLLPKPRVPYPRFSRFSQREQRSYVDLLVKYAKIPANSKAVGINKNDYLQYLDMKKHVNEEVTEFLKFLQNSAKKCAQDYNMLSDDARLFTEKILRACIEQVKKYSEFYTLHEVTSLMGFFPFRVEMGLKLEKTLLALGSVKYVKTVFPSMPIKLQLSKDDIATIETSEQTAEAMHYDISKDPNAEKLVSRYHPQIALTSQSLFTLLNNHGPTYKEQWEIPVCIQVIPVAGSKPVKVIYINSPLPQKKMTMRER

SEQ ID NO: 40943 - protein, 145 aa, Homo sapiens
  Payload ID: 8326
  Gene Symbol: ICE2
  Gene Name: interactor of little elongation complex ELL subunit 2
  ENSP ID: ENSP00000453041
MSSKMVISEPGLNWDISPKNGLKTFFSRENYKDHSMAPSLKELRVLSNRRIGENLNASASSVENEPAVSSATQAKEKVKTTIGMVLLPKPRVPYPRFSRFSQREQRSYVDLLVKYAKIPANSKAVGINKNDYLQYLDMKKHVNEE

SEQ ID NO: 40944 - protein, 73 aa, Homo sapiens
  Payload ID: 8326
  Gene Symbol: ICE2
  Gene Name: interactor of little elongation complex ELL subunit 2
  Uniprot ID: Q659A1
  ENSP ID: ENSP00000453303
MSSKMVISEPGLNWDISPKNGLKTFFSRENYKDHSMAPSLKELRVLSNRESRGVMWTCWLNTQRFLQIPKLLE

SEQ ID NO: 40945 - protein, 73 aa, Homo sapiens; identical to SEQ ID NO: 40944
  Payload ID: 8326
  Gene Symbol: ICE2
  Gene Name: interactor of little elongation complex ELL subunit 2
  Uniprot ID: Q659A1
  ENSP ID: ENSP00000453593

SEQ ID NO: 40946 - protein, 99 aa, Homo sapiens
  Payload ID: 8326
  Gene Symbol: ICE2
  Gene Name: interactor of little elongation complex ELL subunit 2
  ENSP ID: ENSP00000453783
MSSKMVISEPGLNWDISPKNGLKTFFSRENYKDHSMAPSLKELRVLSNRRIGENLNASASSVENEPAVSSATQAKEKVKTTIGMVLLPKPRVPYPRFSR

SEQ ID NO: 40947 - protein, 51 aa, Homo sapiens
  Payload ID: 8326
  Gene Symbol: ICE2
  Gene Name: interactor of little elongation complex ELL subunit 2
  ENSP ID: ENSP00000453820
MSSKMVISEPGLNWDISPKNGLKTFFSRENYKDHSMAPSLKELRVLSNRKF

SEQ ID NO: 40948 - protein, 383 aa, Homo sapiens
  Payload ID: 8326
  Gene Symbol: ICE2
  Gene Name: interactor of little elongation complex ELL subunit 2
  ENSP ID: ENSP00000454162
MSSKMVISEPGLNWDISPKNGLKTFFSRENYKDHSMAPSLKELRVLSNRRIGENLNASASSVENEPAVSSATQAKEKVKTTIGMVLLPKPRVPYPRFSRFSQREQRSYVDLLVKYAKIPANSKAVGINKNDYLQYLDMKKHVNEEVTEFLKFLQNSAKKCAQDYNMLSDDARLFTEKILRACIEQVKKYSEFYTLHEVTSLMGFFPFRVEMGLKLEKTLLALGSVKYVKTVFPSMPIKLQLSKDDIATIETSEQTAEAMHYDISKDPNAEKLVSRYHPQIALTSQSLFTLLNNHGPTYKEQWEIPVCIQVIPVAGSKPVKVIYINSPLPQKKMTMRERNQIFHEVPLKFMMSKNTSVPVSAVFMDKPEEFISEMDVCNAFFFP

SEQ ID NO: 40949 - protein, 911 aa, Homo sapiens
  Payload ID: 8327
  Gene Symbol: ITIH1
  Gene Name: inter-alpha-trypsin inhibitor heavy chain 1
  Uniprot ID: P19827
  ENSP ID: ENSP00000273283
MDGAMGPRGLLLCMYLVSLLILQAMPALGSATGRSKSSEKRQAVDTAVDGVFIRSLKVNCKVTSRFAHYVVTSQVVNTANEAREVAFDLEIPKTAFISDFAVTADGNAFIGDIKDKVTAWKQYRKAAISGENAGLVRASGRTMEQFTIHLTVNPQSKVTFQLTYEEVLKRNHMQYEIVIKVKPKQLVHHFEIDVDIFEPQGISKLDAQASFLPKELAAQTIKKSFSGKKGHVLFRPTVSQQQSCPTCSTSLLNGHFKVTYDVSRDKICDLLVANNHFAHFFAPQNLTNMNKNVVFVIDISGSMRGQKVKQTKEALLKILGDMQPGDYFDLVLFGTRVQSWKGSLVQASEANLQAAQDFVRGFSLDEATNLNGGLLRGIEILNQVQESLPELSNHASILIMLTDGDPTEGVTDRSQILKNVRNAIRGRFPLYNLGFGHNVDFNFLEVMSMENNGRAQRIYEDHDATQQLQGFYSQVAKPLLVDVDLQYPQDAVLALTQNHHKQYYEGSEIVVAGRIADNKQSSFKADVQAHGEGQEFSITCLVDEEEMKKLLRERGHMLENHVERLWAYLTIQELLAKRMKVDREERANLSSQALQMSLDYGFVTPLTSMSIRGMADQDGLKPTIDKPSEDSPPLEMLGPRRTFVLSALQPSPTHSSSNTQRLPDRVTGVDTDPHFIIHVPQKEDTLCFNINEEPGVILSLVQDPNTGFSVNGQLIGNKARSPGQHDGTYFGRLGIANPATDFQLEVTPQNITLNPGFGGPVFSWRDQAVLRQDGVVVTINKKRNLVVSVDDGGTFEVVLHRVWKGSSVHQDFLGFYVLDSHRMSARTHGLLGQFFHPIGFEVSDIHPGSDPTKPDATMVVRNRRLTVTRGLQKDYSKDPWHGAEVSCWFIHNNGAGLIDGAYTDYIVPDIF

SEQ ID NO: 40950 - protein, 277 aa, Homo sapiens
  Payload ID: 8327
  Gene Symbol: ITIH1
  Gene Name: inter-alpha-trypsin inhibitor heavy chain 1
  ENSP ID: ENSP00000384589
MPLPLPSAFVLSALQPSPTHSSSNTQRLPDRVTGVDTDPHFIIHVPQKEDTLCFNINEEPGVILSLVQDPNTGFSVNGQLIGNKARSPGQHDGTYFGRLGIANPATDFQLEVTPQNITLNPGFGGPVFSWRDQAVLRQDGVVVTINKKRNLVVSVDDGGTFEVVLHRVWKGSSVHQDFLGFYVLDSHRMSARTHGLLGQFFHPIGFEVSDIHPGSDPTKPDATMVVRNRRLTVTRGLQKDYSKDPWHGAEVSCWFIHNNGAGLIDGAYTDYIVPDIF

SEQ ID NO: 40951 - protein, 464 aa, Homo sapiens
  Payload ID: 8327
  Gene Symbol: ITIH1
  Gene Name: inter-alpha-trypsin inhibitor heavy chain 1
  ENSP ID: ENSP00000395836
SMENNGRAQRIYEDHDATQQLQGFYSQVAKPLLVDVDLQYPQDAVLALTQNHHKQYYEGSEIVVAGRIADNKQSSFKADVQAHGEGQEFSITCLVDEEEMKKLLRERGHMLENHVERLWAYLTIQELLAKRMKVDREERANLSSQALQMSLDYGFVTPLTSMSIRGMADQDGLKPTIDKPSEGIGCREMLGPRRTFVLSALQPSPTHSSSNTQRLPDRVTGVDTDPHFIIHVPQKEDTLCFNINEEPGVILSLVQDPNTGFSVNGQLIGNKARSPGQHDGTYFGRLGIANPATDFQLEVTPQNITLNPGFGGPVFSWRDQAVLRQDGVVVTINKKRNLVVSVDDGGTFEVVLHRVWKGSSVHQDFLGFYVLDSHRMSARTHGLLGQFFHPIGFEVSDIHPGSDPTKPDATMVVRNRRLTVTRGLQKDYSKDPWHGAEVSCWFIHNNGAGLIDGAYTDYIVPDIF

SEQ ID NO: 40952 - protein, 213 aa, Homo sapiens
  Payload ID: 8327
  Gene Symbol: ITIH1
  Gene Name: inter-alpha-trypsin inhibitor heavy chain 1
  ENSP ID: ENSP00000417340
MDGAMGPRGLLLCMYLVSLLILQAMPALGSATGRSKSSEKRQAVDTAVDGVFIRSLKVNCKVTSRFAHYVVTSQVVNTANEAREVAFDLEIPKTAFISDFAVTADGNAFIGDIKDKVTAWKQYRKAAISGENAGLVRASGRTMEQFTIHLTVNPQSKVTFQLTYEEVLKRNHMQYEIVIKVKPKQLVHHFEVDHRSRGRGPAPLSVTMAPNTG

SEQ ID NO: 40953 - protein, 74 aa, Homo sapiens
  Payload ID: 8327
  Gene Symbol: ITIH1
  Gene Name: inter-alpha-trypsin inhibitor heavy chain 1
  ENSP ID: ENSP00000419957
  MOD_RES (1)..(1): Any amino acid
XMKVDREERANLSSQALQMSLDYGFVTPLTSMSIRGMADQDGLKPTIDKPSEDSPPLEMLGPRRTPIPSGCQTE

SEQ ID NO: 40954 - protein, 623 aa, Homo sapiens
  Payload ID: 8327
  Gene Symbol: ITIH1
  Gene Name: inter-alpha-trypsin inhibitor heavy chain 1
  Uniprot ID: P19827
  ENSP ID: ENSP00000443847
MNKNVVFVIDISGSMRGQKVKQTKEALLKILGDMQPGDYFDLVLFGTRVQSWKGSLVQASEANLQAAQDFVRGFSLDEATNLNGGLLRGIEILNQVQESLPELSNHASILIMLTDGDPTEGVTDRSQILKNVRNAIRGRFPLYNLGFGHNVDFNFLEVMSMENNGRAQRIYEDHDATQQLQGFYSQVAKPLLVDVDLQYPQDAVLALTQNHHKQYYEGSEIVVAGRIADNKQSSFKADVQAHGEGQEFSITCLVDEEEMKKLLRERGHMLENHVERLWAYLTIQELLAKRMKVDREERANLSSQALQMSLDYGFVTPLTSMSIRGMADQDGLKPTIDKPSEDSPPLEMLGPRRTFVLSALQPSPTHSSSNTQRLPDRVTGVDTDPHFIIHVPQKEDTLCFNINEEPGVILSLVQDPNTGFSVNGQLIGNKARSPGQHDGTYFGRLGIANPATDFQLEVTPQNITLNPGFGGPVFSWRDQAVLRQDGVVVTINKKRNLVVSVDDGGTFEVVLHRVWKGSSVHQDFLGFYVLDSHRMSARTHGLLGQFFHPIGFEVSDIHPGSDPTKPDATMVVRNRRLTVTRGLQKDYSKDPWHGAEVSCWFIHNNGAGLIDGAYTDYIVPDIF

SEQ ID NO: 40955 - protein, 946 aa, Homo sapiens
  Payload ID: 8328
  Gene Symbol: ITIH2
  Gene Name: inter-alpha-trypsin inhibitor heavy chain 2
  Uniprot ID: P19823
  ENSP ID: ENSP00000351190
MKRLTCFFICFFLSEVSGFEIPINGLSEFVDYEDLVELAPGKFQLVAENRRYQRSLPGESEEMMEEVDQVTLYSYKVQSTITSRMATTMIQSKVVNNSPQPQNVVFDVQIPKGAFISNFSMTVDGKTFRSSIKEKTVGRALYAQARAKGKTAGLVRSSALDMENFRTEVNVLPGAKVQFELHYQEVKWRKLGSYEHRIYLQPGRLAKHLEVDVWVIEPQGLRFLHVPDTFEGHFDGVPVISKGQQKAHVSFKPTVAQQRICPNCRETAVDGELVVLYDVKREEKAGELEVFNGYFVHFFAPDNLDPIPKNILFVIDVSGSMWGVKMKQTVEAMKTILDDLRAEDHFSVIDFNQNIRTWRNDLISATKTQVADAKRYIEKIQPSGGTNINEALLRAIFILNEANNLGLLDPNSVSLIILVSDGDPTVGELKLSKIQKNVKENIQDNISLFSLGMGFDVDYDFLKRLSNENHGIAQRIYGNQDTSSQLKKFYNQVSTPLLRNVQFNYPHTSVTDVTQNNFHNYFGGSEIVVAGKFDPAKLDQIESVITATSANTQLVLETLAQMDDLQDFLSKDKHADPDFTRKLWAYLTINQLLAERSLAPTAAAKRRITRSILQMSLDHHIVTPLTSLVIENEAGDERMLADAPPQDPSCCSGALYYGSKVVPDSTPSWANPSPTPVISMLAQGSQVLESTPPPHVMRVENDPHFIIYLPKSQKNICFNIDSEPGKILNLVSDPESGIVVNGQLVGAKKPNNGKLSTYFGKLGFYFQSEDIKIEISTETITLSHGSSTFSLSWSDTAQVTNQRVQISVKKEKVVTITLDKEMSFSVLLHRVWKKHPVNVDFLGIYIPPTNKFSPKAHGLIGQFMQEPKIHIFNERPGKDPEKPEASMEVKGQKLIITRGLQKDYRTDLVFGTDVTCWFVHNSGKGFIDGHYKDYFVPQLYSFLKRP

SEQ ID NO: 40956 - protein, 935 aa, Homo sapiens
  Payload ID: 8328
  Gene Symbol: ITIH2
  Gene Name: inter-alpha-trypsin inhibitor heavy chain 2
  ENSP ID: ENSP00000368906
MKRLTCFFICFFLSEVSGFEIPINGLSEFVDYEDLVELAPGKFQLVAENRRYQEEVDQVTLYSYKVQSTITSRMATTMIQSKVVNNSPQPQNVVFDVQIPKGAFISNFSMTVDGKTFRSSIKEKTVGRALYAQARAKGKTAGLVRSSALDMENFRTEVNVLPGAKVQFELHYQEVKWRKLGSYEHRIYLQPGRLAKHLEVDVWVIEPQGLRFLHVPDTFEGHFDGVPVISKGQQKAHVSFKPTVAQQRICPNCRETAVDGELVVLYDVKREEKAGELEVFNGYFVHFFAPDNLDPIPKNILFVIDVSGSMWGVKMKQTVEAMKTILDDLRAEDHFSVIDFNQNIRTWRNDLISATKTQVADAKRYIEKIQPSGGTNINEALLRAIFILNEANNLGLLDPNSVSLIILVSDGDPTVGELKLSKIQKNVKENIQDNISLFSLGMGFDVDYDFLKRLSNENHGIAQRIYGNQDTSSQLKKFYNQVSTPLLRNVQFNYPHTSVTDVTQNNFHNYFGGSEIVVAGKFDPAKLDQIESVITATSANTQLVLETLAQMDDLQDFLSKDKHADPDFTRKLWAYLTINQLLAERSLAPTAAAKRRITRSILQMSLDHHIVTPLTSLVIENEAGDERMLADAPPQDPSCCSGALYYGSKVVPDSTPSWANPSPTPVISMLAQGSQVLESTPPPHVMRVENDPHFIIYLPKSQKNICFNIDSEPGKILNLVSDPESGIVVNGQLVGAKKPNNGKLSTYFGKLGFYFQSEDIKIEISTETITLSHGSSTFSLSWSDTAQVTNQRVQISVKKEKVVTITLDKEMSFSVLLHRVWKKHPVNVDFLGIYIPPTNKFSPKAHGLIGQFMQEPKIHIFNERPGKDPEKPEASMEVKGQKLIITRGLQKDYRTDLVFGTDVTCWFVHNSGKGFIDGHYKDYFVPQLYSFLKRP

SEQ ID NO: 40957 - protein, 237 aa, Homo sapiens
  Payload ID: 8328
  Gene Symbol: ITIH2
  Gene Name: inter-alpha-trypsin inhibitor heavy chain 2
  ENSP ID: ENSP00000388826
MKRLTCFFICFFLSEVSGFEIPINGLSERSLPGESEEMMEEVDQVTLYSYKVQSTITSRMATTMIQSKVVNNSPQPQNVVFDVQIPKGAFISNFSMTVDGKTFRSSIKEKTVGRALYAQARAKGKTAGLVRSSALDMENFRTEVNVLPGAKVQFELHYQEVKWRKLGSYEHRIYLQPGRLAKHLEVDVWVIEPQGLRFLHVPDTFEGHFDGVPVISKGQQKAHVSFKPTVAQQRICP

SEQ ID NO: 40958 - protein, 945 aa, Homo sapiens
  Payload ID: 8328
  Gene Symbol: ITIH2
  Gene Name: inter-alpha-trypsin inhibitor heavy chain 2
  ENSP ID: ENSP00000477794
MKRLTCFFICFFLSEVSGFEIPINGLSEFVDYEDLVELAPGKFQLVAENRRYQRSLPGESEEMMEEVDQVTLYSYKVQSTITSRMATTMIQSKVVNNSPQPQNVVFDVQIPKGAFISNFSMTVDGKTFRSSIKEKTVGRALYAQARAKGKTAGLVRSSALDMENFRTEVNVLPGAKVQFELHYQEVKWRKLGSYEHRIYLQPGRLAKHLEVDVWVIEPQGLRFLHVPDTFEGHFDGVPVISKGQQKAHVSFKPTVAQQRICPNCRETAVDGELVVLYDVKREEKAGELEVFNGYFVHFFAPDNLDPIPKNILFVIDVSGSMWGVKMKQTVEAMKTILDDLRAEDHFSVIDFNQNIRTWRNDLFQLQKHRLQMPRYIEKIQPSGGTNINEALLRAIFILNEANNLGLLDPNSVSLIILVSDGDPTVGELKLSKIQKNVKENIQDNISLFSLGMGFDVDYDFLKRLSNENHGIAQRIYGNQDTSSQLKKFYNQVSTPLLRNVQFNYPHTSVTDVTQNNFHNYFGGSEIVVAGKFDPAKLDQIESVITATSANTQLVLETLAQMDDLQDFLSKDKHADPDFTRKLWAYLTINQLLAERSLAPTAAAKRRITRSILQMSLDHHIVTPLTSLVIENEAGDERMLADAPPQDPSCCSGALYYGSKVVPDSTPSWANPSPTPVISMLAQGSQVLESTPPPHVMRVENDPHFIIYLPKSQKNICFNIDSEPGKILNLVSDPESGIVVNGQLVGAKKPNNGKLSTYFGKLGFYFQSEDIKIEISTETITLSHGSSTFSLSWSDTAQVTNQRVQISVKKEKVVTITLDKEMSFSVLLHRVWKKHPVNVDFLGIYIPPTNKFSPKAHGLIGQFMQEPKIHIFNERPGKDPEKPEASMEVKGQKLIITRGLQKDYRTDLVFGTDVTCWFVHNSGKGFIDGHYKDYFVPQLYSFLKRP

SEQ ID NO: 40959 - protein, 698 aa, Homo sapiens
  Payload ID: 8329
  Gene Symbol: ITIH3
  Gene Name: inter-alpha-trypsin inhibitor heavy chain 3
  ENSP ID: ENSP00000413922
MAFAWWPCLILALLSSLAASGFPRSPFRLLGKRSLPEGVANGIEVYSTKINSKVTSRFAHNVVTMRAVNRADTAKEVSFDVELPKTAFITNFTLTIDGVTYPGNVKEKEVAKKQYEKAVSQGKTAGLVKASGRKLEKFTVSVNVAAGSKVTFELTYEELLKRHKGKYEMYLKVQPKQLVKHFEIEVDIFEPQGISMLDAEASFITNDLLGSALTKSFSGKKGHVSFKPSLDQQRSCPTCTDSLLNGDFTITYDVNRESPGNVQIVNGYFVHFFAPQGLPVVPKNVAFVIDISGSMAGRKLEQTKEALLRILEDMQEEDYLNFILFSGDVSTWKEHLVQATPENLQEARTFVKSMEDKGMTNINDGLLRGISMLNKAREEHRIPERSTSIVIMLTDGDANVGESRPEKIQENVRNAIGGKFPLYNLGFGNNLNYNFLENMALENHGFARRIYEDSDADLQLQGFYEEVANPLLTGVEMEYPENAILDLTQNTYQHFYDGSEIVVAGRLVDEDMNSFKADVKGHGATNDLTFTEEVTTEKITLWNRAVPSTFSWLDTVTVTQDGLSMMINRKNMVVSFGDGVTFVVVLHQVWKKHPVHRDFLGFYVVDSHRMSAQTHGLLGQFFQPFDFKVSDIRPGSDPTKPDATLVVKNHQLIVTRGSQKDYRKDASIGTKVVCWFVHNNGEGLIDGVHTDYIVPNLF

SEQ ID NO: 40960 - protein, 890 aa, Homo sapiens
  Payload ID: 8329
  Gene Symbol: ITIH3
  Gene Name: inter-alpha-trypsin inhibitor heavy chain 3
  Uniprot ID: Q06033
  ENSP ID: ENSP00000415769
MAFAWWPCLILALLSSLAASGFPRSPFRLLGKRSLPEGVANGIEVYSTKINSKVTSRFAHNVVTMRAVNRADTAKEVSFDVELPKTAFITNFTLTIDGVTYPGNVKEKEVAKKQYEKAVSQGKTAGLVKASGRKLEKFTVSVNVAAGSKVTFELTYEELLKRHKGKYEMYLKVQPKQLVKHFEIEVDIFEPQGISMLDAEASFITNDLLGSALTKSFSGKKGHVSFKPSLDQQRSCPTCTDSLLNGDFTITYDVNRESPGNVQIVNGYFVHFFAPQGLPVVPKNVAFVIDISGSMAGRKLEQTKEALLRILEDMQEEDYLNFILFSGDVSTWKEHLVQATPENLQEARTFVKSMEDKGMTNINDGLLRGISMLNKAREEHRIPERSTSIVIMLTDGDANVGESRPEKIQENVRNAIGGKFPLYNLGFGNNLNYNFLENMALENHGFARRIYEDSDADLQLQGFYEEVANPLLTGVEMEYPENAILDLTQNTYQHFYDGSEIVVAGRLVDEDMNSFKADVKGHGATNDLTFTEEVDMKEMEKALQERDYIFGNYIERLWAYLTIEQLLEKRKNAHGEEKENLTARALDLSLKYHFVTPLTSMVVTKPEDNEDERAIADKPGEDAEATPVSPAMSYLTSYQPPQNPYYYVDGDPHFIIQIPEKDDALCFNIDEAPGTVLRLIQDAVTGLTVNGQITGDKRGSPDSKTRKTYFGKLGIANAQMDFQVEVTTEKITLWNRAVPSTFSWLDTVTVTQDGLSMMINRKNMVVSFGDGVTFVVVLHQVWKKHPVHRDFLGFYVVDSHRMSAQTHGLLGQFFQPFDFKVSDIRPGSDPTKPDATLVVKNHQLIVTRGSQKDYRKDASIGTKVVCWFVHNNGEGLIDGVHTDYIVPNLF

SEQ ID NO: 40961 - protein, 670 aa, Homo sapiens [sequence omitted]

SEQ ID NO: 40962 - protein, 930 aa, Homo sapiens
  Payload ID: 8330
  Gene Symbol: ITIH4
  Gene Name: inter-alpha-trypsin inhibitor heavy chain family, member 4
  Uniprot ID: Q14624
  ENSP ID: ENSP00000266041
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSGSTFFKYYLQGAKIPKPEASFSPRRGWNRQAGAAGSRMNFRPGVLSSRQLGLPGPPDVPDHAAYHPFRRLAILPASAPPATSNPDPAVSRVMNMKIEETTMTTQTPAPIQAPSAILPLPGQSVERLCVDPRHRQGPVNLLSDPEQGVEVTGQYEREKAGFSWIEVTFKNPLVWVHASPEHVVVTRNRRSSAYKWKETLFSVMPGLKMTMDKTGLLLLSDPDKVTIGLLFWDGRGEGLRLLLRDTDRFSSHVGGTLGQFYQEVLWGSPAASDDGRRTLRVQGNDHSATRERRLDYQEGPPGVEISCWSVEL

SEQ ID NO: 40963 - protein, 900 aa, Homo sapiens
  Payload ID: 8330
  Gene Symbol: ITIH4
  Gene Name: inter-alpha-trypsin inhibitor heavy chain family, member 4
  Uniprot ID: Q14624
  ENSP ID: ENSP00000384425
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSAGAAGSRMNFRPGVLSSRQLGLPGPPDVPDHAAYHPFRRLAILPASAPPATSNPDPAVSRVMNMKIEETTMTTQTPAPIQAPSAILPLPGQSVERLCVDPRHRQGPVNLLSDPEQGVEVTGQYEREKAGFSWIEVTFKNPLVWVHASPEHVVVTRNRRSSAYKWKETLFSVMPGLKMTMDKTGLLLLSDPDKVTIGLLFWDGRGEGLRLLLRDTDRFSSHVGGTLGQFYQEVLWGSPAASDDGRRTLRVQGNDHSATRERRLDYQEGPPGVEISCWSVEL

SEQ ID NO: 40964 - protein, 719 aa, Homo sapiens
  Payload ID: 8330
  Gene Symbol: ITIH4
  Gene Name: inter-alpha-trypsin inhibitor heavy chain family, member 4
  ENSP ID: ENSP00000395634
  MOD_RES (1)..(1): Any amino acid
XVSVAPNAKITFELVYEELLKRRLGVYELLLKVRPQQLVKHLQMDIHIFEPQGISFLETESTFMTNQLVDALTTWQNKTKQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSAGAAGSRMNFRPGVLSSRQLGLPGPPDVPDHAAYHPFRRLAILPASAPPATSNPDPAVSRVMNMKIEETTMTTQTPGVEVTGQYEREKAGFSWIEVTFKNPLVWVHASPEHVVVTRNRRSSAYKWKETLFSVMPGLKMTMDKTGLLLLSDPDKVTIGLLFWDGRGEGLRLLLRDTDRFSSHVGGTLGQFYQEVLWGSPAASDDGRRTLRVQGNDHSATRERRLDYQEGPPGVEISCWSVEL

SEQ ID NO: 40965 - protein, 935 aa, Homo sapiens
  Payload ID: 8330
  Gene Symbol: ITIH4
  Gene Name: inter-alpha-trypsin inhibitor heavy chain family, member 4
  ENSP ID: ENSP00000417824
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSGSTFFKYYLQGAKIPKPGLDHTEASFSPRRGWNRQAGAAGSRMNFRPGVLSSRQLGLPGPPDVPDHAAYHPFRRLAILPASAPPATSNPDPAVSRVMNMKIEETTMTTQTPAPIQAPSAILPLPGQSVERLCVDPRHRQGPVNLLSDPEQGVEVTGQYEREKAGFSWIEVTFKNPLVWVHASPEHVVVTRNRRSSAYKWKETLFSVMPGLKMTMDKTGLLLLSDPDKVTIGLLFWDGRGEGLRLLLRDTDRFSSHVGGTLGQFYQEVLWGSPAASDDGRRTLRVQGNDHSATRERRLDYQEGPPGVEISCWSVEL

SEQ ID NO: 40966 - protein, 702 aa, Homo sapiens
  Payload ID: 8331
  Gene Symbol: ITIH5
  Gene Name: inter-alpha-trypsin inhibitor heavy chain family, member 5
  ENSP ID: ENSP00000380332
MLLLLGLCLGLSLCVGSQEEAQSWGHSSEQDGLRVPRQVRLLQRLKTKPLMTEFSVKSTIISRYAFTTVSCRMLNRASEDQDIEFQMQIPAAAFITNFTMLIGDKVYQGEITEREKKSGDRVKEKRNKTTEENGEKGTEIFRASAVIPSKDKAAFFLSYEELLQRRLGKYEHSISVRPQQLSGRLSVDVNILESAGIASLEVLPLHNSRQRGSGRGEDDSGPPPSTVINQNETFANIIFKPTVVQQARIAQNGILGDFIIRYDVNREQSIGDIQVLNGYFVHYFAPKDLPPLPKNVVFVLDSSASMVGTKLRQTKDALFTILHDLRPQDRFSIIGFSNRIKVWKDHLISVTPDSIRDGKVYIHHMSPTGGTDINGALQRAIRLLNKYVAHSGIGDRSVSLIVFLTDGKPTVGETHTLKILNNTREAARGQVCIFTIGIGNDVDFRLLEKLSLENCGLTRRVHEEEDAGSQLIGFYDEIRTPLLSDIRIDYPPSSVVQATKTLFPNYFNGSEIIIAGKLVDRKLDHLHVEVTASNSKKFIILKTDVPVRPQKAGKDVTGSPRPGGDGEGDTNHIERLWSYLTTKELLSSWLQSDDEPEKERLRQRAQALAVSYRFLTPFTSMKLRGPVPRMDGLEEAHGMSAAMGPEPVVQSVRGAGTQPGPLLKKPYQPRIKISKTSVRGFRREEQIFSNVMKFPFASILEL

SEQ ID NO: 40967 - protein, 942 aa, Homo sapiens
  Payload ID: 8331
  Gene Symbol: ITIH5
  Gene Name: inter-alpha-trypsin inhibitor heavy chain family, member 5
  ENSP ID: ENSP00000380333
MLLLLGLCLGLSLCVGSQEEAQSWGHSSEQDGLRVPRQVRLLQRLKTKPLMTEFSVKSTIISRYAFTTVSCRMLNRASEDQDIEFQMQIPAAAFITNFTMLIGDKVYQGEITEREKKSGDRVKEKRNKTTEENGEKGTEIFRASAVIPSKDKAAFFLSYEELLQRRLGKYEHSISVRPQQLSGRLSVDVNILESAGIASLEVLPLHNSRQRGSGRGEDDSGPPPSTVINQNETFANIIFKPTVVQQARIAQNGILGDFIIRYDVNREQSIGDIQVLNGYFVHYFAPKDLPPLPKNVVFVLDSSASMVGTKLRQTKDALFTILHDLRPQDRFSIIGFSNRIKVWKDHLISVTPDSIRDGKVYIHHMSPTGGTDINGALQRAIRLLNKYVAHSGIGDRSVSLIVFLTDGKPTVGETHTLKILNNTREAARGQVCIFTIGIGNDVDFRLLEKLSLENCGLTRRVHEEEDAGSQLIGFYDEIRTPLLSDIRIDYPPSSVVQATKTLFPNYFNGSEIIIAGKLVDRKLDHLHVEVTASNSKKFIILKTDVPVRPQKAGKDVTGSPRPGGDGEGDTNHIERLWSYLTTKELLSSWLQSDDEPEKERLRQRAQALAVSYRFLTPFTSMKLRGPVPRMDGLEEAHGMSAAMGPEPVVQSVRGAGTQPGPLLKKPYQPRIKISKTSVDGDPHFVVDFPLSRLTVCFNIDGQPGDILRLVSDHRDSGVTVNGELIGAPAPPNGHKKQRTYLRTITILINKPERSYLEITPSRVILDGGDRLVLPCNQSVVVGSWGLEVSVSANANVTVTIQGSIAFVILIHLYKKPAPFQRHHLGFYIANSEGLSSNCHGLLGQFLNQDARLTEDPAGPSQNLTHPLLLQVGEGPEAVLTVKGHQVPVVWKQRKIYNGEEQIDCWFARNNAAKLIDGEYKDYLASHPFDTGMTLGRGMSREL

SEQ ID NO: 40968 - protein, 119 aa, Homo sapiens
  Payload ID: 8331
  Gene Symbol: ITIH5
  Gene Name: inter-alpha-trypsin inhibitor heavy chain family, member 5
  ENSP ID: ENSP00000419386
  MOD_RES (1)..(1): Any amino acid
XPSTVINQNETFANIIFKPTVVQQARIAQNGILGDFIIRYDVNREQSIGDIQVLNGYFVHYFAPKDLPPLPKNVVFVLDSSASMVGTKLRQDIGFSLAVQNWVPKGYLDISCVTLQVHV

SEQ ID NO: 40969 - protein, 728 aa, Homo sapiens
  Payload ID: 8331
  Gene Symbol: ITIH5
  Gene Name: inter-alpha-trypsin inhibitor heavy chain family, member 5
  ENSP ID: ENSP00000485414
MRNYDSGPPPSTVINQNETFANIIFKPTVVQQARIAQNGILGDFIIRYDVNREQSIGDIQVLNGYFVHYFAPKDLPPLPKNVVFVLDSSASMVGTKLRQTKDALFTILHDLRPQDRFSIIGFSNRIKVWKDHLISVTPDSIRDGKVYIHHMSPTGGTDINGALQRAIRLLNKYVAHSGIGDRSVSLIVFLTDGKPTVGETHTLKILNNTREAARGQVCIFTIGIGNDVDFRLLEKLSLENCGLTRRVHEEEDAGSQLIGFYDEIRTPLLSDIRIDYPPSSVVQATKTLFPNYFNGSEIIIAGKLVDRKLDHLHVEVTASNSKKFIILKTDVPVRPQKAGKDVTGSPRPGGDGEGDTNHIERLWSYLTTKELLSSWLQSDDEPEKERLRQRAQALAVSYRFLTPFTSMKLRGPVPRMDGLEEAHGMSAAMGPEPVVQSVRGAGTQPGPLLKKPYQPRIKISKTSVDGDPHFVVDFPLSRLTVCFNIDGQPGDILRLVSDHRDSGVTVNGELIGAPAPPNGHKKQRTYLRTITILINKPERSYLEITPSRVILDGGDRLVLPCNQSVVVGSWGLEVSVSANANVTVTIQGSIAFVILIHLYKKPAPFQRHHLGFYIANSEGLSSNCHGLLGQFLNQDARLTEDPAGPSQNLTHPLLLQVGEGPEAVLTVKGHQVPVVWKQRKIYNGEEQIDCWFARNNAAKLIDGEYKDYLASHPFDTGMTLGRGMSREL

SEQ ID NO: 40970 - protein, 1313 aa, Homo sapiens
  Payload ID: 8332
  Gene Symbol: ITIH6
  Gene Name: inter-alpha-trypsin inhibitor heavy chain family, member 6
  Uniprot ID: Q6UXX5
  ENSP ID: ENSP00000218436
MSGWRYLICVSFLLTILLELTYQGPPVPASSSTKLLMTSYSMRSTVVSRYAHTLVTSVLFNPHAEAHEAIFDLDLPHLAFISNFTMTINNKVYIAEVKEKHQAKKIYEEAHQQGKTAAHVGIRDRESEKFRISTSLAAGTEVTFSLAYEELLQRHQGQYQLVVSLRPGQLVKRLSIEVTVSERTGISYVHIPPLRTGRLRTNAHASEVDSPPSTRIERGETCVRITYCPTLQDQSSISGSGIMADFLVQYDVVMEDIIGDVQIYDDYFIHYFAPRGLPPMEKNVVFVIDVSSSMFGTKMEQTKTAMNVILSDLQANDYFNIISFSDTVNVWKAGGSIQATIQNVHSAKDYLHCMEADGWTDVNSALLAAASVLNHSNQEPGRGPSVGRIPLIIFLTDGEPTAGVTTPSVILSNVRQALGHRVSLFSLAFGDDADFTLLRRLSLENRGIARRIYEDTDAALQLKGLYEEISMPLLADVRLNYLGGLVGASPWAVFPNYFGGSELVVAGQVQPGKQELGIHLAARGPKDQLLVAHHSEGATNNSQKAFGCPGEPAPNVAHFIRRLWAYVTIGELLDAHFQARDTTTRHLLAAKVLNLSLEYNFVTPLTSLVMVQPKQASEETRRQTSTSAGPDTIMPSSSSRHGLGVSTAQPALVPKVISPKSRPVKPKFYLSSTTTASTKKMLSSKELEPLGESPHTLSMPTYPKAKIPAQQDSGTLAQPTLRTKPTILVPSNSGTLLPLKPGSLSHQNPDILPTNSRTQVPPVKPGIPASPKADTVKCVTPLHSKPGAPSHPQLGALTSQAPKGLPQSRPGVSTLQVPKYPLHTRPRVPAPKTRNNMPHLGPGILLSKTPKILLSLKPSAPPHQISTSISLSKPETPNPHMPQTPLPPRPDRPRPPLPESLSTFPNTISSSTGPSSTTTTSVLGEPLPMPFTPTLPPGRFWHQYDLLPGPQRTRQVLGPSRPGVPTMSLLNSSRPTPEGSPPNLPILLPSSILPEAISLLLLPEELELLSESMVESKFVESLNPPAFYTFLTPDEDGSPNWDGNSEEILGGAGGSMESQGSSVGLAKGTLPSIFTFSSSVDGDPHFVIQIPHSEEKICFTLNGHPGDLLQLIEDPKAGLHVSGKLLGAPPRPGHKDQTRTYFQIITVTTDKPRAYTITISRSSISLRGEGTLRLSWDQPALLKRPQLELYVAAAARLTLRLGPYLEFLVLRHRYRHPSTLQLPHLGFYVANGSGLSPSARGLIGQFQHADIRLVTGPMGPCLRRHHGPDVPVILGKRLLKDSPRLLPRWASCWLVKRSHVELLLGHPYLSYVL

SEQ ID NO: 40971 - protein, 532 aa, Homo sapiens
  Payload ID: 8333
  Gene Symbol: ICAM1
  Gene Name: intercellular adhesion molecule 1
  Uniprot ID: P05362
  ENSP ID: ENSP00000264832
MAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTRKVTVNVLSPRYEIVIITVVAAAVIMGTAGLSTYLYNRQRKIKKYRLQQAQKGTPMKPNTQATPP

SEQ ID NO: 40972 - protein, 310 aa, Homo sapiens
  Payload ID: 8333
  Gene Symbol: ICAM1
  Gene Name: intercellular adhesion molecule 1
  ENSP ID: ENSP00000413124
MAPSSPRPALPALLVLLGALFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTRKVTVNVLSPRYEIVIITVVAAAVIMGTAGLSTYLYNRQRKIKKYRLQQAQKGTPMKPNTQATPP

SEQ ID NO: 40973 - protein, 180 aa, Homo sapiens
  Payload ID: 8333
  Gene Symbol: ICAM1
  Gene Name: intercellular adhesion molecule 1
  ENSP ID: ENSP00000465680
MAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVEGGAPRANLTVVLLRGEKELKREPAVGEPAEVTTTVLVRRDHHGANFSCRTELDLRPQGLELFE

SEQ ID NO: 40974 - protein, 275 aa, Homo sapiens
  Payload ID: 8334
  Gene Symbol: ICAM2
  Gene Name: intercellular adhesion molecule 2
  Uniprot ID: P13598
  ENSP ID: ENSP00000388666
MSSFGYRTLTVALFTLICCPGSDEKVFEVHVRPKKLAVEPKGSLEVNCSTTCNQPEVGGLETSLDKILLDEQAQWKHYLVSNISHDTVLQCHFTCSGKQESMNSNVSVYQPPRQVILTLQPTLVAVGKSFTIECRVPTVEPLDSLTLFLFRGNETLHYETFGKAAPAPQEATATFNSTADREDGHRNFSCLAVLDLMSRGGNIFHKHSAPKMLEIYEPVSDSQMVIIVTVVSVLLSLFVTSVLLCFIFGQHLRQQRMGTYGVRAAWRRLPQAFRP

SEQ ID NO: 40975 - protein, 275 aa, Homo sapiens; identical to SEQ ID NO: 40974
  Payload ID: 8334
  Gene Symbol: ICAM2
  Gene Name: intercellular adhesion molecule 2
  Uniprot ID: P13598
  ENSP ID: ENSP00000392634

SEQ ID NO: 40976 - protein, 275 aa, Homo sapiens; identical to SEQ ID NO: 40974
  Payload ID: 8334
  Gene Symbol: ICAM2
  Gene Name: intercellular adhesion molecule 2
  Uniprot ID: P13598
  ENSP ID: ENSP00000415283

SEQ ID NO: 40977 - protein, 275 aa, Homo sapiens; identical to SEQ ID NO: 40974
  Payload ID: 8334
  Gene Symbol: ICAM2
  Gene Name: intercellular adhesion molecule 2
  Uniprot ID: P13598
  ENSP ID: ENSP00000462579

SEQ ID NO: 40978 - protein, 53 aa, Homo sapiens
  Payload ID: 8334
  Gene Symbol: ICAM2
  Gene Name: intercellular adhesion molecule 2
  ENSP ID: ENSP00000462617
MSSFGYRTLTVALFTLICCPGVNEFQRQRVPASKAGHPDTATHFGGCGQVLHH

SEQ ID NO: 40979 - protein, 174 aa, Homo sapiens
  Payload ID: 8334
  Gene Symbol: ICAM2
  Gene Name: intercellular adhesion molecule 2
  ENSP ID: ENSP00000463199
MNSNVSVYQPPRQVILTLQPTLVAVGKSFTIECRVPTVEPLDSLTLFLFRGNETLHYETFGKAAPAPQEATATFNSTADREDGHRNFSCLAVLDLMSRGGNIFHKHSAPKMLEIYEPVSDSQMVIIVTVVSVLLSLFVTSVLLCFIFGQHLRQQRMGTYGVRAAWRRLPQAFRP

SEQ ID NO: 40980 - protein, 166 aa, Homo sapiens
  Payload ID: 8334
  Gene Symbol: ICAM2
  Gene Name: intercellular adhesion molecule 2
  ENSP ID: ENSP00000463862
MSSFGYRTLTVALFTLICCPGSDEKVFEVHVRPKKLAVEPKGSLEVNCSTTCNQPEVGGLETSLDKILLDEQAQWKHYLVSNISHDTVLQCHFTCSGKQESMNSNVSVYQPPRQVILTLQPTLVAVGKSFTIECRVPTVEPLDSLTLFLFRGNETLHYETFGKAAP

SEQ ID NO: 40981 - protein, 214 aa, Homo sapiens
  Payload ID: 8334
  Gene Symbol: ICAM2
  Gene Name: intercellular adhesion molecule 2
  ENSP ID: ENSP00000463945
MSSFGYRTLTVALFTLICCPGSDEKVFEVHVRPKKLAVEPKGSLEVNCSTTCNQPEVGGLETSLDKILLDEQAQWKHYLVSNISHDTVLQCHFTCSGKQESMNSNVSVYQPPRQVILTLQPTLVAVGKSFTIECRVPTVEPLDSLTLFLFRGNETLHYETFGKAAPAPQEATATFNSTADREDGHRNFSCLAVLDLMSRGGNIFHKHSAPKMLE

SEQ ID NO: 40982 - protein, 216 aa, Homo sapiens
  Payload ID: 8334
  Gene Symbol: ICAM2
  Gene Name: intercellular adhesion molecule 2
  ENSP ID: ENSP00000464331
MSSFGYRTLTVALFTLICCPGSDEKVFEVHVRPKKLAVEPKGSLEVNCSTTCNQPEVGGLETSLDKILLDEQAQWKHYLVSNISHDTVLQCHFTCSGKQESMNSNVSVYQPPRQVILTLQPTLVAVGKSFTIECRVPTVEPLDSLTLFLFRGNETLHYETFGKAAPAPQEATATFNSTADREDGHRNFSCLAVLDLMSRGGNIFHKHSAPKMLEIY

SEQ ID NO: 40983 - protein, 251 aa, Homo sapiens
  Payload ID: 8334
  Gene Symbol: ICAM2
  Gene Name: intercellular adhesion molecule 2
  ENSP ID: ENSP00000464372
MSSFGYRTLTVALFTLICCPGSDEKVFEVHVRPKKLATSLDKILLDEQAQWKHYLVSNISHDTVLQCHFTCSGKQESMNSNVSVYQPPRQVILTLQPTLVAVGKSFTIECRVPTVEPLDSLTLFLFRGNETLHYETFGKAAPAPQEATATFNSTADREDGHRNFSCLAVLDLMSRGGNIFHKHSAPKMLEIYEPVSDSQMVIIVTVVSVLLSLFVTSVLLCFIFGQHLRQQRMGTYGVRAAWRRLPQAFRP

SEQ ID NO: 40984 - protein, 275 aa, Homo sapiens; identical to SEQ ID NO: 40974
  Payload ID: 8334
  Gene Symbol: ICAM2
  Gene Name: intercellular adhesion molecule 2
  Uniprot ID: P13598
  ENSP ID: ENSP00000464665

SEQ ID NO: 40985 - protein, 547 aa, Homo sapiens
  Payload ID: 8335
  Gene Symbol: ICAM3
  Gene Name: intercellular adhesion molecule 3
  Uniprot ID: P32942
  ENSP ID: ENSP00000160262
MATMVPSVLWPRACWTLLVCCLLTPGVQGQEFLLRVEPQNPVLSAGGSLFVNCSTDCPSSEKIALETSLSKELVASGMGWAAFNLSNVTGNSRILCSVYCNGSQITGSSNITVYRLPERVELAPLPPWQPVGQNFTLRCQVEDGSPRTSLTVVLLRWEEELSRQPAVEEPAEVTATVLASRDDHGAPFSCRTELDMQPQGLGLFVNTSAPRQLRTFVLPVTPPRLVAPRFLEVETSWPVDCTLDGLFPASEAQVYLALGDQMLNATVMNHGDTLTATATATARADQEGAREIVCNVTLGGERREARENLTVFSFLGPIVNLSEPTAHEGSTVTVSCMAGARVQVTLDGVPAAAPGQPAQLQLNATESDDGRSFFCSATLEVDGEFLHRNSSVQLRVLYGPKIDRATCPQHLKWKDKTRHVLQCQARGNPYPELRCLKEGSSREVPVGIPFFVNVTHNGTYQCQASSSRGKYTLVVVMDIEAGSSHFVPVFVAVLLTLGVVTIVLALMYVFREHQRSGSYHVREESTYLPLTSMQPTEAMGEEPSRAE

SEQ ID NO: 40986 - protein, 40 aa, Homo sapiens
  Payload ID: 8335
  Gene Symbol: ICAM3
  Gene Name: intercellular adhesion molecule 3
  ENSP ID: ENSP00000466081
MGWAAFNLSNVTGNSRILCSVYCNGSQITGSSNITVYRLP

SEQ ID NO: 40987 - protein, 59 aa, Homo sapiens
  Payload ID: 8335
  Gene Symbol: ICAM3
  Gene Name: intercellular adhesion molecule 3
  ENSP ID: ENSP00000466501
MATMVPSVLWPRACWTLLVCCLLTPVLIVPALRKSPWRRPYQRSWWPVAWAGQPSISAT

SEQ ID NO: 40988 - protein, 301 aa, Homo sapiens
  Payload ID: 8335
  Gene Symbol: ICAM3
  Gene Name: intercellular adhesion molecule 3
  ENSP ID: ENSP00000467232
DHGAPFSCRTELDMQPQGLGLFVNTSAPRQLRTFVLPVTPPRLVAPRFLEVETSWPVDCTLDGLFPASEAQVYLALGDQMLNATVMNHGDTLTATATATARADQEGFLGPIVNLSEPTAHEGSTVTVSCMAGARVQVTLDGVPAAAPGQPAQLQLNATESDDGRSFFCSATLEVDGEFLHRNSSVQLRVLYGPKIDRATCPQHLKWKDKTRHVLQCQARGNPYPELRCLKEGSSREVPVGIPFFVNVTHNGTYQCQASSSRGKYTLVVVMDIEAGSSHFVPVFVAVLLTLGVVTIVLALMY

SEQ ID NO: 40989 - protein, 132 aa, Homo sapiens
  Payload ID: 8335
  Gene Symbol: ICAM3
  Gene Name: intercellular adhesion molecule 3
  ENSP ID: ENSP00000467770
MLDQSLFWPPSEFSPVSDGFYLSHWTMKAGTLLSRHKERGVKCTDCPSSEKIALETSLSKELVASGMGWAAFNLSNVTGNSRILCSVYCNGSQITGSSNITVYRLPERVELAPLPPWQPVGQNFTLRCQVED

SEQ ID NO: 40990 - protein, 192 aa, Homo sapiens
  Payload ID: 8335
  Gene Symbol: ICAM3
  Gene Name: intercellular adhesion molecule 3
  ENSP ID: ENSP00000468230
TVSCMAGARVQVTLDGVPAAAPGQPAQLQLNATESDDGRSFFCSATLEVDGEFLHRNSSVQLRVLYGPKIDRATCPQHLKWKDKTRHVLQCQARGNPYPELRCLKEGSSREVPVGIPFFVNVTHNAGSSHFVPVFVAVLLTLGVVTIVLALMYVFREHQRSGSYHVREESTYLPLTSMQPTEAMGEEPSRAE

SEQ ID NO: 40991 - protein, 23 aa, Homo sapiens
  Payload ID: 8335
  Gene Symbol: ICAM3
  Gene Name: intercellular adhesion molecule 3
  ENSP ID: ENSP00000468282
MGWAAFNLSNVTGNSRILCSVYC

SEQ ID NO: 40992 - protein, 470 aa, Homo sapiens
  Payload ID: 8335
  Gene Symbol: ICAM3
  Gene Name: intercellular adhesion molecule 3
  ENSP ID: ENSP00000468333
MGWAAFNLSNVTGNSRILCSVYCNGSQITGSSNITVYRLPERVELAPLPPWQPVGQNFTLRCQVEDGSPRTSLTVVLLRWEEELSRQPAVEEPAEVTATVLASRDDHGAPFSCRTELDMQPQGLGLFVNTSAPRQLRTFVLPVTPPRLVAPRFLEVETSWPVDCTLDGLFPASEAQVYLALGDQMLNATVMNHGDTLTATATATARADQEGAREIVCNVTLGGERREARENLTVFSFLGPIVNLSEPTAHEGSTVTVSCMAGARVQVTLDGVPAAAPGQPAQLQLNATESDDGRSFFCSATLEVDGEFLHRNSSVQLRVLYGPKIDRATCPQHLKWKDKTRHVLQCQARGNPYPELRCLKEGSSREVPVGIPFFVNVTHNGTYQCQASSSRGKYTLVVVMDIEAGSSHFVPVFVAVLLTLGVVTIVLALMYVFREHQRSGSYHVREESTYLPLTSMQPTEAMGEEPSRAE

SEQ ID NO: 40993 - protein, 272 aa, Homo sapiens
  Payload ID: 8336
  Gene Symbol: ICAM4
  Gene Name: intercellular adhesion molecule 4 (Landsteiner-Wiener blood group)
  Uniprot ID: Q14773
  ENSP ID: ENSP00000342114
MGSLFPLSLLFFLAAAYPGVGSALGRRTKRAQSPKGSPLAPSGTSVPFWVRMSPEFVAVQPGKSVQLNCSNSCPQPQNSSLRTPLRQGKTLRGPGWVSYQLLDVRAWSSLAHCLVTCAGKTRWATSRITAYSVPGGLLGGDPEAWKPGHLFRKPGALHRPGSGQRDLDLRVCCWTPRLLAARDLPRAPQSRRPGGPQQLGTHYTDARLEPRAHSFGLRFHRCPCRDPPHCGRCVPMQVPSYEVPGVKGDVLCRLSEKKRNMKQSGEMAIHGG

SEQ ID NO: 40994 - protein, 271 aa, Homo sapiens
  Payload ID: 8336
  Gene Symbol: ICAM4
  Gene Name: intercellular adhesion molecule 4 (Landsteiner-Wiener blood group)
  Uniprot ID: Q14773
  ENSP ID: ENSP00000370147
MGSLFPLSLLFFLAAAYPGVGSALGRRTKRAQSPKGSPLAPSGTSVPFWVRMSPEFVAVQPGKSVQLNCSNSCPQPQNSSLRTPLRQGKTLRGPGWVSYQLLDVRAWSSLAHCLVTCAGKTRWATSRITAYKPPHSVILEPPVLKGRKYTLRCHVTQVFPVGYLVVTLRHGSRVIYSESLERFTGLDLANVTLTYEFAAGPRDFWQPVICHARLNLDGLVVRNSSAPITLMLAWSPAPTALASGSIAALVGILLTVGAAYLCKCLAMKSQA

SEQ ID NO: 40995 - protein, 237 aa, Homo sapiens
  Payload ID: 8336
  Gene Symbol: ICAM4
  Gene Name: intercellular adhesion molecule 4 (Landsteiner-Wiener blood group)
  Uniprot ID: Q14773
  ENSP ID: ENSP00000377320
MGSLFPLSLLFFLAAAYPGVGSALGRRTKRAQSPKGSPLAPSGTSVPFWVRMSPEFVAVQPGKSVQLNCSNSCPQPQNSSLRTPLRQGKTLRGPGWVSYQLLDVRAWSSLAHCLVTCAGKTRWATSRITAYKPPHSVILEPPVLKGRKYTLRCHVTQVFPVGYLVVTLRHGSRVIYSESLERFTGLDLANVTLTYEFAAGPRDFWQPVICHARLNLDGLVVRNSSAPITLMLGEAPL

SEQ ID NO: 40996 - protein, 924 aa, Homo sapiens
  Payload ID: 8337
  Gene Symbol: ICAM5
  Gene Name: intercellular adhesion molecule 5, telencephalin
  Uniprot ID: Q9UMF0
  ENSP ID: ENSP00000221980
MPGPSPGLRRALLGLWAALGLGLFGLSAVSQEPFWADLQPRVAFVERGGSLWLNCSTNCPRPERGGLETSLRRNGTQRGLRWLARQLVDIREPETQPVCFFRCARRTLQARGLIRTFQRPDRVELMPLPPWQPVGENFTLSCRVPGAGPRASLTLTLLRGAQELIRRSFAGEPPRARGAVLTATVLARREDHGANFSCRAELDLRPHGLGLFENSSAPRELRTFSLSPDAPRLAAPRLLEVGSERPVSCTLDGLFPASEARVYLALGDQNLSPDVTLEGDAFVATATATASAEQEGARQLVCNVTLGGENRETRENVTIYSFPAPLLTLSEPSVSEGQMVTVTCAAGAQALVTLEGVPAAVPGQPAQLQLNATENDDRRSFFCDATLDVDGETLIKNRSAELRVLYAPRLDDSDCPRSWTWPEGPEQTLRCEARGNPEPSVHCARSDGGAVLALGLLGPVTRALSGTYRCKAANDQGEAVKDVTLTVEYAPALDSVGCPERITWLEGTEASLSCVAHGVPPPDVICVRSGELGAVIEGLLRVAREHAGTYRCEATNPRGSAAKNVAVTVEYGPRFEEPSCPSNWTWVEGSGRLFSCEVDGKPQPSVKCVGSGGATEGVLLPLAPPDPSPRAPRIPRVLAPGIYVCNATNRHGSVAKTVVVSAESPPEMDESTCPSHQTWLEGAEASALACAARGRPSPGVRCSREGIPWPEQQRVSREDAGTYHCVATNAHGTDSRTVTVGVEYRPVVAELAASPPGGVRPGGNFTLTCRAEAWPPAQISWRAPPGALNIGLSSNNSTLSVAGAMGSHGGEYECAATNAHGRHARRITVRVAGPWLWVAVGGAAGGAALLAAGAGLAFYVQSTACKKGEYNVQEAESSGEAVCLNGAGGGAGGAAGAEGGPEAAGGAAESPAEGEVFAIQLTSA

SEQ ID NO: 40997 - protein, 78 aa, Homo sapiens
  Payload ID: 8337
  Gene Symbol: ICAM5
  Gene Name: intercellular adhesion molecule 5, telencephalin
  ENSP ID: ENSP00000464796
MPLPPWQPVGENFTLSCRVPGAGPRASLTLTLLRGAQELIRRSFAGEPPRARGAVLTATVLARREDHGANFSCRAELD

SEQ ID NO: 40998 - protein, 557 aa, Homo sapiens
  Payload ID: 8338
  Gene Symbol: IFNAR1
  Gene Name: interferon (alpha, beta and omega) receptor 1
  Uniprot ID: P17181
  ENSP ID: ENSP00000270139
MMVVLLGATTLVLVAVAPWVLSAAAGGKNLKSPQKVEVDIIDDNFILRWNRSDESVGNVTFSFDYQKTGMDNWIKLSGCQNITSTKCNFSSLKLNVYEEIKLRIRAEKENTSSWYEVDSFTPFRKAQIGPPEVHLEAEDKAIVIHISPGTKDSVMWALDGLSFTYSLVIWKNSSGVEERIENIYSRHKIYKLSPETTYCLKVKAALLTSWKIGVYSPVHCIKTTVENELPPPENIEVSVQNQNYVLKWDYTYANMTFQVQWLHAFLKRNPGNHLYKWKQIPDCENVKTTQCVFPQNVFQKGIYLLRVQASDGNNTSFWSEEIKFDTEIQAFLLPPVFNIRSLSDSFHIYIGAPKQSGNTPVIQDYPLIYEIIFWENTSNAERKIIEKKTDVTVPNLKPLTVYCVKARAHTMDEKLNKSSVFSDAVCEKTKPGNTSKIWLIVGICIALFALPFVIYAAKVFLRCINYVFFPSLKPSSSIDEYFSEQPLKNLLLSTSEEQIEKCFIIENISTIATVEETNQTDEDHKKYSSQTSQDSGNYSNEDESESKTSEELQQDFV

SEQ ID NO: 40999 - protein, 136 aa, Homo sapiens
  Payload ID: 8338
  Gene Symbol: IFNAR1
  Gene Name: interferon (alpha, beta and omega) receptor 1
  ENSP ID: ENSP00000400161
MMVVLLGATTLVLVAVAPWVLSAAAGGKNLKSPQKVEVDIIDDNFILRWNRSDESVGNVTFSFDYQKTGMDNWIKLSGCQNITSTKCNFSSLKLNVYEEIKLRIRAEKENTSSWYEVDSFTPFRKVENELPPPENI

SEQ ID NO: 41000 - protein, 239 aa, Homo sapiens
  Payload ID: 8339
  Gene Symbol: IFNAR2
  Gene Name: interferon (alpha, beta and omega) receptor 2
  Uniprot ID: P48551
  ENSP ID: ENSP00000343289
MLLSQNAFIFRSLNLVLMVYISLVFGISYDSPDYTDESCTFKISLRNFRSILSWELKNHSIVPTHYTLLYTIMSKPEDLKVVKNCANTTRSFCDLTDEWRSTHEAYVTVLEGFSGNTTLFSCSHNFWLAIDMSFEPPEFEIVGFTNHINVMVKFPSIVEEELQFDLSLVIEEQSEGIVKKHKPEIKGNMSGNFTYIIDKLIPNTNYCVSVYLEHSDEQAVIKSPLKCTLLPPGQESEFS

SEQ ID NO: 41001 - protein, 515 aa, Homo sapiens [sequence omitted]

SEQ ID NO: 41002 - protein, 197 aa, Homo sapiens
  Payload ID: 8339
  Gene Symbol: IFNAR2
  Gene Name: interferon (alpha, beta and omega) receptor 2
  ENSP ID: ENSP00000371673
MLLSQNAFIFRSLNLVLMVYISLVFGISYDSPDYTDESCTFKISLRNFRSILSWELKNHSIVPTHYTLLYTIMSKPEDLKVVKNCANTTRSFCDLTDEWRSTHEAYVTVLEGFSGNTTLFSCSHNFWLAIDMSFEPPEFEIVGFTNHINVMVKFPSIVEEELQFDLSLVIEEQSEGIVKKGEDEKLDISQFCHRQAL

SEQ ID NO: 41003 - protein, 331 aa, Homo sapiens
  Payload ID: 8339
  Gene Symbol: IFNAR2
  Gene Name: interferon (alpha, beta and omega) receptor 2
  Uniprot ID: P48551
  ENSP ID: ENSP00000371699
MLLSQNAFIFRSLNLVLMVYISLVFGISYDSPDYTDESCTFKISLRNFRSILSWELKNHSIVPTHYTLLYTIMSKPEDLKVVKNCANTTRSFCDLTDEWRSTHEAYVTVLEGFSGNTTLFSCSHNFWLAIDMSFEPPEFEIVGFTNHINVMVKFPSIVEEELQFDLSLVIEEQSEGIVKKHKPEIKGNMSGNFTYIIDKLIPNTNYCVSVYLEHSDEQAVIKSPLKCTLLPPGQESESAESAKIGGIITVFLIALVLTSTIVTLKWIGYICLRNSLPKVLRQGLAKGWNAVAIHRCSHNALQSETPELKQSSCLSFPSSWDYKRASLCPSD

SEQ ID NO: 41004 - protein, 331 aa, Homo sapiens; identical to SEQ ID NO: 41003
  Payload ID: 8339
  Gene Symbol: IFNAR2
  Gene Name: interferon (alpha, beta and omega) receptor 2
  Uniprot ID: P48551
  ENSP ID: ENSP00000384309

SEQ ID NO: 41005 - protein, 54 aa, Homo sapiens
  Payload ID: 8339
  Gene Symbol: IFNAR2
  Gene Name: interferon (alpha, beta and omega) receptor 2
  ENSP ID: ENSP00000398799
FTNHINVMVKFPSIVEEELQFDLSLVIEEQSEGIVKKGEDEKLDISQFCHRQAL

SEQ ID NO: 41006 - protein, 204 aa, Homo sapiens
  Payload ID: 8339
  Gene Symbol: IFNAR2
  Gene Name: interferon (alpha, beta and omega) receptor 2
  ENSP ID: ENSP00000402311
MPRIPGICHCKICKSQEKTLKIAKMLLSQNAFIFRSLNLVLMVYISLVFGISYDSPDYTDESCTFKISLRNFRSILSWELKNHSIVPTHYTLLYTIMSKPEDLKVVKNCANTTRSFCDLTDEWRSTHEAYVTVLEGFSGNTTLFSCSHNFWLAIDMSFEPPEFEIVGFTNHINVMVKFPSIVEEELQFDLSLVIEEQSEGIVKK

SEQ ID NO: 41007 - protein, 229 aa, Homo sapiens
  Payload ID: 8339
  Gene Symbol: IFNAR2
  Gene Name: interferon (alpha, beta and omega) receptor 2
  ENSP ID: ENSP00000403569
MSKPEDLKVVKNCANTTRSFCDLTDEWRSTHEAYVTVLEGFSGNTTLFSCSHNFWLAIDMSFEPPEFEIVGFTNHINVMVKFPSIVEEELQFDLSLVIEEQSEGIVKKHKPEIKGNMSGNFTYIIDKLIPNTNYCVSVYLEHSDEQAVIKSPLKCTLLPPGQESESAESAKIGGIITVFLIALVLTSTIVTLKWIGYICLRNSLPKVLNFHNFLAWPFPNLPPLEAMDM

SEQ ID NO: 41008 - protein, 167 aa, Homo sapiens
  Payload ID: 8339
  Gene Symbol: IFNAR2
  Gene Name: interferon (alpha, beta and omega) receptor 2
  ENSP ID: ENSP00000413160
MSKPEDLKVVKNCANTTRSFCDLTDEWRSTHEAYVTVLEGFSGNTTLFSCSHNFWLAIDMSFEPPEFEIVGFTNHINVMVKFPSIVEEELQFDLSLVIEEQSEGIVKKHKPEIKGNMSGNFTYIIDKLIPNTNYCVSVYLEHSDEQAVIKSPLKCTLLPPGQESEFS

SEQ ID NO: 41009 - protein, 489 aa, Homo sapiens
  Payload ID: 8340
  Gene Symbol: IFNGR1
  Gene Name: interferon gamma receptor 1
  Uniprot ID: P15260
  ENSP ID: ENSP00000356713
MALLFLLPLVMQGVSRAEMGTADLGPSSVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIKGSLWIPVVAALLLFLVLSLVFICFYIKKINPLKEKSIILPKSLISVVRSATLETKPESKYVSLITSYQPFSLEKEVVCEEPLSPATVPGMHTEDNPGKVEHTEELSSITEVVTTEENIPDVVPGSHLTPIERESSSPLSSNQSEPGSIALNSYHSRNCSESDHSRNGFDTDSSCLESHSSLSDSEFPPNNKGEIKTEGQELITVIKAPTSFGYDKPHVLVDLLVDDSGKESLIGYRPTEDSKEFS

SEQ ID NO: 41010 - protein, 210 aa, Homo sapiens
  Payload ID: 8340
  Gene Symbol: IFNGR1
  Gene Name: interferon gamma receptor 1
  ENSP ID: ENSP00000389249
MALLFLLPLVMQGVSRAEMGTADLGPSSVPTPTNVTIESYNMNPIVYWEYQIMPQVPVFTVEVKNYGVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIK

SEQ ID NO: 41011 - protein, 161 aa, Homo sapiens
  Payload ID: 8340
  Gene Symbol: IFNGR1
  Gene Name: interferon gamma receptor 1
  ENSP ID: ENSP00000394230
MLLKSPENSLLQFQFKYGVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRV

SEQ ID NO: 41012 - protein, 274 aa, Homo sapiens
  Payload ID: 8340
  Gene Symbol: IFNGR1
  Gene Name: interferon gamma receptor 1
  ENSP ID: ENSP00000443282
MALLFLLPLVMQGVSRAEMGTADLGPSSVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIKGSLWIPVVAALLLFCLAWYSSVFILRKLIH

SEQ ID NO: 41013 - protein, 337 aa, Homo sapiens
  Payload ID: 8341
  Gene Symbol: IFNGR2
  Gene Name: interferon gamma receptor 2 (interferon gamma transducer 1)
  Uniprot ID: P38484
  ENSP ID: ENSP00000290219
MRPTLLWSLLLLLGVFAAAAAAPPDPLSQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSPKDDVWDSVSIISFPEKEQEDVLQTL

SEQ ID NO: 41014 - protein, 356 aa, Homo sapiens
  Payload ID: 8341
  Gene Symbol: IFNGR2
  Gene Name: interferon gamma receptor 2 (interferon gamma transducer 1)
  ENSP ID: ENSP00000371425
MRPTLLWSLLLLLGVFAAAAAAPPAQLTLETYQEWCNDSAATHDPLSQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSPKDDVWDSVSIISFPEKEQEDVLQTL

SEQ ID NO: 41015 - protein, 258 aa, Homo sapiens
  Payload ID: 8341
  Gene Symbol: IFNGR2
  Gene Name: interferon gamma receptor 2 (interferon gamma transducer 1)
  ENSP ID: ENSP00000385044
MSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSPKDDVWDSVSIISFPEKEQEDVLQTL

SEQ ID NO: 41016 - protein, 60 aa, Homo sapiens
  Payload ID: 8341
  Gene Symbol: IFNGR2
  Gene Name: interferon gamma receptor 2 (interferon gamma transducer 1)
  ENSP ID: ENSP00000402629
  MOD_RES (1)..(1): Any amino acid
XETMADASTELQQVILISVGTFSLLSVLAGACFFLVLKYRGLIKYWFHTPPSIPLQIEEV

SEQ ID NO: 41017 - protein, 70 aa, Homo sapiens
  Payload ID: 8341
  Gene Symbol: IFNGR2
  Gene Name: interferon gamma receptor 2 (interferon gamma transducer 1)
  ENSP ID: ENSP00000407541
MRPTLLWSLLLLLGVFAAAAAAPPAQLTLETYQEWCNDSAATHEMGDGEQACGGRNNGPQRCPRPHPQSP

SEQ ID NO: 41018 - protein, 37 aa, Homo sapiens
  Payload ID: 8341
  Gene Symbol: IFNGR2
  Gene Name: interferon gamma receptor 2 (interferon gamma transducer 1)
  ENSP ID: ENSP00000442735
MRPTLLWSLLLLLGVFAAAAAAPPAPTVNGSRPTSCP

SEQ ID NO: 41019 - protein, 313 aa, Homo sapiens
  Payload ID: 8341
  Gene Symbol: IFNGR2
  Gene Name: interferon gamma receptor 2 (interferon gamma transducer 1)
  Uniprot ID: P38484
  ENSP ID: ENSP00000458487
  MOD_RES (1)..(1): Any amino acid
XPLSQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSPKDDVWDSVSIISFPEKEQEDVLQTL

SEQ ID NO: 41020 - protein, 46 aa, Homo sapiens
  Payload ID: 8341
  Gene Symbol: IFNGR2
  Gene Name: interferon gamma receptor 2 (interferon gamma transducer 1)
  ENSP ID: ENSP00000459355
  MOD_RES (1)..(1): Any amino acid
XQLTLETYQEWCNDSAATHEMGDGEQACGGRNNGPQRCPRPHPQSP

SEQ ID NO: 41021 - protein, 60 aa, Homo sapiens; identical to SEQ ID NO: 41016
  Payload ID: 8341
  Gene Symbol: IFNGR2
  Gene Name: interferon gamma receptor 2 (interferon gamma transducer 1)
  ENSP ID: ENSP00000459791
  MOD_RES (1)..(1): Any amino acid

SEQ ID NO: 41022 - protein, 332 aa, Homo sapiens
  Payload ID: 8341
  Gene Symbol: IFNGR2
  Gene Name: interferon gamma receptor 2 (interferon gamma transducer 1)
  ENSP ID: ENSP00000459965
  MOD_RES (1)..(1): Any amino acid
XQLTLETYQEWCNDSAATHDPLSQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSPKDDVWDSVSIISFPEKEQEDVLQTL

SEQ ID NO: 41023 - protein, 13 aa, Homo sapiens
  Payload ID: 8341
  Gene Symbol: IFNGR2
  Gene Name: interferon gamma receptor 2 (interferon gamma transducer 1)
  ENSP ID: ENSP00000460732
  MOD_RES (1)..(1): Any amino acid
XPTVNGSRPTSCP

SEQ ID NO: 41024 - protein, 330 aa, Homo sapiens
  Payload ID: 8341
  Gene Symbol: IFNGR2
  Gene Name: interferon gamma receptor 2 (interferon gamma transducer 1)
  ENSP ID: ENSP00000461231
LTLETYQEWCNDSAATHDPLSQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSPKDDVWDSVSIISFPEKEQEDVLQTL

SEQ ID NO: 41025 - protein, 125 aa, Homo sapiens
  Payload ID: 8342
  Gene Symbol: IFITM1
  Gene Name: interferon induced transmembrane protein 1
  Uniprot ID: P13164
  ENSP ID: ENSP00000330825
MHKEEHEVAVLGPPPSTILPRSTVINIHSETSVPDHVVWSLFNTLFLNWCCLGFIAFAYSVKSRDRKMVGDVTGAQAYASTAKCLNIWALILGILMTIGFILLLVFGSVTVYHIMLQIIQEKRGY

SEQ ID NO: 41026 - protein, 125 aa, Homo sapiens; identical to SEQ ID NO: 41025
  Payload ID: 8342
  Gene Symbol: IFITM1
  Gene Name: interferon induced transmembrane protein 1
  Uniprot ID: P13164
  ENSP ID: ENSP00000386187

SEQ ID NO: 41027 - protein, 125 aa, Homo sapiens; identical to SEQ ID NO: 41025
  Payload ID: 8342
  Gene Symbol: IFITM1
  Gene Name: interferon induced transmembrane protein 1
  Uniprot ID: P13164
  ENSP ID: ENSP00000437057

SEQ ID NO: 41028 - protein, 228 aa, Homo sapiens
  Payload ID: 8343
  Gene Symbol: IFITM10
  Gene Name: interferon induced transmembrane protein 10
  Uniprot ID: A6NMD0
  ENSP ID: ENSP00000344430
MREGKRGPPCILSFRGTLERVEAQWELEAQGPGQCPAPLGDPASTTDGAQEARVPLDGAFWIPRPPAGSPKGCFACVSKPPALQAPAAPAPEPSASPPMAPTLFPMESKSSKTDSVRAAGAPPACKHLAEKKTMTNPTTVIEVYPDTTEVNDYYLWSIFNFVYLNFCCLGFIALAYSLKVRDKKLLNDLNGAVEDAKTARLFNITSSALAASCIILVFIFLRYPLTDY

SEQ ID NO: 41029 - protein, 128 aa, Homo sapiens
  Payload ID: 8343
  Gene Symbol: IFITM10
  Gene Name: interferon induced transmembrane protein 10
  ENSP ID: ENSP00000371557
MREGKRGPPCILSFRGTLERVEAQWELEVGPLGGGSVDRQRPAGRRKDARTEAQGVRPRAEESLVGPGPRPVPSPAGRPGQHHGRRPGSPSPPGRGLLDSEAPGRFAQGLLRLRVQAPCPAGSGGPCP

SEQ ID NO: 41030 - protein, 49 aa, Homo sapiens
  Payload ID: 8343
  Gene Symbol: IFITM10
  Gene Name: interferon induced transmembrane protein 10
  ENSP ID: ENSP00000486449
VRDKKLLNDLNGAVEDAKTARLFNITSSALAASCIILVFIFLRYPLTDY

SEQ ID NO: 41031 - protein, 74 aa, Homo sapiens
  Payload ID: 8344
  Gene Symbol: IFITM2
  Gene Name: interferon induced transmembrane protein 2
  ENSP ID: ENSP00000382712
  MOD_RES (1)..(1): Any amino acid
XGFIAFAYSVKSRDRKMVGDVTGAQAYASTAKCLNIWALILGILMTIGFILLLVFGSVTVYHIMLQIIQEKRGY

SEQ ID NO: 41032 - protein, 132 aa, Homo sapiens
  Payload ID: 8344
  Gene Symbol: IFITM2
  Gene Name: interferon induced transmembrane protein 2
  Uniprot ID: Q01629
  ENSP ID: ENSP00000382714
MNHIVQTFSPVNSGQPPNYEMLKEEQEVAMLGVPHNPAPPMSTVIHIRSETSVPDHVVWSLFNTLFMNTCCLGFIAFAYSVKSRDRKMVGDVTGAQAYASTAKCLNIWALILGIFMTILLIIIPVLVVQAQR

SEQ ID NO: 41033 - protein, 55 aa, Homo sapiens
  Payload ID: 8344
  Gene Symbol: IFITM2
  Gene Name: interferon induced transmembrane protein 2
  ENSP ID: ENSP00000431850
  MOD_RES (1)..(1): Any amino acid
XVIHIRSETSVPDHVVWSLFNTLFMNTCCLGFIAFAYSVKTGTQALPESEKGTHR

SEQ ID NO: 41034 - protein, 112 aa, Homo sapiens
  Payload ID: 8344
  Gene Symbol: IFITM2
  Gene Name: interferon induced transmembrane protein 2
  ENSP ID: ENSP00000434443
MLKEEQEVAMLGVPHNPAPPMSTVIHIRSETSVPDHVVWSLFNTLFMNTCCLGFIAFAYSVKSRDRKMVGDVTGAQAYASTAKCLNIWALILGIFMTILLIIIPVLVVQAQR

SEQ ID NO: 41035 - protein, 112 aa, Homo sapiens; identical to SEQ ID NO: 41034
  Payload ID: 8344
  Gene Symbol: IFITM2
  Gene Name: interferon induced transmembrane protein 2
  ENSP ID: ENSP00000473587

SEQ ID NO: 41036 - protein, 132 aa, Homo sapiens; identical to SEQ ID NO: 41032
  Payload ID: 8344
  Gene Symbol: IFITM2
  Gene Name: interferon induced transmembrane protein 2
  Uniprot ID: Q01629
  ENSP ID: ENSP00000484689

SEQ ID NO: 41037 - protein, 133 aa, Homo sapiens
  Payload ID: 8345
  Gene Symbol: IFITM3
  Gene Name: interferon induced transmembrane protein 3
  Uniprot ID: Q01628
  ENSP ID: ENSP00000382707
MNHTVQTFFSPVNSGQPPNYEMLKEEHEVAVLGAPHNPAPPTSTVIHIRSETSVPDHVVWSLFNTLFMNPCCLGFIAFAYSVKSRDRKMVGDVTGAQAYASTAKCLNIWALILGILMTILLIVIPVLIFQAYG

SEQ ID NO: 41038 - protein, 112 aa, Homo sapiens
  Payload ID: 8345
  Gene Symbol: IFITM3
  Gene Name: interferon induced transmembrane protein 3
  ENSP ID: ENSP00000432108
MLKEEHEVAVLGAPHNPAPPTSTVIHIRSETSVPDHVVWSLFNTLFMNPCCLGFIAFAYSVKSRDRKMVGDVTGAQAYASTAKCLNIWALILGILMTILLIVIPVLIFQAYG

SEQ ID NO: 41039 - protein, 112 aa, Homo sapiens; identical to SEQ ID NO: 41038
  Payload ID: 8345
  Gene Symbol: IFITM3
  Gene Name: interferon induced transmembrane protein 3
  ENSP ID: ENSP00000473544

SEQ ID NO: 41040 - protein, 55 aa, Homo sapiens
  Payload ID: 8345
  Gene Symbol: IFITM3
  Gene Name: interferon induced transmembrane protein 3
  ENSP ID: ENSP00000473645
  MOD_RES (1)..(1): Any amino acid
XVIHIRSETSVPDHVVWSLFNTLFMNPCCLGFIAFAYSVKTGTQALPESEKGTHR

SEQ ID NO: 41041 - protein, 132 aa, Homo sapiens
  Payload ID: 8346
  Gene Symbol: IFITM5
  Gene Name: interferon induced transmembrane protein 5
  Uniprot ID: A6NNB3
  ENSP ID: ENSP00000372059
MDTAYPREDTRAPTPSKAGAHTALTLGAPHPPPRDHLIWSVFSTLYLNLCCLGFLALAYSIKARDQKVVGDLEAARRFGSKAKCYNILAAMWTLVPPLLLLGLVVTGALHLARLAKDSAAFFSTKFDDADYD

SEQ ID NO: 41042 - protein, 1025 aa, Homo sapiens
  Payload ID: 8347
  Gene Symbol: IFIH1
  Gene Name: interferon induced with helicase C domain 1
  Uniprot ID: Q9BYX4
  ENSP ID: ENSP00000263642
MSNGYSTDENFRYLISCFRARVKMYIQVEPVLDYLTFLPAEVKEQIQRTVATSGNMQAVELLLSTLEKGVWHLGWTREFVEALRRTGSPLAARYMNPELTDLPSPSFENAHDEYLQLLNLLQPTLVDKLLVRDVLDKCMEEELLTIEDRNRIAAAENNGNESGVRELLKRIVQKENWFSAFLNVLRQTGNNELVQELTGSDCSESNAEIENLSQVDGPQVEEQLLSTTVQPNLEKEVWGMENNSSESSFADSSVVSESDTSLAEGSVSCLDESLGHNSNMGSDSGTMGSDSDEENVAARASPEPELQLRPYQMEVAQPALEGKNIIICLPTGSGKTRVAVYIAKDHLDKKKKASEPGKVIVLVNKVLLVEQLFRKEFQPFLKKWYRVIGLSGDTQLKISFPEVVKSCDIIISTAQILENSLLNLENGEDAGVQLSDFSLIIIDECHHTNKEAVYNNIMRHYLMQKLKNNRLKKENKPVIPLPQILGLTASPGVGGATKQAKAEEHILKLCANLDAFTIKTVKENLDQLKNQIQEPCKKFAIADATREDPFKEKLLEIMTRIQTYCQMSPMSDFGTQPYEQWAIQMEKKAAKEGNRKERVCAEHLRKYNEALQINDTIRMIDAYTHLETFYNEEKDKKFAVIEDDSDEGGDDEYCDGDEDEDDLKKPLKLDETDRFLMTLFFENNKMLKRLAENPEYENEKLTKLRNTIMEQYTRTEESARGIIFTKTRQSAYALSQWITENEKFAEVGVKAHHLIGAGHSSEFKPMTQNEQKEVISKFRTGKINLLIATTVAEEGLDIKECNIVIRYGLVTNEIAMVQARGRARADESTYVLVAHSGSGVIEHETVNDFREKMMYKAIHCVQNMKPEEYAHKILELQMQSIMEKKMKTKRNIAKHYKNNPSLITFLCKNCSVLACSGEDIHVIEKMHHVNMTPEFKELYIVRENKALQKKCADYQINGEIICKCGQAWGTMMVHKGLDLPCLKIRNFVVVFKNNSTKKQYKKWVELPITFPNLDYSECCLFSDED

SEQ ID NO: 41043 - protein, 221 aa, Homo sapiens
  Payload ID: 8347
  Gene Symbol: IFIH1
  Gene Name: interferon induced with helicase C domain 1
  Uniprot ID: Q9BYX4
  ENSP ID: ENSP00000408450
MSNGYSTDENFRYLISCFRARVKMYIQVEPVLDYLTFLPAEVKEQIQRTVATSGNMQAVELLLSTLEKGVWHLGWTREFVEALRRTGSPLAARYMNPELTDLPSPSFENAHDEYLQLLNLLQPTLVDKLLVRDVLDKCMEEELLTIEDRNRIAAAENNGNESGVRELLKRIVQKENWFSAFLNVLRQTGNNELVQELTGSDCSESNAGICNFTEEDSSNSA

SEQ ID NO: 41044 - protein, 325 aa, Homo sapiens
  Payload ID: 8348
  Gene Symbol: IRF1
  Gene Name: interferon regulatory factor 1
  Uniprot ID: P10914
  ENSP ID: ENSP00000245414
MPITRMRMRPWLEMQINSNQIPGLIWINKEEMIFQIPWKHAAKHGWDINKDACLFRSWAIHTGRYKAGEKEPDPKTWKANFRCAMNSLPDIEEVKDQSRNKGSSAVRVYRMLPPLTKNQRKERKSKSSRDAKSKAKRKSCGDSSPDTFSDGLSSSTLPDDHSSYTVPGYMQDLEVEQALTPALSPCAVSSTLPDWHIPVEVVPDSTSDLYNFQVSPMPSTSEATTDEDEEGKLPEDIMKLLEQSEWQPTNVDGKGYLLNEPGVQPTSVYGDFSCKEEPEIDSPGGDIGLSLQRVFTDLKNMDATWLDSLLTPVRLPSIQAIPCAP

SEQ ID NO: 41045 - protein, 325 aa, Homo sapiens; identical to SEQ ID NO: 41044
  Payload ID: 8348
  Gene Symbol: IRF1
  Gene Name: interferon regulatory factor 1
  Uniprot ID: P10914
  ENSP ID: ENSP00000384406

SEQ ID NO: 41046 - protein, 51 aa, Homo sapiens
  Payload ID: 8348
  Gene Symbol: IRF1
  Gene Name: interferon regulatory factor 1
  ENSP ID: ENSP00000392455
MPITRMRMRPWLEMQINSNQIPGLIWINKADTKQGKRSQIPRRGRPTFAVP

SEQ ID NO: 41047 - protein, 192 aa, Homo sapiens
  Payload ID: 8348
  Gene Symbol: IRF1
  Gene Name: interferon regulatory factor 1
  ENSP ID: ENSP00000396318
MPITRMRMRPWLEMQINSNQIPGLIWINKEEMIFQIPWKHAAKHGWDINKDACLFRSWAIHTGRYKAGEKEPDPKTWKANFRCAMNSLPDIEEVKDQSRNKGSSAVRVYRMLPPLTKNQRKERKSKSSRDAKSKAKRKSCGDSSPDTFSDGLSSSTLPDDHSSYTVPGYMQDLEVEQALTPALSPCAVSSTL

SEQ ID NO: 41048 - protein, 198 aa, Homo sapiens
  Payload ID: 8348
  Gene Symbol: IRF1
  Gene Name: interferon regulatory factor 1
  ENSP ID: ENSP00000405655
MPITRMRMRPWLEMQINSNQIPGLIWINKEEMIFQIPWKHAAKHGWDINKDACLFRSWAIHTGRYKAGEKEPDPKTWKANFRCAMNSLPDIEEVKDQSRNKGSSAVRVYRMLPPLTKNQRKERKSKSSRDAKSKAKRKSCGDSSPDTFSDGLSSSTLPDDHSSYTVPGYMQDLEVEQALTPATTDEDEEGKLPEDIMK

SEQ ID NO: 41049 - protein, 118 aa, Homo sapiens
  Payload ID: 8348
  Gene Symbol: IRF1
  Gene Name: interferon regulatory factor 1
  ENSP ID: ENSP00000473661
MPITRMRMRPWLEMQINSNQIPGLIWINKEEMIFQIPWKHAAKHGWDINKDACLFRSWAIHTGRYKAGEKEPDPKTWKANFRCAMNSLPDIEEVKDQSRNKGSSAVRVYRMLPPLTKN

SEQ ID NO: 41050 - protein, 201 aa, Homo sapiens
  Payload ID: 8348
  Gene Symbol: IRF1
  Gene Name: interferon regulatory factor 1
  ENSP ID: ENSP00000480887
MPITRMRMRPWLEMQINSNQIPGLIWINKEEMIFQIPWKHAAKHGWDINKDACLFRSWAIHTGRYKAGEKEPDPKTWKANFRCAMNSLPDIEEVKDQSRNKGSSAVRVYRMLPPLTKNQRKERKSKSSRDAKSKAKRKSCGDSSPDTFSDGLSSSTLPDDHSSYTVPGYMQDLEVEQALTPALGAVGVAANKRGWEGVPTQ

SEQ ID NO: 41051 - protein, 349 aa, Homo sapiens
  Payload ID: 8349
  Gene Symbol: IRF2
  Gene Name: interferon regulatory factor 2
  Uniprot ID: P14316
  ENSP ID: ENSP00000377218
MPVERMRMRPWLEEQINSNTIPGLKWLNKEKKIFQIPWMHAARHGWDVEKDAPLFRNWAIHTGKHQPGVDKPDPKTWKANFRCAMNSLPDIEEVKDKSIKKGNNAFRVYRMLPLSERPSKKGKKPKTEKEDKVKHIKQEPVESSLGLSNGVSDLSPEYAVLTSTIKNEVDSTVNIIVVGQSHLDSNIENQEIVTNPPDICQVVEVTTESDEQPVSMSELYPLQISPVSSYAESETTDSVPSDEESAEGRPHWRKRNIEGKQYLSNMGTRGSYLLPGMASFVTSNKPDLQVTIKEESNPVPYNSSWPPFQDLPLSSSMTPASSSSRPDRETRASVIKKTSDITQARVKSC

SEQ ID NO: 41052 - protein, 196 aa, Homo sapiens
  Payload ID: 8349
  Gene Symbol: IRF2
  Gene Name: interferon regulatory factor 2
  ENSP ID: ENSP00000421927
  MOD_RES (1)..(1): Any amino acid
XNNAFRVYRMLPLSERPSKKGKKPKTEKEDKVKHIKQEPVESSLGLSNGVSDLSPEYAVLTSTIKNEVDSTVNIIALNFCCVYGDFCFWETEEASSMLNCPDRPPLASCRVVGQSHLDSNIENQEIVTNPPDICQVVEVTTESDEQPVSMSELYPLQISPVSSYAESETTDSVPSDEESAEGRPHWRKRNIEGKQY

SEQ ID NO: 41053 - protein, 137 aa, Homo sapiens
  Payload ID: 8349
  Gene Symbol: IRF2
  Gene Name: interferon regulatory factor 2
  ENSP ID: ENSP00000422860
MPVERMRMRPWLEEQINSNTIPGLKWLNKEKKIFQIPWMHAARHGWDVEKDAPLFRNWAIHTGKHQPGVDKPDPKTWKANFRCAMNSLPDIEEVKDKSIKKGNNAFRVYRMLPLSERPSKKGKKPKTEKEDKVKHIK

SEQ ID NO: 41054 - protein, 113 aa, Homo sapiens
  Payload ID: 8349
  Gene Symbol: IRF2
  Gene Name: interferon regulatory factor 2
  ENSP ID: ENSP00000423074
PDIEEVKDKSIKKGNNAFRVYRMLPLSERPSKKVVGQSHLDSNIENQEIVTNPPDICQVVEVTTESDEQPVSMSELYPLQISPVSSYAESETTDSVPSDEESAEGRPHWRKRN

SEQ ID NO: 41055 - protein, 160 aa, Homo sapiens
  Payload ID: 8349
  Gene Symbol: IRF2
  Gene Name: interferon regulatory factor 2
  ENSP ID: ENSP00000424552
MPVERMRMRPWLEEQINSNTIPGLKWLNKEKKIFQIPWMHAARHGWDVEKDAPLFRNWAIHTGKHQPGVDKPDPKTWKANFRCAMNSLPDIEEVKDKSIKKGNNAFRVYRMLPLSERPSKKGKKPKTEKEDKVKHIKQEPVESSLGLSNGVSDLSPEYAV

SEQ ID NO: 41056 - protein, 83 aa, Homo sapiens
  Payload ID: 8349
  Gene Symbol: IRF2
  Gene Name: interferon regulatory factor 2
  ENSP ID: ENSP00000425037
MPVERMRMRPWLEEQINSNTIPGLKWLNKRQGLTIWPTLECSGAVITHCSLDLLGSSDPPTSASRVAGTTGKEDFSDPLDACG

SEQ ID NO: 41057 - protein, 176 aa, Homo sapiens
  Payload ID: 8349
  Gene Symbol: IRF2
  Gene Name: interferon regulatory factor 2
  ENSP ID: ENSP00000427204
MPVERMRMRPWLEEQINSNTIPGLKWLNKEKKIFQIPWMHAARHGWDVEKDAPLFRNWAIHTGKHQPGVDKPDPKTWKANFRCAMNSLPDIEEVKDKSIKKGNNAFRVYRMLPLSERPSKKGKKPKTEKEDKVKHIKQEPVESSLGLSNGVSDLSPEYAVLTSTIKNEVDSTVNII

SEQ ID NO: 41058 - protein, 584 aa, Homo sapiens
  Payload ID: 8350
  Gene Symbol: IRF2BP1
  Gene Name: interferon regulatory factor 2 binding protein 1
  Uniprot ID: Q8IU81
  ENSP ID: ENSP00000307265
MASVQASRRQWCYLCDLPKMPWAMVWDFSEAVCRGCVNFEGADRIELLIDAARQLKRSHVLPEGRSPGPPALKHPATKDLAAAAAQGPQLPPPQAQPQPSGTGGGVSGQDRYDRATSSGRLPLPSPALEYTLGSRLANGLGREEAVAEGARRALLGSMPGLMPPGLLAAAVSGLGSRGLTLAPGLSPARPLFGSDFEKEKQQRNADCLAELNEAMRGRAEEWHGRPKAVREQLLALSACAPFNVRFKKDHGLVGRVFAFDATARPPGYEFELKLFTEYPCGSGNVYAGVLAVARQMFHDALREPGKALASSGFKYLEYERRHGSGEWRQLGELLTDGVRSFREPAPAEALPQQYPEPAPAALCGPPPRAPSRNLAPTPRRRKASPEPEGEAAGKMTTEEQQQRHWVAPGGPYSAETPGVPSPIAALKNVAEALGHSPKDPGGGGGPVRAGGASPAASSTAQPPTQHRLVARNGEAEVSPTAGAEAVSGGGSGTGATPGAPLCCTLCRERLEDTHFVQCPSVPGHKFCFPCSREFIKAQGPAGEVYCPSGDKCPLVGSSVPWAFMQGEIATILAGDIKVKKERDP

SEQ ID NO: 41059 - protein, 587 aa, Homo sapiens
  Payload ID: 8351
  Gene Symbol: IRF2BP2
  Gene Name: interferon regulatory factor 2 binding protein 2
  Uniprot ID: Q7Z5L9
  ENSP ID: ENSP00000355568
MAAAVAVAAASRRQSCYLCDLPRMPWAMIWDFTEPVCRGCVNYEGADRVEFVIETARQLKRAHGCFPEGRSPPGAAASAAAKPPPLSAKDILLQQQQQLGHGGPEAAPRAPQALERYPLAAAAERPPRLGSDFGSSRPAASLAQPPTPQPPPVNGILVPNGFSKLEEPPELNRQSPNPRRGHAVPPTLVPLMNGSATPLPTALGLGGRAAASLAAVSGTAAASLGSAQPTDLGAHKRPASVSSSAAVEHEQREAAAKEKQPPPPAHRGPADSLSTAAGAAELSAEGAGKSRGSGEQDWVNRPKTVRDTLLALHQHGHSGPFESKFKKEPALTAGRLLGFEANGANGSKAVARTARKRKPSPEPEGEVGPPKINGEAQPWLSTSTEGLKIPMTPTSSFVSPPPPTASPHSNRTTPPEAAQNGQSPMAALILVADNAGGSHASKDANQVHSTTRRNSNSPPSPSSMNQRRLGPREVGGQGAGNTGGLEPVHPASLPDSSLATSAPLCCTLCHERLEDTHFVQCPSVPSHKFCFPCSRQSIKQQGASGEVYCPSGEKCPLVGSNVPWAFMQGEIATILAGDVKVKKERDS

SEQ ID NO: 41060 - protein, 571 aa, Homo sapiens
  Payload ID: 8351
  Gene Symbol: IRF2BP2
  Gene Name: interferon regulatory factor 2 binding protein 2
  Uniprot ID: Q7Z5L9
  ENSP ID: ENSP00000355569
MAAAVAVAAASRRQSCYLCDLPRMPWAMIWDFTEPVCRGCVNYEGADRVEFVIETARQLKRAHGCFPEGRSPPGAAASAAAKPPPLSAKDILLQQQQQLGHGGPEAAPRAPQALERYPLAAAAERPPRLGSDFGSSRPAASLAQPPTPQPPPVNGILVPNGFSKLEEPPELNRQSPNPRRGHAVPPTLVPLMNGSATPLPTALGLGGRAAASLAAVSGTAAASLGSAQPTDLGAHKRPASVSSSAAVEHEQREAAAKEKQPPPPAHRGPADSLSTAAGAAELSAEGAGKSRGSGEQDWVNRPKTVRDTLLALHQHGHSGPFESKFKKEPALTAVARTARKRKPSPEPEGEVGPPKINGEAQPWLSTSTEGLKIPMTPTSSFVSPPPPTASPHSNRTTPPEAAQNGQSPMAALILVADNAGGSHASKDANQVHSTTRRNSNSPPSPSSMNQRRLGPREVGGQGAGNTGGLEPVHPASLPDSSLATSAPLCCTLCHERLEDTHFVQCPSVPSHKFCFPCSRQSIKQQGASGEVYCPSGEKCPLVGSNVPWAFMQGEIATILAGDVKVKKERDS

SEQ ID NO: 41061 - protein, 796 aa, Homo sapiens
  Payload ID: 8352
  Gene Symbol: IRF2BPL
  Gene Name: interferon regulatory factor 2 binding protein-like
  Uniprot ID: Q9H1B7
  ENSP ID: ENSP00000238647
MSAAQVSSSRRQSCYLCDLPRMPWAMIWDFSEPVCRGCVNYEGADRIEFVIETARQLKRAHGCFQDGRSPGPPPPVGVKTVALSAKEAAAAAAAAAAAAAAAQQQQQQQQQQQQQQQQQQQQQQQQQLNHVDGSSKPAVLAAPSGLERYGLSAAAAAAAAAAAAVEQRSRFEYPPPPVSLGSSSHTARLPNGLGGPNGFPKPTPEEGPPELNRQSPNSSSAAASVASRRGTHGGLVTGLPNPGGGGGPQLTVPPNLLPQTLLNGPASAAVLPPPPPHALGSRGPPTPAPPGAPGGPACLGGTPGVSATSSSASSSTSSSVAEVGVGAGGKRPGSVSSTDQERELKEKQRNAEALAELSESLRNRAEEWASKPKMVRDTLLTLAGCTPYEVRFKKDHSLLGRVFAFDAVSKPGMDYELKLFIEYPTGSGNVYSSASGVAKQMYQDCMKDFGRGLSSGFKYLEYEKKHGSGDWRLLGDLLPEAVRFFKEGVPGADMLPQPYLDASCPMLPTALVSLSRAPSAPPGTGALPPAAPSGRGAAASLRKRKASPEPPDSAEGALKLGEEQQRQQWMANQSEALKLTMSAGGFAAPGHAAGGPPPPPPPLGPHSNRTTPPESAPQNGPSPMAALMSVADTLGTAHSPKDGSSVHSTTASARRNSSSPVSPASVPGQRRLASRNGDLNLQVAPPPPSAHPGMDQVHPQNIPDSPMANSGPLCCTICHERLEDTHFVQCPSVPSHKFCFPCSRESIKAQGATGEVYCPSGEKCPLVGSNVPWAFMQGEIATILAGDVKVKKERDP

SEQ ID NO: 41062 - protein, 427 aa, Homo sapiens
  Payload ID: 8353
  Gene Symbol: IRF3
  Gene Name: interferon regulatory factor 3
  Uniprot ID: Q14653
  ENSP ID: ENSP00000310127
MGTPKPRILPWLVSQLDLGQLEGVAWVNKSRTRFRIPWKHGLRQDAQQEDFGIFQAWAEATGAYVPGRDKPDLPTWKRNFRSALNRKEGLRLAEDRSKDPHDPHKIYEFVNSGVGDFSQPDTSPDTNGGGSTSDTQEDILDELLGNMVLAPLPDPGPPSLAVAPEPCPQPLRSPSLDNPTPFPNLGPSENPLKRLLVPGEEWEFEVTAFYRGRQVFQQTISCPEGLRLVGSEVGDRTLPGWPVTLPDPGMSLTDRGVMSYVRHVLSCLGGGLALWRAGQWLWAQRLGHCHTYWAVSEELLPNSGHGPDGEVPKDKEGGVFDLGPFIVDLITFTEGSGRSPRYALWFCVGESWPQDQPWTKRLVMVKVVPTCLRALVEMARVGGASSLENTVDLHISNSHPLSLTSDQYKAYLQDLVEGMDFQGPGES

SEQ ID NO: 41063 - protein, 281 aa, Homo sapiens
  Payload ID: 8353
  Gene Symbol: IRF3
  Gene Name: interferon regulatory factor 3
  ENSP ID: ENSP00000366339
MVLAPLPDPGPPSLAVAPEPCPQPLRSPSLDNPTPFPNLGPSENPLKRLLVPGEEWEFEVTAFYRGRQVFQQTISCPEGLRLVGSEVGDRTLPGWPVTLPDPGMSLTDRGVMSYVRHVLSCLGGGLALWRAGQWLWAQRLGHCHTYWAVSEELLPNSGHGPDGEVPKDKEGGVFDLGPFIVDLITFTEGSGRSPRYALWFCVGESWPQDQPWTKRLVMVKVVPTCLRALVEMARVGGASSLENTVDLHISNSHPLSLTSDQYKAYLQDLVEGMDFQGPGES

SEQ ID NO: 41064 - protein, 427 aa, Homo sapiens; identical to SEQ ID NO: 41062
  Payload ID: 8353
  Gene Symbol: IRF3
  Gene Name: interferon regulatory factor 3
  Uniprot ID: Q14653
  ENSP ID: ENSP00000366344

SEQ ID NO: 41065 - protein, 104 aa, Homo sapiens
  Payload ID: 8353
  Gene Symbol: IRF3
  Gene Name: interferon regulatory factor 3
  Uniprot ID: Q14653
  ENSP ID: ENSP00000400378
MGTPKPRILPWLVSQLDLGQLEGVAWVNKSRTRFRIPWKHGLRQDAQQEDFGIFQELGTFPSQTPLRTPMVEAVLLIPRKTFWMSYWVTWCWPHSQIRDPQAWL

SEQ ID NO: 41066 - protein, 135 aa, Homo sapiens
  Payload ID: 8353
  Gene Symbol: IRF3
  Gene Name: interferon regulatory factor 3
  ENSP ID: ENSP00000468911
MVLAPLPDPGPPSLAVAPEPCPQPLRSPSLDNPTPFPNLGPSENPLKRLLVPGEGCAHVPQGLGRNGPGRGCLLPGEYCGPAHFQQPPTLPHLRPVQGLPAGLGGGHGFPGPWGELSPRSSWCASNPPVPHHLNQ

SEQ ID NO: 41067 - protein, 119 aa, Homo sapiens
  Payload ID: 8353
  Gene Symbol: IRF3
  Gene Name: interferon regulatory factor 3
  ENSP ID: ENSP00000469067
MVLAPLPDPGPPSLAVAPEPCPQPLRSPSLDNPTPFPNLGPSENPLKRLLVPGEEWEFEVTAFYRGRQVFQQTISCPEGLRLVGSEVGDRTLPGWPVTLPDPGMSLTDRGVMSYVRHVL

SEQ ID NO: 41068 - protein, 427 aa, Homo sapiens; identical to SEQ ID NO: 41062
  Payload ID: 8353
  Gene Symbol: IRF3
  Gene Name: interferon regulatory factor 3
  Uniprot ID: Q14653
  ENSP ID: ENSP00000469113

SEQ ID NO: 41069 - protein, 281 aa, Homo sapiens; identical to SEQ ID NO: 41063
  Payload ID: 8353
  Gene Symbol: IRF3
  Gene Name: interferon regulatory factor 3
  ENSP ID: ENSP00000470069

SEQ ID NO: 41070 - protein, 190 aa, Homo sapiens
  Payload ID: 8353
  Gene Symbol: IRF3
  Gene Name: interferon regulatory factor 3
  ENSP ID: ENSP00000470140
MGTPKPRILPWLVSQLDLGQLEGVAWVNKSRTRFRIPWKHGLRQDAQQEDFGIFQAWAEATGAYVPGRDKPDLPTWKRNFRSALNRKEGLRLAEDRSKDPHDPHKIYEFVNSGVGDFSQPDTSPDTNGGGSTSDTQEDILDELLGNMVLAPLPDPGPPSLAVAPEPCPQPLRSPSLDNPTPFPNLGPSEN

SEQ ID NO: 41071 - protein, 408 aa, Homo sapiens
  Payload ID: 8353
  Gene Symbol: IRF3
  Gene Name: interferon regulatory factor 3
  ENSP ID: ENSP00000470431
MGTPKPRILPWLVSQLDLGQLEGVAWVNKSRTRFRIPWKHGLRQDAQQEDFGIFQAWAEATGAYVPGRDKPDLPTWKRNFRSALNRKEGLRLAEDRSKDPHDPHKIYEFVNSGVGDFSQPDTSPDTNGGGSTSDTQEDILDELLGNMVLAPLPDPGPPSLAVAPEPCPQPLRSPSLDNPTPFPNLGPSENPLKRLLVPGEEWEFEVTAFYRGRQVFQQTISCPEGLRLVGSEVGDRTLPGWPVTLPDPGMSLTDRGVMSYVRHVLSCLGGGLALWRAGQWLWAQRLGHCHTYWAVSEELLPNSGHGPDGEVPKDKEGGVFDLGPFIVGCAHVPQGLGRNGPGRGCLLPGEYCGPAHFQQPPTLPHLRPVQGLPAGLGGGHGFPGPWGELSPRSSWCASNPPVPHHLNQ

SEQ ID NO: 41072 - protein, 329 aa, Homo sapiens
  Payload ID: 8353
  Gene Symbol: IRF3
  Gene Name: interferon regulatory factor 3
  ENSP ID: ENSP00000470436
MGTPKPRILPWLVSQLDLGQLEGVAWVNKSRTRFRIPWKHGLRQDAQQEDFGIFQAWAEATGAYVPGRDKPDLPTWKRNFRSALNRKEGLRLAEDRSKDPHDPHKIYEFVNSGVGDFSQPDTSPDTNGGGSTSDTQEDILDELLGNMVLAPLPDPGPPSLAVAPEPCPQPLRSPSLDNPTPFPNLGPSENPLKRLLVPGEEWEFEVTAFYRGRQVFQQTISCPEGLRLVGSEVGDRTLPGWPVTLPDPGMSLTDRGVMSYVRHVLSCLGGGLALWRAGQWLWAQRLGHCHTYWAVSEELLPNSGHGPDGEVPKDKEGGVFDLGPFIVGE

SEQ ID NO: 41073 - protein, 154 aa, Homo sapiens
  Payload ID: 8353
  Gene Symbol: IRF3
  Gene Name: interferon regulatory factor 3
  Uniprot ID: Q14653
  ENSP ID: ENSP00000470512
MVLAPLPDPGPPSLAVAPEPCPQPLRSPSLDNPTPFPNLGPSENPLKRLLVPGEDLITFTEGSGRSPRYALWFCVGESWPQDQPWTKRLVMVKVVPTCLRALVEMARVGGASSLENTVDLHISNSHPLSLTSDQYKAYLQDLVEGMDFQGPGES

SEQ ID NO: 41074 - protein, 102 aa, Homo sapiens
  Payload ID: 8353
  Gene Symbol: IRF3
  Gene Name: interferon regulatory factor 3
  ENSP ID: ENSP00000470905
MGTPKPRILPWLVSQLDLGQLEGVAWVNKSRTRFRIPWKHGLRQDAQQEDFGIFQAWAEATGAYVPGRDKPDLPTWKRNFRSALNRKEGLRLAEDRSKDPHD

SEQ ID NO: 41075 - protein, 300 aa, Homo sapiens
  Payload ID: 8353
  Gene Symbol: IRF3
  Gene Name: interferon regulatory factor 3
  Uniprot ID: Q14653
  ENSP ID: ENSP00000471358
MGTPKPRILPWLVSQLDLGQLEGVAWVNKSRTRFRIPWKHGLRQDAQQEDFGIFQAWAEATGAYVPGRDKPDLPTWKRNFRSALNRKEGLRLAEDRSKDPHDPHKIYEFVNSGVGDFSQPDTSPDTNGGGSTSDTQEDILDELLGNMVLAPLPDPGPPSLAVAPEPCPQPLRSPSLDNPTPFPNLGPSENPLKRLLVPGEDLITFTEGSGRSPRYALWFCVGESWPQDQPWTKRLVMVKVVPTCLRALVEMARVGGASSLENTVDLHISNSHPLSLTSDQYKAYLQDLVEGMDFQGPGES

SEQ ID NO: 41076 - protein, 84 aa, Homo sapiens
  Payload ID: 8353
  Gene Symbol: IRF3
  Gene Name: interferon regulatory factor 3
  ENSP ID: ENSP00000471402
MVLAPLPDPGPPSLAVAPEPCPQPLRSPSLDNPTPFPNLGPSENPLKRLLVPGEEWEFEVTAFYRGRQVFQQTISCPEGLRLVG

SEQ ID NO: 41077 - protein, 105 aa, Homo sapiens
  Payload ID: 8353
  Gene Symbol: IRF3
  Gene Name: interferon regulatory factor 3
  ENSP ID: ENSP00000471517
MVLAPLPDPGPPSLAVAPEPCPQPLRSPSLDNPTPFPNLGPSENPLKRLLVPGEEWEFEVTAFYRGRQVFQQTISCPEGLRLVGSEVGDRTLPGWPVTLPDPGMS

SEQ ID NO: 41078 - protein, 452 aa, Homo sapiens
  Payload ID: 8353
  Gene Symbol: IRF3
  Gene Name: interferon regulatory factor 3
  Uniprot ID: Q14653
  ENSP ID: ENSP00000471896
MGTPKPRILPWLVSQLDLGQLEGVAWVNKSRTRFRIPWKHGLRQDAQQEDFGIFQAWAEATGAYVPGRDKPDLPTWKRNFRSALNRKEGLRLAEDRSKDPHDPHKIYEFVNSGVGDFSQPDTSPDTNGGGSTSDTQEDILDELLGNMVLAPLPDPGPPSLAVAPEPCPQPLRSPSLDNPTPFPNLGPSENPLKRLLVPGEEWEFEVTAFYRGRQVFQQTISCPEGLRLVGSEVGDRTLPGWPVTLPDPGMSLTDRGVMSYVRHVLSCLGGGLALWRAGQWLWAQRLGHCHTYWAVSEELLPNSGHGPDGEVPKDKEGGVFDLGPFIVGSWAPRSDYLHGRKRTLTTLCPLVLCGGVMAPGPAVDQEARDGQGCAHVPQGLGRNGPGRGCLLPGEYCGPAHFQQPPTLPHLRPVQGLPAGLGGGHGFPGPWGELSPRSSWCASNPPVPHHLNQ

SEQ ID NO: 41079 - protein, 287 aa, Homo sapiens
  Payload ID: 8353
  Gene Symbol: IRF3
  Gene Name: interferon regulatory factor 3
  ENSP ID: ENSP00000472223
MGTPKPRILPWLVSQLDLGQLEGVAWVNKSRTRFRIPWKHGLRQDAQQEDFGIFQAWAEATGAYVPGRDKPDLPTWKRNFRSALNRKEGLRLAEDRSKDPHDPHKIYEFVNSGVGDFSQPDTSPDTNGGGSTSDTQEDILDELLGNMVLAPLPDPGPPSLAVAPEPCPQPLRSPSLDNPTPFPNLGPSENPLKRLLVPGEEWEFEVTAFYRGRQVFQQTISCPEGLRLVGSEVGDRTLPGWPVTLPDPGMSLTDRGVMSYVRHVLSCLGGGLALWRAGQWLWAQRLG

SEQ ID NO: 41080 - protein, 281 aa, Homo sapiens; identical to SEQ ID NO: 41063
  Payload ID: 8353
  Gene Symbol: IRF3
  Gene Name: interferon regulatory factor 3
  ENSP ID: ENSP00000472582

SEQ ID NO: 41081 - protein, 281 aa, Homo sapiens; identical to SEQ ID NO: 41063
  Payload ID: 8353
  Gene Symbol: IRF3
  Gene Name: interferon regulatory factor 3
  ENSP ID: ENSP00000472601

SEQ ID NO: 41082 - protein, 154 aa, Homo sapiens; identical to SEQ ID NO: 41073
  Payload ID: 8353
  Gene Symbol: IRF3
  Gene Name: interferon regulatory factor 3
  Uniprot ID: Q14653
  ENSP ID: ENSP00000472700

SEQ ID NO: 41083 - protein, 264 aa, Homo sapiens
  Payload ID: 8353
  Gene Symbol: IRF3
  Gene Name: interferon regulatory factor 3
  ENSP ID: ENSP00000473128
MGTPKPRILPWLVSQLDLGQLEGVAWVNKSRTRFRIPWKHGLRQDAQQEDFGIFQAWAEATGAYVPGRDKPDLPTWKRNFRSALNRKEGLRLAEDRSKDPHDPHKIYEFVNSGVGDFSQPDTSPDTNGGGSTSDTQEDILDELLGNMVLAPLPDPGPPSLAVAPEPCPQPLRSPSLDNPTPFPNLGPSENPLKRLLVPGEDLITFTEGSGRSPRYALWFCVGESWPQDQPWTKRLVMVKVVPTCLRALVEMARVGGASSLENTV

SEQ ID NO: 41084 - protein, 153 aa, Homo sapiens
  Payload ID: 8353
  Gene Symbol: IRF3
  Gene Name: interferon regulatory factor 3
  ENSP ID: ENSP00000473176
MGTPKPRILPWLVSQLDLGQLEGVAWVNKSRTRFRIPWKHGLRQDAQQEDFGIFQAWAEATGAYVPGRDKPDLPTWKRNFRSALNRKEGLRLAEDRSKDPHDPHKIYEFVNSGVGDFSQPDTSPDTNGGGSTSDTQEDILDELLEWEFEVTAF

SEQ ID NO: 41085 - protein, 71 aa, Homo sapiens
  Payload ID: 8353
  Gene Symbol: IRF3
  Gene Name: interferon regulatory factor 3
  ENSP ID: ENSP00000473232
  MOD_RES (1)..(1): Any amino acid
XHGLRQDAQQEDFGIFQVRATTWDAGNPELRAGRKGLLVGPAEKAEVAREGRARANAGLGRGHWCICSREG

SEQ ID NO: 41086 - protein, 451 aa, Homo sapiens
  Payload ID: 8354
  Gene Symbol: IRF4
  Gene Name: interferon regulatory factor 4
  Uniprot ID: Q15306
  ENSP ID: ENSP00000370343
MNLEGGGRGGEFGMSAVSCGNGKLRQWLIDQIDSGKYPGLVWENEEKSIFRIPWKHAGKQDYNREEDAALFKAWALFKGKFREGIDKPDPPTWKTRLRCALNKSNDFEELVERSQLDISDPYKVYRIVPEGAKKGAKQLTLEDPQMSMSHPYTMTTPYPSLPAQQVHNYMMPPLDRSWRDYVPDQPHPEIPYQCPMTFGPRGHHWQGPACENGCQVTGTFYACAPPESQAPGVPTEPSIRSAEALAFSDCRLHICLYYREILVKELTTSSPEGCRISHGHTYDASNLDQVLFPYPEDNGQRKNIEKLLSHLERGVVLWMAPDGLYAKRLCQSRIYWDGPLALCNDRPNKLERDQTCKLFDTQQFLSELQAFAHHGRSLPRFQVTLCFGEEFPDPQRQRKLITAHVEPLLARQLYYFAQQNSGHFLRGYDLPEHISNPEDYHRSIRHSSIQE

SEQ ID NO: 41087 - protein, 410 aa, Homo sapiens
  Payload ID: 8354
  Gene Symbol: IRF4
  Gene Name: interferon regulatory factor 4
  ENSP ID: ENSP00000436094
MNLEGGGRGGEFGMSAVSCGNGKLRQWLIDQIDSGKYPGLVWENEEKSIFRIPWKHAGKQDYNREEDAALFKAWALFKGKFREGIDKPDPPTWKTRLRCALNKSNDFEELVERSQLDISDPYKVYRIVPEGAKKGAKQLTLEDPQMSMSHPYTMTTPYPSLPAQQVHNYMMPPLDRSWRDYVPDQPHPEIPYQCPMTFGPRGHHWQGPACENGCQVTGTFYACAPPESQAPGVPTEPSIRSAEALAFSDCRLHICLYYREILVKELTTSSPEGCRISHGHTYDASNLDQVLFPYPEDNGQRKNIEKLLSHLERGVVLWMAPDGLYAKRLCQSRIYWDGPLALCNDRPNKLERDQTCKLFDTQQFLSELQAFAHHGRSLPRFQVTLCFGEEFPDPQRQRKLITAHVLRSLA

SEQ ID NO: 41088 - protein, 498 aa, Homo sapiens
  Payload ID: 8355
  Gene Symbol: IRF5
  Gene Name: interferon regulatory factor 5
  Uniprot ID: Q13568
  ENSP ID: ENSP00000249375
MNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDGPRDMPPQPYKIYEVCSNGPAPTDSQPPEDYSFGAGEEEEEEEELQRMLPSLSLTEDVKWPPTLQPPTLRPPTLQPPTLQPPVVLGPPAPDPSPLAPPPGNPAGFRELLSEVLEPGPLPASLPPAGEQLLPDLLISPHMLPLTDLEIKFQYRGRPPRALTISNPHGCRLFYSQLEATQEQVELFGPISLEQVRFPSPEDIPSDKQRFYTNQLLDVLDRGLILQLQGQDLYAIRLCQCKVFWSGPCASAHDSCPNPIQREVKTKLFSLEHFLNELILFQKGQTNTPPPFEIFFCFGEEWPDRKPREKKLITVQVVPVAARLLLEMFSGELSWSADSIRLQISNPDLKDRMVEQFKELHHIWQSQQRLQPVAQAPPGAGLGVGQGPWPMHPAGMQ

SEQ ID NO: 41089 - protein, 514 aa, Homo sapiens
  Payload ID: 8355
  Gene Symbol: IRF5
  Gene Name: interferon regulatory factor 5
  Uniprot ID: Q13568
  ENSP ID: ENSP00000349770
MNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDGPRDMPPQPYKIYEVCSNGPAPTDSQPPEDYSFGAGEEEEEEEELQRMLPSLSLTDAVQSGPHMTPYSLLKEDVKWPPTLQPPTLRPPTLQPPTLQPPVVLGPPAPDPSPLAPPPGNPAGFRELLSEVLEPGPLPASLPPAGEQLLPDLLISPHMLPLTDLEIKFQYRGRPPRALTISNPHGCRLFYSQLEATQEQVELFGPISLEQVRFPSPEDIPSDKQRFYTNQLLDVLDRGLILQLQGQDLYAIRLCQCKVFWSGPCASAHDSCPNPIQREVKTKLFSLEHFLNELILFQKGQTNTPPPFEIFFCFGEEWPDRKPREKKLITVQVVPVAARLLLEMFSGELSWSADSIRLQISNPDLKDRMVEQFKELHHIWQSQQRLQPVAQAPPGAGLGVGQGPWPMHPAGMQ

SEQ ID NO: 41090 - protein, 498 aa, Homo sapiens; identical to SEQ ID NO: 41088
  Payload ID: 8355
  Gene Symbol: IRF5
  Gene Name: interferon regulatory factor 5
  Uniprot ID: Q13568
  ENSP ID: ENSP00000385352

SEQ ID NO: 41091 - protein, 59 aa, Homo sapiens
  Payload ID: 8355
  Gene Symbol: IRF5
  Gene Name: interferon regulatory factor 5
  ENSP ID: ENSP00000417454
MNQSIPVAPTPPRRVRLKPWLVAQVNSCQYPGLQWVNGEKKLFCIPWRHATRHGPSQDG

SEQ ID NO: 41092 - protein, 141 aa, Homo sapiens
  Payload ID: 8355
  Gene Symbol: IRF5
  Gene Name: interferon regulatory factor 5
  ENSP ID: ENSP00000417770
MNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDGPRDMPPQPYKIYEVCSNGPAPTDSQPPEDYSFGAG

SEQ ID NO: 41093 - protein, 151 aa, Homo sapiens
  Payload ID: 8355
  Gene Symbol: IRF5
  Gene Name: interferon regulatory factor 5
  ENSP ID: ENSP00000418037
MNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDGPRDMPPQPYKIYEVCSNGPAPTDSQPPEDYSFGAGEEEEEEEEVS

SEQ ID NO: 41094 - protein, 147 aa, Homo sapiens
  Payload ID: 8355
  Gene Symbol: IRF5
  Gene Name: interferon regulatory factor 5
  Uniprot ID: Q13568
  ENSP ID: ENSP00000418534
MNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDGPRDMPPQPYKIYETPSPLRITLLVQERRRKKRKSCRGCCQA

SEQ ID NO: 41095 - protein, 106 aa, Homo sapiens
  Payload ID: 8355
  Gene Symbol: IRF5
  Gene Name: interferon regulatory factor 5
  ENSP ID: ENSP00000419056
MNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDG

SEQ ID NO: 41096 - protein, 498 aa, Homo sapiens; identical to SEQ ID NO: 41088
  Payload ID: 8355
  Gene Symbol: IRF5
  Gene Name: interferon regulatory factor 5
  Uniprot ID: Q13568
  ENSP ID: ENSP00000419149

SEQ ID NO: 41097 - protein, 412 aa, Homo sapiens
  Payload ID: 8355
  Gene Symbol: IRF5
  Gene Name: interferon regulatory factor 5
  Uniprot ID: Q13568
  ENSP ID: ENSP00000419950
MNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDGPRDMPPQPYKIYEVCSNGPAPTDSQPPEDYSFGAGEEEEEEEELQRMLPSLSLTVTDLEIKFQYRGRPPRALTISNPHGCRLFYSQLEATQEQVELFGPISLEQVRFPSPEDIPSDKQRFYTNQLLDVLDRGLILQLQGQDLYAIRLCQCKVFWSGPCASAHDSCPNPIQREVKTKLFSLEHFLNELILFQKGQTNTPPPFEIFFCFGEEWPDRKPREKKLITVQVVPVAARLLLEMFSGELSWSADSIRLQISNPDLKDRMVEQFKELHHIWQSQQRLQPVAQAPPGAGLGVGQGPWPMHPAGMQ

SEQ ID NO: 41098 - protein, 104 aa, Homo sapiens
  Payload ID: 8355
  Gene Symbol: IRF5
  Gene Name: interferon regulatory factor 5
  ENSP ID: ENSP00000420274
MNQSIPVAPTPPRRVRLKPWLVAQVNSCQYPGLQWVNGEKKLFCIPWRHATRHGPSQDGDNTIFKGLTLSPRLECSGLISAHCSLDLPGSGLGQGDREIHRRRG

SEQ ID NO: 41099 - protein, 157 aa, Homo sapiens
  Payload ID: 8355
  Gene Symbol: IRF5
  Gene Name: interferon regulatory factor 5
  ENSP ID: ENSP00000480058
MNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDGPRDMPPQPYKIYEVCSNGPAPTDSQPPEDYSFGAGEEEEEEEEMQCSLAPT

SEQ ID NO: 41100 - protein, 147 aa, Homo sapiens; identical to SEQ ID NO: 41094
  Payload ID: 8355
  Gene Symbol: IRF5
  Gene Name: interferon regulatory factor 5
  Uniprot ID: Q13568
  ENSP ID: ENSP00000483292

SEQ ID NO: 41101 - protein, 467 aa, Homo sapiens
  Payload ID: 8356
  Gene Symbol: IRF6
  Gene Name: interferon regulatory factor 6
  Uniprot ID: O14896
  ENSP ID: ENSP00000355988
MALHPRRVRLKPWLVAQVDSGLYPGLIWLHRDSKRFQIPWKHATRHSPQQEEENTIFKAWAVETGKYQEGVDDPDPAKWKAQLRCALNKSREFNLMYDGTKEVPMNPVKIYQVCDIPQPQGSIINPGSTGSAPWDEKDNDVDEEDEEDELDQSQHHVPIQDTFPFLNINGSPMAPASVGNCSVGNCSPEAVWPKTEPLEMEVPQAPIQPFYSSPELWISSLPMTDLDIKFQYRGKEYGQTMTVSNPQGCRLFYGDLGPMPDQEELFGPVSLEQVKFPGPEHITNEKQKLFTSKLLDVMDRGLILEVSGHAIYAIRLCQCKVYWSGPCAPSLVAPNLIERQKKVKLFCLETFLSDLIAHQKGQIEKQPPFEIYLCFGEEWPDGKPLERKLILVQVIPVVARMIYEMFSGDFTRSFDSGSVRLQISTPDIKDNIVAQLKQLYRILQTQESWQPMQPTPSMQLPPALPPQ

SEQ ID NO: 41102 - protein, 276 aa, Homo sapiens
  Payload ID: 8356
  Gene Symbol: IRF6
  Gene Name: interferon regulatory factor 6
  ENSP ID: ENSP00000403855
MALHPRRVRLKPWLVAQVDSGLYPGLIWLHRDSKRFQIPWKHATRHSPQQEEENTIFKAWAVETGKYQEGVDDPDPAKWKAQLRCALNKSREFNLMYDGTKEVPMNPVKIYQVCDIPQPQGSIINPGSTGSAPWDEKDNDVDEEDEEDELDQSQHHVPIQDTFPFLNINGSPMAPASVGNCSVGNCSPEAVWPKTEPLEMEVPQAPIQPFYSSPELWISSLPMTDLDIKFQYRGKEYGQTMTVSNPQGCRLFYGDLGPMPDQEELFGPVSLEQVKF

SEQ ID NO: 41103 - protein, 372 aa, Homo sapiens
  Payload ID: 8356
  Gene Symbol: IRF6
  Gene Name: interferon regulatory factor 6
  Uniprot ID: O14896
  ENSP ID: ENSP00000440532
MYDGTKEVPMNPVKIYQVCDIPQPQGSIINPGSTGSAPWDEKDNDVDEEDEEDELDQSQHHVPIQDTFPFLNINGSPMAPASVGNCSVGNCSPEAVWPKTEPLEMEVPQAPIQPFYSSPELWISSLPMTDLDIKFQYRGKEYGQTMTVSNPQGCRLFYGDLGPMPDQEELFGPVSLEQVKFPGPEHITNEKQKLFTSKLLDVMDRGLILEVSGHAIYAIRLCQCKVYWSGPCAPSLVAPNLIERQKKVKLFCLETFLSDLIAHQKGQIEKQPPFEIYLCFGEEWPDGKPLERKLILVQVIPVVARMIYEMFSGDFTRSFDSGSVRLQISTPDIKDNIVAQLKQLYRILQTQESWQPMQPTPSMQLPPALPPQ

SEQ ID NO: 41104 - protein, 516 aa, Homo sapiens
  Payload ID: 8357
  Gene Symbol: IRF7
  Gene Name: interferon regulatory factor 7
  Uniprot ID: Q92985
  ENSP ID: ENSP00000329411
MPVPERPAAGPDSPRPGTRRAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFQELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 41105 - protein, 474 aa, Homo sapiens
  Payload ID: 8357
  Gene Symbol: IRF7
  Gene Name: interferon regulatory factor 7
  Uniprot ID: Q92985
  ENSP ID: ENSP00000331803
MALAPERAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFQELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 41106 - protein, 516 aa, Homo sapiens; identical to SEQ ID NO: 41104
  Payload ID: 8357
  Gene Symbol: IRF7
  Gene Name: interferon regulatory factor 7
  Uniprot ID: Q92985
  ENSP ID: ENSP00000380697

SEQ ID NO: 41107 - protein, 487 aa, Homo sapiens
  Payload ID: 8357
  Gene Symbol: IRF7
  Gene Name: interferon regulatory factor 7
  ENSP ID: ENSP00000380700
MPVPERPAAGPDSPRPGTRRAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFQELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 41108 - protein, 503 aa, Homo sapiens
  Payload ID: 8357
  Gene Symbol: IRF7
  Gene Name: interferon regulatory factor 7
  Uniprot ID: Q92985
  ENSP ID: ENSP00000380704
MALAPERAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFQELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 41109 - protein, 177 aa, Homo sapiens
  Payload ID: 8357
  Gene Symbol: IRF7
  Gene Name: interferon regulatory factor 7
  ENSP ID: ENSP00000432403
MPVPERPAAGPDSPRPGTRRAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQAQGSLLGSCTGGQ

SEQ ID NO: 41110 - protein, 164 aa, Homo sapiens
  Payload ID: 8357
  Gene Symbol: IRF7
  Gene Name: interferon regulatory factor 7
  Uniprot ID: Q92985
  ENSP ID: ENSP00000433903
MALAPERAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQAQGSLLGSCTGGQ

SEQ ID NO: 41111 - protein, 397 aa, Homo sapiens
  Payload ID: 8357
  Gene Symbol: IRF7
  Gene Name: interferon regulatory factor 7
  ENSP ID: ENSP00000434009
MLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFQELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 41112 - protein, 135 aa, Homo sapiens
  Payload ID: 8357
  Gene Symbol: IRF7
  Gene Name: interferon regulatory factor 7
  ENSP ID: ENSP00000434524
MALAPERAAPRVLFGEWLLGEISSGCYEGLQWLDEARTCFRVPWKHFARKDLSEADARIFKVGTPAPPRPGWESPPRTPRARHTCSVPLFRPGLWPAAGGRLAAGEVARPPRLRLRSAPAGKPTSAAHCAARVAS

SEQ ID NO: 41113 - protein, 164 aa, Homo sapiens; identical to SEQ ID NO: 41110
  Payload ID: 8357
  Gene Symbol: IRF7
  Gene Name: interferon regulatory factor 7
  Uniprot ID: Q92985
  ENSP ID: ENSP00000434607

SEQ ID NO: 41114 - protein, 185 aa, Homo sapiens
  Payload ID: 8357
  Gene Symbol: IRF7
  Gene Name: interferon regulatory factor 7
  ENSP ID: ENSP00000436696
MALAPERAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWRGPGTDQTEAEAPAAVPPPQARPRPQSPRTRQSRTCHPPQAPAPRCKSPAQGRWT

SEQ ID NO: 41115 - protein, 487 aa, Homo sapiens; identical to SEQ ID NO: 41107
  Payload ID: 8357
  Gene Symbol: IRF7
  Gene Name: interferon regulatory factor 7
  ENSP ID: ENSP00000479277

SEQ ID NO: 41116 - protein, 516 aa, Homo sapiens; identical to SEQ ID NO: 41104
  Payload ID: 8357
  Gene Symbol: IRF7
  Gene Name: interferon regulatory factor 7
  Uniprot ID: Q92985
  ENSP ID: ENSP00000479615

SEQ ID NO: 41117 - protein, 503 aa, Homo sapiens; identical to SEQ ID NO: 41108
  Payload ID: 8357
  Gene Symbol: IRF7
  Gene Name: interferon regulatory factor 7
  Uniprot ID: Q92985
  ENSP ID: ENSP00000480358

SEQ ID NO: 41118 - protein, 185 aa, Homo sapiens; identical to SEQ ID NO: 41114
  Payload ID: 8357
  Gene Symbol: IRF7
  Gene Name: interferon regulatory factor 7
  ENSP ID: ENSP00000487875

SEQ ID NO: 41119 - protein, 516 aa, Homo sapiens; identical to SEQ ID NO: 41104
  Payload ID: 8357
  Gene Symbol: IRF7
  Gene Name: interferon regulatory factor 7
  Uniprot ID: Q92985
  ENSP ID: ENSP00000488039

SEQ ID NO: 41120 - protein, 397 aa, Homo sapiens; identical to SEQ ID NO: 41111
  Payload ID: 8357
  Gene Symbol: IRF7
  Gene Name: interferon regulatory factor 7
  ENSP ID: ENSP00000488372

SEQ ID NO: 41121 - protein, 164 aa, Homo sapiens; identical to SEQ ID NO: 41110
  Payload ID: 8357
  Gene Symbol: IRF7
  Gene Name: interferon regulatory factor 7
  Uniprot ID: Q92985
  ENSP ID: ENSP00000488581

SEQ ID NO: 41122 - protein, 164 aa, Homo sapiens; identical to SEQ ID NO: 41110
  Payload ID: 8357
  Gene Symbol: IRF7
  Gene Name: interferon regulatory factor 7
  Uniprot ID: Q92985
  ENSP ID: ENSP00000488591

SEQ ID NO: 41123 - protein, 474 aa, Homo sapiens; identical to SEQ ID NO: 41105
  Payload ID: 8357
  Gene Symbol: IRF7
  Gene Name: interferon regulatory factor 7
  Uniprot ID: Q92985
  ENSP ID: ENSP00000488666

SEQ ID NO: 41124 - protein, 426 aa, Homo sapiens
  Payload ID: 8358
  Gene Symbol: IRF8
  Gene Name: interferon regulatory factor 8
  Uniprot ID: Q02556
  ENSP ID: ENSP00000268638
MCDRNGGRRLRQWLIEQIDSSMYPGLIWENEEKSMFRIPWKHAGKQDYNQEVDASIFKAWAVFKGKFKEGDKAEPATWKTRLRCALNKSPDFEEVTDRSQLDISEPYKVYRIVPEEEQKCKLGVATAGCVNEVTEMECGRSEIDELIKEPSVDDYMGMIKRSPSPPEACRSQLLPDWWAQQPSTGVPLVTGYTTYDAHHSAFSQMVISFYYGGKLVGQATTTCPEGCRLSLSQPGLPGTKLYGPEGLELVRFPPADAIPSERQRQVTRKLFGHLERGVLLHSSRQGVFVKRLCQGRVFCSGNAVVCKGRPNKLERDEVVQVFDTSQFFRELQQFYNSQGRLPDGRVVLCFGEEFPDMAPLRSKLILVQIEQLYVRQLAEEAGKSCGAGSVMQAPEEPPPDQVFRMFPDICASHQRSFFRENQQITV

SEQ ID NO: 41125 - protein, 152 aa, Homo sapiens
  Payload ID: 8358
  Gene Symbol: IRF8
  Gene Name: interferon regulatory factor 8
  ENSP ID: ENSP00000455048
  MOD_RES (1)..(1): Any amino acid
XAWAVFKGKFKEGDKAEPATWKTRLRCALNKSPDFEEVTDRSQLDISEPYKVYRIVPEEEQKCKLGVATAGCVNEVTEMECGRSEIDELIKESCSSSITARAGFLTAGWCCALGKSFRIWPPCAPNSFSCRLSSCMSGNWQKRLGRAVEPAL

SEQ ID NO: 41126 - protein, 222 aa, Homo sapiens
  Payload ID: 8358
  Gene Symbol: IRF8
  Gene Name: interferon regulatory factor 8
  ENSP ID: ENSP00000455452
MVISFYYGGKLVGQATTTCPEGCRLSLSQPGLPGTKLYGPEGLELVRFPPADAIPSERQRQVTRKLFGHLERGVLLHSSRQGVFVKRLCQGRVFCSGNAVVCKGRPNKLERDEVVQVFDTSQFFRELQQFYNSQGRLPDGRVVLCFGEEFPDMAPLRSKLILVQIEQLYVRQLAEEAGKSCGAGSVMQAPEEPPPDQVFRMFPDICASHQRSFFRENQQITV

SEQ ID NO: 41127 - protein, 14 aa, Homo sapiens
  Payload ID: 8358
  Gene Symbol: IRF8
  Gene Name: interferon regulatory factor 8
  ENSP ID: ENSP00000455760
MGASWWARPPPPAP

SEQ ID NO: 41128 - protein, 159 aa, Homo sapiens
  Payload ID: 8358
  Gene Symbol: IRF8
  Gene Name: interferon regulatory factor 8
  ENSP ID: ENSP00000455784
MCDRNGGRRLRQWLIEQIDSSMYPGLIWENEEKSMFRIPWKHAGKQDYNQEVDASIFKAWAVFKGKFKEGDKAEPATWKTRLRCALNKSPDFEEVTDRSQLDISEPYKVYRIVPEEEQKCKLGVATAGCVNEVTEMECGRSEIDELIKEPSVDDYMGMI

SEQ ID NO: 41129 - protein, 47 aa, Homo sapiens
  Payload ID: 8358
  Gene Symbol: IRF8
  Gene Name: interferon regulatory factor 8
  ENSP ID: ENSP00000455816
MCDRNGGRRLRQWLIEQIDSSMYPGLIWENEEKSMFRIPWKHAGKQD

SEQ ID NO: 41130 - protein, 220 aa, Homo sapiens
  Payload ID: 8358
  Gene Symbol: IRF8
  Gene Name: interferon regulatory factor 8
  ENSP ID: ENSP00000456395
MVISFYYGGKLVGQATTTCPEGCRLSLSQPGLPGTKLYGPEGLELVRFPPADAIPSERQRQVTRKLFGHLERGVLLHSSRQGVFVKRLCQGRVFCSGNAVVCKGRPNKLERDEVVQVFDTSQFFRELQQFYNSQGRLPDGRVVLCFGEEFPDMAPLRSKLILVQIEQLYVRQLAEEAGKSCGAGSVMQAPEEPPPDQVFRMFPDICASHQRSFFRENQQI

SEQ ID NO: 41131 - protein, 328 aa, Homo sapiens
  Payload ID: 8358
  Gene Symbol: IRF8
  Gene Name: interferon regulatory factor 8
  ENSP ID: ENSP00000456992
MCDRNGGRRLRQWLIEQIDSSMYPGLIWENEEKSMFRIPWKHAGKQDYNQEVDASIFKAWAVFKGKFKEGDKAEPATWKTRLRCALNKSPDFEEVTDRSQLDISEPYKVYRIVPEEEQKCKLGVATAGCVNEVTEMECGRSEIDELIKEPSVDDYMGMIKRSPSPPEACRSQLLPDWWAQQPSTGVPLVTGYTTYDAHHSAFSQMVISFYYGGKLVGQATTTCPEGCRLSLSQPGLPGTKLYGPEGLELVRFPPADAIPSERQRQVTRKLFGHLERGVLLHSSRQGVFVKRLCQGRVFCSGNAVVCKGRPNKLERDEVVQVFDTSQFF

SEQ ID NO: 41132 - protein, 126 aa, Homo sapiens
  Payload ID: 8358
  Gene Symbol: IRF8
  Gene Name: interferon regulatory factor 8
  ENSP ID: ENSP00000458047
MCDRNGGRRLRQWLIEQIDSSMYPGLIWENEEKSMFRIPWKHAGKQDYNQEVDASIFKAWAVFKGKFKEGDKAEPATWKTRLRCALNKSPDFEEVTDRSQLDISEPYKVYRIVPEEEQKCNYPLWA

SEQ ID NO: 41133 - protein, 209 aa, Homo sapiens
  Payload ID: 8359
  Gene Symbol: IRF9
  Gene Name: interferon regulatory factor 9
  ENSP ID: ENSP00000313529
EGDTGGPAVWKTRLRCALNKSSEFKEVPERGRMDVAEPYKVYQLLPPGIVSGQPGTQKVPSKRQHSSVSSERKEEEDAMQNCTLSPSVLQDSLNNEEEGASGGAVHSDIGSSSSSSSPEPQEVTDTTEAPFQGDQRSLEFLLPPEPDLVRYFQGLGPPPKFQVTLNFWEESHGSSHTPQNLITVKMEQAFARYLLEQTPEQQAAILSLV

SEQ ID NO: 41134 - protein, 393 aa, Homo sapiens
  Payload ID: 8359
  Gene Symbol: IRF9
  Gene Name: interferon regulatory factor 9
  Uniprot ID: Q00978
  ENSP ID: ENSP00000380073
MASGRARCTRKLRNWVVEQVESGQFPGVCWDDTAKTMFRIPWKHAGKQDFREDQDAAFFKAWAIFKGKYKEGDTGGPAVWKTRLRCALNKSSEFKEVPERGRMDVAEPYKVYQLLPPGIVSGQPGTQKVPSKRQHSSVSSERKEEEDAMQNCTLSPSVLQDSLNNEEEGASGGAVHSDIGSSSSSSSPEPQEVTDTTEAPFQGDQRSLEFLLPPEPDYSLLLTFIYNGRVVGEAQVQSLDCRLVAEPSGSESSMEQVLFPKPGPLEPTQRLLSQLERGILVASNPRGLFVQRLCPIPISWNAPQAPPGPGPHLLPSNECVELFRTAYFCRDLVRYFQGLGPPPKFQVTLNFWEESHGSSHTPQNLITVKMEQAFARYLLEQTPEQQAAILSLV

SEQ ID NO: 41135 - protein, 353 aa, Homo sapiens
  Payload ID: 8359
  Gene Symbol: IRF9
  Gene Name: interferon regulatory factor 9
  ENSP ID: ENSP00000453534
MDVAEPYKVYQLLPPGIVSGQPGTQKVPSKRQHSSVSSERKEEEDAMQNCTLSPSVLQDSLNNEEEGASGGAVHSDIGSSSSSSSPEPQEVTDTTEAPFQGDQRSLEFLLPPEPDYSLLLTFIYNGRVVGEAQVQSLDCRLVAEPSGSESSMEQVLFPKPGPLEPTQRLLSQLERGILVASNPRGLFVQRLCPIPISWNAPQAPPGPGPHLLPSNECVELFRTAYFCRDPPCSLCMALLRLCVAYPVWPYAQPGSYLAALLQPRQWKRWFRLGQVLSGPGPPTEVPGNTEFLGREPWLQPYSTESYHSEDGAGLCPILAGADSRAAGSHSVPGVEPGGPIFHLTSLFFLSPLK

SEQ ID NO: 41136 - protein, 178 aa, Homo sapiens
  Payload ID: 8359
  Gene Symbol: IRF9
  Gene Name: interferon regulatory factor 9
  ENSP ID: ENSP00000453540
MASGRARCTRKLRNWVVEQVESGQFPGVCWDDTAKTMFRIPWKHAGKQDFREDQDAAFFKAWAIFKGKYKEGDTGGPAVWKTRLRCALNKSSEFKEVPERGRMDVAEPYKVYQLLPPGIVSGQPGTQKVPSKRQHSSVSSERKEEEDAMQNCTLSPSVLQDSLNNLQTQLRPPFKGIR

SEQ ID NO: 41137 - protein, 50 aa, Homo sapiens
  Payload ID: 8359
  Gene Symbol: IRF9
  Gene Name: interferon regulatory factor 9
  ENSP ID: ENSP00000453974
MASGRARCTRKLRNWVVEQVESGQFPGVCWDDTAKTMFRIPWKHAGLGNI

SEQ ID NO: 41138 - protein, 50 aa, Homo sapiens; identical to SEQ ID NO: 41137
  Payload ID: 8359
  Gene Symbol: IRF9
  Gene Name: interferon regulatory factor 9
  ENSP ID: ENSP00000454078

SEQ ID NO: 41139 - protein, 267 aa, Homo sapiens
  Payload ID: 8359
  Gene Symbol: IRF9
  Gene Name: interferon regulatory factor 9
  ENSP ID: ENSP00000454095
MASGRARCTRKLRNWVVEQVESGQFPGVCWDDTAKTMFRIPWKHAGKQDFREDQDAAFFKAWAIFKGKYKEGDTGGPAVWKTRLRCALNKSSEFKEVPERGRMDVAEPYKVYQLLPPGIVSGQPGTQKVPSKRQHSSVSSERKEEEDAMQNCTLSPSVLQDSLNNEEEGASGGAVHSDIGSSSSSSSPEPQEVTDTTEAPFQGDQRSLEFLLPPEPAPGRAVLSPDYSLLLTFIYNGRVVGEAQVQSLDCRLVAEPSGSESSMEQVL

SEQ ID NO: 41140 - protein, 181 aa, Homo sapiens
  Payload ID: 8360
  Gene Symbol: ISG20
  Gene Name: interferon stimulated exonuclease gene 20kDa
  Uniprot ID: Q96AZ6
  ENSP ID: ENSP00000306565
MAGSREVVAMDCEMVGLGPHRESGLARCSLVNVHGAVLYDKFIRPEGEITDYRTRVSGVTPQHMVGATPFAVARLEILQLLKGKLVVGHDLKHDFQALKEDMSGYTIYDTSTDRLLWREAKLDHCRRVSLRVLSERLLHKSIQNSLLGHSSVEDARATMELYQISQRIRARRGLPRLAVSD

SEQ ID NO: 41141 - protein, 87 aa, Homo sapiens
  Payload ID: 8360
  Gene Symbol: ISG20
  Gene Name: interferon stimulated exonuclease gene 20kDa
  ENSP ID: ENSP00000368526
MAGSREVVAMDCEMVGLGPHRESGLARCSLVNVHGAVLYDKFIRPEGEITDYRTRVSGVTPQHMVGATPFAVARLEVPFPSSPTAAE

SEQ ID NO: 41142 - protein, 181 aa, Homo sapiens; identical to SEQ ID NO: 41140
  Payload ID: 8360
  Gene Symbol: ISG20
  Gene Name: interferon stimulated exonuclease gene 20kDa
  Uniprot ID: Q96AZ6
  ENSP ID: ENSP00000453638

SEQ ID NO: 41143 - protein, 155 aa, Homo sapiens
  Payload ID: 8360
  Gene Symbol: ISG20
  Gene Name: interferon stimulated exonuclease gene 20kDa
  ENSP ID: ENSP00000453666
MAGSREVVAMDCEMVGLGPHRESGLARCSLVNVHGAVLYDKFIRPEGEITDYRTRVSGVTPQHMVGATPFAVARLEALKEDMSGYTIYDTSTDRLLWREAKLDHCRRVSLRVLSERLLHKSIQNSLLGHSSVEDARATMELYQISQRIRARRGLP

SEQ ID NO: 41144 - protein, 353 aa, Homo sapiens
  Payload ID: 8361
  Gene Symbol: ISG20L2
  Gene Name: interferon stimulated exonuclease gene 20kDa-like 2
  Uniprot ID: Q9H9L3
  ENSP ID: ENSP00000323424
MSTLLLNLDFGEPPPKKALEGNAKHRNFVKKRRLLERRGFLSKKNQPPSKAPKLHSEPSKKGETPTVDGTWKTPSFPKKKTAASSNGSGQPLDKKAAVSWLTPAPSKKADSVAAKVDLLGEFQSALPKINSHPTRSQKKSSQKKSSKKNHPQKNAPQNSTQAHSENKCSGASQKLPRKMVAIDCEMVGTGPKGHVSSLARCSIVNYNGDVLYDEYILPPCHIVDYRTRWSGIRKQHMVNATPFKIARGQILKILTGKIVVGHAIHNDFKALQYFHPKSLTRDTSHIPPLNRKADCPENATMSLKHLTKKLLNRDIQVGKSGHSSVEDAQATMELYKLVEVEWEEHLARNPPTD

SEQ ID NO: 41145 - protein, 353 aa, Homo sapiens; identical to SEQ ID NO: 41144
  Payload ID: 8361
  Gene Symbol: ISG20L2
  Gene Name: interferon stimulated exonuclease gene 20kDa-like 2
  Uniprot ID: Q9H9L3
  ENSP ID: ENSP00000357202

SEQ ID NO: 41146 - protein, 189 aa, Homo sapiens
  Payload ID: 8362
  Gene Symbol: IFNA1
  Gene Name: interferon, alpha 1
  Uniprot ID: P01562
  ENSP ID: ENSP00000276927
MASPFALLMVLVVLSCKSSCSLGCDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 41147 - protein, 189 aa, Homo sapiens
  Payload ID: 8362
  Gene Symbol: IFNA1
  Gene Name: interferon, alpha 1
  ENSP ID: ENSP00000485003
MALTFYLLVALVVLSYKSFSSLGCDLPQTHSLGNRRALILLAQMRRISPFSCLKDRHDFEFPQEEFDDKQFQKAQAISVLHEMIQQTFNLFSTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 41148 - protein, 189 aa, Homo sapiens
  Payload ID: 8363
  Gene Symbol: IFNA10
  Gene Name: interferon, alpha 10
  Uniprot ID: P01566
  ENSP ID: ENSP00000369566
MALSFSLLMAVLVLSYKSICSLGCDLPQTHSLGNRRALILLGQMGRISPFSCLKDRHDFRIPQEEFDGNQFQKAQAISVLHEMIQQTFNLFSTEDSSAAWEQSLLEKFSTELYQQLNDLEACVIQEVGVEETPLMNEDSILAVRKYFQRITLYLIERKYSPCAWEVVRAEIMRSLSFSTNLQKRLRRKD

SEQ ID NO: 41149 - protein, 189 aa, Homo sapiens
  Payload ID: 8364
  Gene Symbol: IFNA13
  Gene Name: interferon, alpha 13
  Uniprot ID: P01562
  ENSP ID: ENSP00000394494
MASPFALLMALVVLSCKSSCSLGCDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 41150 - protein, 190 aa, Homo sapiens
  Payload ID: 8364
  Gene Symbol: IFNA13
  Gene Name: interferon, alpha 13
  ENSP ID: ENSP00000480467
MMASPFALLMALVVLSCKSSCSLGCDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 41151 - protein, 189 aa, Homo sapiens
  Payload ID: 8365
  Gene Symbol: IFNA14
  Gene Name: interferon, alpha 14
  Uniprot ID: P01570
  ENSP ID: ENSP00000369571
MALPFALMMALVVLSCKSSCSLGCNLSQTHSLNNRRTLMLMAQMRRISPFSCLKDRHDFEFPQEEFDGNQFQKAQAISVLHEMMQQTFNLFSTKNSSAAWDETLLEKFYIELFQQMNDLEACVIQEVGVEETPLMNEDSILAVKKYFQRITLYLMEKKYSPCAWEVVRAEIMRSLSFSTNLQKRLRRKD

SEQ ID NO: 41152 - protein, 189 aa, Homo sapiens
  Payload ID: 8366
  Gene Symbol: IFNA16
  Gene Name: interferon, alpha 16
  Uniprot ID: P05015
  ENSP ID: ENSP00000369564
MALSFSLLMAVLVLSYKSICSLGCDLPQTHSLGNRRALILLAQMGRISHFSCLKDRYDFGFPQEVFDGNQFQKAQAISAFHEMIQQTFNLFSTKDSSAAWDETLLDKFYIELFQQLNDLEACVTQEVGVEEIALMNEDSILAVRKYFQRITLYLMGKKYSPCAWEVVRAEIMRSFSFSTNLQKGLRRKD

SEQ ID NO: 41153 - protein, 189 aa, Homo sapiens
  Payload ID: 8367
  Gene Symbol: IFNA17
  Gene Name: interferon, alpha 17
  Uniprot ID: P01571
  ENSP ID: ENSP00000411940
MALSFSLLMAVLVLSYKSICSLGCDLPQTHSLGNRRALILLAQMGRISPFSCLKDRHDFGLPQEEFDGNQFQKTQAISVLHEMIQQTFNLFSTEDSSAAWEQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 41154 - protein, 188 aa, Homo sapiens
  Payload ID: 8368
  Gene Symbol: IFNA2
  Gene Name: interferon, alpha 2
  Uniprot ID: P01563
  ENSP ID: ENSP00000369554
MALTFALLVALLVLSCKSSCSVGCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 41155 - protein, 189 aa, Homo sapiens
  Payload ID: 8369
  Gene Symbol: IFNA21
  Gene Name: interferon, alpha 21
  Uniprot ID: P01568
  ENSP ID: ENSP00000369574
MALSFSLLMAVLVLSYKSICSLGCDLPQTHSLGNRRALILLAQMGRISPFSCLKDRHDFGFPQEEFDGNQFQKAQAISVLHEMIQQTFNLFSTKDSSATWEQSLLEKFSTELNQQLNDLEACVIQEVGVEETPLMNVDSILAVKKYFQRITLYLTEKKYSPCAWEVVRAEIMRSFSLSKIFQERLRRKE

SEQ ID NO: 41156 - protein, 189 aa, Homo sapiens
  Payload ID: 8370
  Gene Symbol: IFNA4
  Gene Name: interferon, alpha 4
  Uniprot ID: P05014
  ENSP ID: ENSP00000412897
MALSFSLLMAVLVLSYKSICSLGCDLPQTHSLGNRRALILLAQMGRISHFSCLKDRHDFGFPEEEFDGHQFQKAQAISVLHEMIQQTFNLFSTEDSSAAWEQSLLEKFSTELYQQLNDLEACVIQEVGVEETPLMNEDSILAVRKYFQRITLYLTEKKYSPCAWEVVRAEIMRSLSFSTNLQKRLRRKD

SEQ ID NO: 41157 - protein, 189 aa, Homo sapiens
  Payload ID: 8370
  Gene Symbol: IFNA4
  Gene Name: interferon, alpha 4
  ENSP ID: ENSP00000482906
MALSFSLLMAVLVLSYKSICSLGCDLPQTHSLGNRRALILLAQMGRISPFSCLKDRHDFGLPQEEFDGNQFQKAQAISVLHEMIQQTFNLFSTEDSSAAWEQSLLEKFSTELYQQLNDLEACVIQEVGVEETPLMNEDSILAVRKYFQRITLYLTEKKYSPCAWEVVRAEIMRSLSFSTNLQKRLRRKD

SEQ ID NO: 41158 - protein, 189 aa, Homo sapiens
  Payload ID: 8371
  Gene Symbol: IFNA5
  Gene Name: interferon, alpha 5
  Uniprot ID: P01569
  ENSP ID: ENSP00000484479
MALPFVLLMALVVLNCKSICSLGCDLPQTHSLSNRRTLMIMAQMGRISPFSCLKDRHDFGFPQEEFDGNQFQKAQAISVLHEMIQQTFNLFSTKDSSATWDETLLDKFYTELYQQLNDLEACMMQEVGVEDTPLMNVDSILTVRKYFQRITLYLTEKKYSPCAWEVVRAEIMRSFSLSANLQERLRRKE

SEQ ID NO: 41159 - protein, 190 aa, Homo sapiens
  Payload ID: 8372
  Gene Symbol: IFNA6
  Gene Name: interferon, alpha 6
  ENSP ID: ENSP00000259555
TMALPFALLMALVVLSCKSSCSLDCDLPQTHSLGHRRTMMLLAQMRRISLFSCLKDRHDFRFPQEEFDGNQFQKAEAISVLHEVIQQTFNLFSTKDSSVAWDERLLDKLYTELYQQLNDLEACVMQEVWVGGTPLMNEDSILAVRKYFQRITLYLTEKKYSPCAWEVVRAEIMRSFSSSRNLQERLRRKE

SEQ ID NO: 41160 - protein, 189 aa, Homo sapiens
  Payload ID: 8372
  Gene Symbol: IFNA6
  Gene Name: interferon, alpha 6
  Uniprot ID: P05013
  ENSP ID: ENSP00000369558
MALPFALLMALVVLSCKSSCSLDCDLPQTHSLGHRRTMMLLAQMRRISLFSCLKDRHDFRFPQEEFDGNQFQKAEAISVLHEVIQQTFNLFSTKDSSVAWDERLLDKLYTELYQQLNDLEACVMQEVWVGGTPLMNEDSILAVRKYFQRITLYLTEKKYSPCAWEVVRAEIMRSFSSSRNLQERLRRKE

SEQ ID NO: 41161 - protein, 189 aa, Homo sapiens
  Payload ID: 8373
  Gene Symbol: IFNA7
  Gene Name: interferon, alpha 7
  Uniprot ID: P01567
  ENSP ID: ENSP00000239347
MARSFSLLMVVLVLSYKSICSLGCDLPQTHSLRNRRALILLAQMGRISPFSCLKDRHEFRFPEEEFDGHQFQKTQAISVLHEMIQQTFNLFSTEDSSAAWEQSLLEKFSTELYQQLNDLEACVIQEVGVEETPLMNEDFILAVRKYFQRITLYLMEKKYSPCAWEVVRAEIMRSFSFSTNLKKGLRRKD

SEQ ID NO: 41162 - protein, 189 aa, Homo sapiens
  Payload ID: 8374
  Gene Symbol: IFNA8
  Gene Name: interferon, alpha 8
  Uniprot ID: P32881
  ENSP ID: ENSP00000369553
MALTFYLLVALVVLSYKSFSSLGCDLPQTHSLGNRRALILLAQMRRISPFSCLKDRHDFEFPQEEFDDKQFQKAQAISVLHEMIQQTFNLFSTKDSSAALDETLLDEFYIELDQQLNDLESCVMQEVGVIESPLMYEDSILAVRKYFQRITLYLTEKKYSSCAWEVVRAEIMRSFSLSINLQKRLKSKE

SEQ ID NO: 41163 - protein, 40 aa, Homo sapiens
  Payload ID: 8375
  Gene Symbol: IFI27
  Gene Name: interferon, alpha-inducible protein 27
  ENSP ID: ENSP00000451987
MEASALTSSAVTSVAKVVRVASGSAVVLPLARIATVVIGG

SEQ ID NO: 41164 - protein, 122 aa, Homo sapiens
  Payload ID: 8375
  Gene Symbol: IFI27
  Gene Name: interferon, alpha-inducible protein 27
  ENSP ID: ENSP00000477753
MEASALTSSAVTSVAKVVRVASGSAVVLPLARIATVVIGGVVAMAAVPMVLSAMGFTAAGIASSSIAAKMMSAAAIANGGGVASGSLVATLQSLGATGLSGLTKFILGSIGSAIAAVIARFY

SEQ ID NO: 41165 - protein, 96 aa, Homo sapiens
  Payload ID: 8375
  Gene Symbol: IFI27
  Gene Name: interferon, alpha-inducible protein 27
  ENSP ID: ENSP00000478718
MEASALTSSAVTSVAKVVRVASGSAVVLPLARIATVVIGGVVAMAAVPMVLSAMGFTAAGIASSSIAAKMMSAAAIANGGGVASGSLVATLQSLGA

SEQ ID NO: 41166 - protein, 65 aa, Homo sapiens
  Payload ID: 8375
  Gene Symbol: IFI27
  Gene Name: interferon, alpha-inducible protein 27
  ENSP ID: ENSP00000479250
MEASALTSSAVTSVAKVVRVASGSAVVLPLARIATVVIGGVVAMAAVPMVLSAMGFTAAGIASSS

SEQ ID NO: 41167 - protein, 79 aa, Homo sapiens
  Payload ID: 8375
  Gene Symbol: IFI27
  Gene Name: interferon, alpha-inducible protein 27
  ENSP ID: ENSP00000482635
MAAVPMVLSAMGFTAAGIASSSIAAKMMSAAAIANGGGVASGSLVATLQSLGATGLSGLTKFILGSIGSAIAAVIARFY

SEQ ID NO: 41168 - protein, 119 aa, Homo sapiens
  Payload ID: 8375
  Gene Symbol: IFI27
  Gene Name: interferon, alpha-inducible protein 27
  ENSP ID: ENSP00000482832
MEASALTSSAVTSVAKVVRVASGSAVVLPLARIATVVIGGVAAVPMVLSAMGFTAAGIASSSIAAKMMSAAAIANGGGVASGSLVATLQSLGATGLSGLTKFILGSIGSAIAAVIARFY

SEQ ID NO: 41169 - protein, 110 aa, Homo sapiens
  Payload ID: 8375
  Gene Symbol: IFI27
  Gene Name: interferon, alpha-inducible protein 27
  ENSP ID: ENSP00000483072
  MOD_RES (1)..(1): Any amino acid
XQDCYSCDWRSCGHGGCAHGAQCHGLHCGGNRLVLHSSQDDVRGGHCQWGWSCLGQPCGYSAVTGVSLREMEEGGKEPKPGTVHSGRLSPKQICWVTWGVSSPLGCSLLP

SEQ ID NO: 41170 - protein, 79 aa, Homo sapiens; identical to SEQ ID NO: 41167
  Payload ID: 8375
  Gene Symbol: IFI27
  Gene Name: interferon, alpha-inducible protein 27
  ENSP ID: ENSP00000483291

SEQ ID NO: 41171 - protein, 60 aa, Homo sapiens
  Payload ID: 8375
  Gene Symbol: IFI27
  Gene Name: interferon, alpha-inducible protein 27
  ENSP ID: ENSP00000483404
MEASALTSSAVTSVAKVVRVASGSAVVLPLARIATVVIGGVVAMAAVPMVLSAMGFTAAG

SEQ ID NO: 41172 - protein, 122 aa, Homo sapiens; identical to SEQ ID NO: 41164
  Payload ID: 8375
  Gene Symbol: IFI27
  Gene Name: interferon, alpha-inducible protein 27
  ENSP ID: ENSP00000483430

SEQ ID NO: 41173 - protein, 122 aa, Homo sapiens; identical to SEQ ID NO: 41164
  Payload ID: 8375
  Gene Symbol: IFI27
  Gene Name: interferon, alpha-inducible protein 27
  ENSP ID: ENSP00000483498

SEQ ID NO: 41174 - protein, 122 aa, Homo sapiens; identical to SEQ ID NO: 41164
  Payload ID: 8375
  Gene Symbol: IFI27
  Gene Name: interferon, alpha-inducible protein 27
  ENSP ID: ENSP00000483932

SEQ ID NO: 41175 - protein, 112 aa, Homo sapiens
  Payload ID: 8375
  Gene Symbol: IFI27
  Gene Name: interferon, alpha-inducible protein 27
  ENSP ID: ENSP00000483954
MEASALTSSAVTSVAKVVRVASGSAVVLPLVVAMAAVPMVLSAMGFTAAGIASSSIAAKMMSAAAIANGGGVASGSLVATLQSLGATGLSGLTKFILGSIGSAIAAVIARFY

SEQ ID NO: 41176 - protein, 122 aa, Homo sapiens; identical to SEQ ID NO: 41164
  Payload ID: 8375
  Gene Symbol: IFI27
  Gene Name: interferon, alpha-inducible protein 27
  ENSP ID: ENSP00000484089

SEQ ID NO: 41177 - protein, 119 aa, Homo sapiens; identical to SEQ ID NO: 41168
  Payload ID: 8375
  Gene Symbol: IFI27
  Gene Name: interferon, alpha-inducible protein 27
  ENSP ID: ENSP00000484970

SEQ ID NO: 41178 - protein, 65 aa, Homo sapiens; identical to SEQ ID NO: 41166
  Payload ID: 8375
  Gene Symbol: IFI27
  Gene Name: interferon, alpha-inducible protein 27
  ENSP ID: ENSP00000486139

SEQ ID NO: 41179 - protein, 112 aa, Homo sapiens; identical to SEQ ID NO: 41175
  Payload ID: 8375
  Gene Symbol: IFI27
  Gene Name: interferon, alpha-inducible protein 27
  ENSP ID: ENSP00000486224

SEQ ID NO: 41180 - protein, 122 aa, Homo sapiens; identical to SEQ ID NO: 41164
  Payload ID: 8375
  Gene Symbol: IFI27
  Gene Name: interferon, alpha-inducible protein 27
  ENSP ID: ENSP00000486608

SEQ ID NO: 41181 - protein, 60 aa, Homo sapiens; identical to SEQ ID NO: 41171
  Payload ID: 8375
  Gene Symbol: IFI27
  Gene Name: interferon, alpha-inducible protein 27
  ENSP ID: ENSP00000487246

SEQ ID NO: 41182 - protein, 110 aa, Homo sapiens; identical to SEQ ID NO: 41169
  Payload ID: 8375
  Gene Symbol: IFI27
  Gene Name: interferon, alpha-inducible protein 27
  ENSP ID: ENSP00000487416
  MOD_RES (1)..(1): Any amino acid

SEQ ID NO: 41183 - protein, 104 aa, Homo sapiens
  Payload ID: 8376
  Gene Symbol: IFI27L1
  Gene Name: interferon, alpha-inducible protein 27-like 1
  Uniprot ID: Q96BM0
  ENSP ID: ENSP00000376824
MGKESGWDSGRAAVAAVVGGVVAVGTVLVALSAMGFTSVGIAASSIAAKMMSTAAIANGGGVAAGSLVAILQSVGAAGLSVTSKVIGGFAGTALGAWLGSPPSS

SEQ ID NO: 41184 - protein, 50 aa, Homo sapiens
  Payload ID: 8376
  Gene Symbol: IFI27L1
  Gene Name: interferon, alpha-inducible protein 27-like 1
  ENSP ID: ENSP00000450463
MGKESGWDSGRAAVAAVVGGGAAGLSVTSKVIGGFAGTALGAWLGSPPSS

SEQ ID NO: 41185 - protein, 92 aa, Homo sapiens
  Payload ID: 8376
  Gene Symbol: IFI27L1
  Gene Name: interferon, alpha-inducible protein 27-like 1
  ENSP ID: ENSP00000450620
MGKESGWDSGRAAVAAVVGGVVAVGTVLVALSAMGFTSVGIAASSIAAKMMSTAAIANGGGVAAGSLVAILQSVGECSGQDDQSQEMIQPRG

SEQ ID NO: 41186 - protein, 105 aa, Homo sapiens
  Payload ID: 8376
  Gene Symbol: IFI27L1
  Gene Name: interferon, alpha-inducible protein 27-like 1
  ENSP ID: ENSP00000451043
MRDAEGGSPRIRVEAHRGEGANHGKGEWMGLRQGCCSSCGRRSCGCGDCARGAQCHGLHLSRNRRILHSSQDDVYSSHCQRGRSCCWQSGGYSAVSGGSWTLCDI

SEQ ID NO: 41187 - protein, 91 aa, Homo sapiens
  Payload ID: 8376
  Gene Symbol: IFI27L1
  Gene Name: interferon, alpha-inducible protein 27-like 1
  ENSP ID: ENSP00000451459
MVRLDISEGRAAVAAVVGGVVAVGTVLVALSAMGFTSVGIAASSIAAKMMSTAAIANGGGVAAGSLVAILQSVGECSGQDDQSQEMIQPRG

SEQ ID NO: 41188 - protein, 95 aa, Homo sapiens
  Payload ID: 8376
  Gene Symbol: IFI27L1
  Gene Name: interferon, alpha-inducible protein 27-like 1
  ENSP ID: ENSP00000451608
MVRLDISEGRAAVAAVVGGVVAVGTVLVALSAMGFTSVGIAASSIAAKMMSTAAIANGGGVAAGSLVAILQSVGAAGLSVTSKVIGGFAGTALGA

SEQ ID NO: 41189 - protein, 39 aa, Homo sapiens
  Payload ID: 8376
  Gene Symbol: IFI27L1
  Gene Name: interferon, alpha-inducible protein 27-like 1
  ENSP ID: ENSP00000451676
MGKESGWDSGAAGLSVTSKVIGGFAGTALGAWLGSPPSS

SEQ ID NO: 41190 - protein, 104 aa, Homo sapiens; identical to SEQ ID NO: 41183
  Payload ID: 8376
  Gene Symbol: IFI27L1
  Gene Name: interferon, alpha-inducible protein 27-like 1
  Uniprot ID: Q96BM0
  ENSP ID: ENSP00000451851

SEQ ID NO: 41191 - protein, 50 aa, Homo sapiens; identical to SEQ ID NO: 41184
  Payload ID: 8376
  Gene Symbol: IFI27L1
  Gene Name: interferon, alpha-inducible protein 27-like 1
  ENSP ID: ENSP00000451889

SEQ ID NO: 41192 - protein, 93 aa, Homo sapiens
  Payload ID: 8376
  Gene Symbol: IFI27L1
  Gene Name: interferon, alpha-inducible protein 27-like 1
  ENSP ID: ENSP00000452226
MVRLDISEGRAAVAAVVGGVVAVGTVLVALSAMGFTSVGIAASSIAAKMMSTAAIANGGGVAAGSLVAILQSVGAAGLSVTSKVIGGFAGTAL

SEQ ID NO: 41193 - protein, 104 aa, Homo sapiens; identical to SEQ ID NO: 41183
  Payload ID: 8376
  Gene Symbol: IFI27L1
  Gene Name: interferon, alpha-inducible protein 27-like 1
  Uniprot ID: Q96BM0
  ENSP ID: ENSP00000480235

SEQ ID NO: 41194 - protein, 91 aa, Homo sapiens; identical to SEQ ID NO: 41187
  Payload ID: 8376
  Gene Symbol: IFI27L1
  Gene Name: interferon, alpha-inducible protein 27-like 1
  ENSP ID: ENSP00000485767

SEQ ID NO: 41195 - protein, 104 aa, Homo sapiens; identical to SEQ ID NO: 41183
  Payload ID: 8376
  Gene Symbol: IFI27L1
  Gene Name: interferon, alpha-inducible protein 27-like 1
  Uniprot ID: Q96BM0
  ENSP ID: ENSP00000485930

SEQ ID NO: 41196 - protein, 50 aa, Homo sapiens; identical to SEQ ID NO: 41184
  Payload ID: 8376
  Gene Symbol: IFI27L1
  Gene Name: interferon, alpha-inducible protein 27-like 1
  ENSP ID: ENSP00000486527

SEQ ID NO: 41197 - protein, 39 aa, Homo sapiens; identical to SEQ ID NO: 41189
  Payload ID: 8376
  Gene Symbol: IFI27L1
  Gene Name: interferon, alpha-inducible protein 27-like 1
  ENSP ID: ENSP00000486785

SEQ ID NO: 41198 - protein, 50 aa, Homo sapiens; identical to SEQ ID NO: 41184
  Payload ID: 8376
  Gene Symbol: IFI27L1
  Gene Name: interferon, alpha-inducible protein 27-like 1
  ENSP ID: ENSP00000487076

SEQ ID NO: 41199 - protein, 95 aa, Homo sapiens; identical to SEQ ID NO: 41188
  Payload ID: 8376
  Gene Symbol: IFI27L1
  Gene Name: interferon, alpha-inducible protein 27-like 1
  ENSP ID: ENSP00000487181

SEQ ID NO: 41200 - protein, 92 aa, Homo sapiens; identical to SEQ ID NO: 41185
  Payload ID: 8376
  Gene Symbol: IFI27L1
  Gene Name: interferon, alpha-inducible protein 27-like 1
  ENSP ID: ENSP00000487242

SEQ ID NO: 41201 - protein, 93 aa, Homo sapiens; identical to SEQ ID NO: 41192
  Payload ID: 8376
  Gene Symbol: IFI27L1
  Gene Name: interferon, alpha-inducible protein 27-like 1
  ENSP ID: ENSP00000487394

SEQ ID NO: 41202 - protein, 105 aa, Homo sapiens; identical to SEQ ID NO: 41186
  Payload ID: 8376
  Gene Symbol: IFI27L1
  Gene Name: interferon, alpha-inducible protein 27-like 1
  ENSP ID: ENSP00000487514

SEQ ID NO: 41203 - protein, 130 aa, Homo sapiens
  Payload ID: 8377
  Gene Symbol: IFI27L2
  Gene Name: interferon, alpha-inducible protein 27-like 2
  Uniprot ID: Q9H2X8
  ENSP ID: ENSP00000238609
MMKRAAAAAVGGALAVGAVPVVLSAMGFTGAGIAASSIAAKMMSAAAIANGGGVSAGSLVATLQSVGAAGLSTSSNILLASVGSVLGACLGNSPSSSLPAEPEAKEDEARENVPQGEPPKPPLKSEKHEE

SEQ ID NO: 41204 - protein, 105 aa, Homo sapiens
  Payload ID: 8377
  Gene Symbol: IFI27L2
  Gene Name: interferon, alpha-inducible protein 27-like 2
  ENSP ID: ENSP00000451717
MGFTGAGIAASSIAAKMMSAAAIANGGGVSAGSLVATLQSVGAAGLSTSSNILLASVGSVLGACLGNSPSSSLPAEPEAKEDEARENVPQGEPPKPPLKSEKHEE

SEQ ID NO: 41205 - protein, 130 aa, Homo sapiens; identical to SEQ ID NO: 41203
  Payload ID: 8377
  Gene Symbol: IFI27L2
  Gene Name: interferon, alpha-inducible protein 27-like 2
  Uniprot ID: Q9H2X8
  ENSP ID: ENSP00000482521

SEQ ID NO: 41206 - protein, 105 aa, Homo sapiens; identical to SEQ ID NO: 41204
  Payload ID: 8377
  Gene Symbol: IFI27L2
  Gene Name: interferon, alpha-inducible protein 27-like 2
  ENSP ID: ENSP00000487453

SEQ ID NO: 41207 - protein, 138 aa, Homo sapiens
  Payload ID: 8378
  Gene Symbol: IFI6
  Gene Name: interferon, alpha-inducible protein 6
  Uniprot ID: P09912
  ENSP ID: ENSP00000342513
MRQKAVSLFLCYLLLFTCSGVEAGENAGKDAGKKKCSESSDSGSGFWKALTFMAVGGGLAVAGLPALGFTGAGIAANSVAASLMSWSAILNGGGVPAGGLVATLQSLGAGGSSVVIGNIGALMGYATHKYLDSEEDEE

SEQ ID NO: 41208 - protein, 130 aa, Homo sapiens
  Payload ID: 8378
  Gene Symbol: IFI6
  Gene Name: interferon, alpha-inducible protein 6
  Uniprot ID: P09912
  ENSP ID: ENSP00000354736
MRQKAVSLFLCYLLLFTCSGVEAGKKKCSESSDSGSGFWKALTFMAVGGGLAVAGLPALGFTGAGIAANSVAASLMSWSAILNGGGVPAGGLVATLQSLGAGGSSVVIGNIGALMGYATHKYLDSEEDEE

SEQ ID NO: 41209 - protein, 134 aa, Homo sapiens
  Payload ID: 8378
  Gene Symbol: IFI6
  Gene Name: interferon, alpha-inducible protein 6
  Uniprot ID: P09912
  ENSP ID: ENSP00000355152
MRQKAVSLFLCYLLLFTCSGVEAGENAGKKKCSESSDSGSGFWKALTFMAVGGGLAVAGLPALGFTGAGIAANSVAASLMSWSAILNGGGVPAGGLVATLQSLGAGGSSVVIGNIGALMGYATHKYLDSEEDEE

SEQ ID NO: 41210 - protein, 187 aa, Homo sapiens
  Payload ID: 8379
  Gene Symbol: IFNB1
  Gene Name: interferon, beta 1, fibroblast
  Uniprot ID: P01574
  ENSP ID: ENSP00000369581
MTNKCLLQIALLLCFSTTALSMSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 41211 - protein, 208 aa, Homo sapiens
  Payload ID: 8380
  Gene Symbol: IFNE
  Gene Name: interferon, epsilon
  Uniprot ID: Q86WN2
  ENSP ID: ENSP00000418018
MIIKHFFGTVLVLLASTTIFSLDLKLIIFQQRQVNQESLKLLNKLQTLSIQQCLPHRKNFLLPQKSLSPQQYQKGHTLAILHEMLQQIFSLFRANISLDGWEENHTEKFLIQLHQQLEYLEALMGLEAEKLSGTLGSDNLRLQVKMYFRRIHDYLENQDYSTCAWAIVQVEISRCLFFVFSLTEKLSKQGRPLNDMKQELTTEFRSPR

SEQ ID NO: 41212 - protein, 166 aa, Homo sapiens
  Payload ID: 8381
  Gene Symbol: IFNG
  Gene Name: interferon, gamma
  Uniprot ID: P01579
  ENSP ID: ENSP00000229135
MKYTSYILAFQLCIVLGSLGCYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 41213 - protein, 785 aa, Homo sapiens
  Payload ID: 8382
  Gene Symbol: IFI16
  Gene Name: interferon, gamma-inducible protein 16
  Uniprot ID: Q16666
  ENSP ID: ENSP00000295809
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSPSPKTSLSAPPNSSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQRQLPYPSEASTTFPESHLRTPQMPPTTPSSSFFTKKSEDTISKMNDFMRMQILKEGSHFPGPFMTSIGPAESHPHTPQMPPSTPSSSFLTTKSEDTISKMNDFMRMQILKEGSHFPGPFMTSIGPAESHPHTPQMPPSTPSSSFLTTLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLTTINCEEGDKLKLTCFELAPKSGNTGELRSVIHSHIKVIKTRKNKKDILNPDSSMETSPDFFF

SEQ ID NO: 41214 - protein, 243 aa, Homo sapiens [sequence omitted]

SEQ ID NO: 41215 - protein, 729 aa, Homo sapiens
  Payload ID: 8382
  Gene Symbol: IFI16
  Gene Name: interferon, gamma-inducible protein 16
  Uniprot ID: Q16666
  ENSP ID: ENSP00000352740
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQNPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQRQLPYPSEASTTFPESHLRTPQMPPTTPSSSFFTKKSEDTISKMNDFMRMQILKEGSHFPGPFMTSIGPAESHPHTPQMPPSTPSSSFLTTKSEDTISKMNDFMRMQILKEGSHFPGPFMTSIGPAESHPHTPQMPPSTPSSSFLTTLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLTTINCEEGDKLKLTCFELAPKSGNTGELRSVIHSHIKVIKTRKNKKDILNPDSSMETSPDFFF

SEQ ID NO: 41216 - protein, 729 aa, Homo sapiens
  Payload ID: 8382
  Gene Symbol: IFI16
  Gene Name: interferon, gamma-inducible protein 16
  Uniprot ID: Q16666
  ENSP ID: ENSP00000357113
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSPSPKTSLSAPPNSSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQRQLPYPSEASTTFPESHLRTPQMPPTTPSSSFFTKKSEDTISKMNDFMRMQILKEGSHFPGPFMTSIGPAESHPHTPQMPPSTPSSSFLTTLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLTTINCEEGDKLKLTCFELAPKSGNTGELRSVIHSHIKVIKTRKNKKDILNPDSSMETSPDFFF

SEQ ID NO: 41217 - protein, 729 aa, Homo sapiens; identical to SEQ ID NO: 41216
  Payload ID: 8382
  Gene Symbol: IFI16
  Gene Name: interferon, gamma-inducible protein 16
  Uniprot ID: Q16666
  ENSP ID: ENSP00000357114

SEQ ID NO: 41218 - protein, 673 aa, Homo sapiens
  Payload ID: 8382
  Gene Symbol: IFI16
  Gene Name: interferon, gamma-inducible protein 16
  Uniprot ID: Q16666
  ENSP ID: ENSP00000404325
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSPSPKTSLSAPPNSSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQRQLPYPSEASTTFPESHLRTPQMPPTTPSSSFFTKLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLTTINCEEGDKLKLTCFELAPKSGNTGELRSVIHSHIKVIKTRKNKKDILNPDSSMETSPDFFF

SEQ ID NO: 41219 - protein, 167 aa, Homo sapiens
  Payload ID: 8382
  Gene Symbol: IFI16
  Gene Name: interferon, gamma-inducible protein 16
  ENSP ID: ENSP00000406406
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSP

SEQ ID NO: 41220 - protein, 180 aa, Homo sapiens
  Payload ID: 8382
  Gene Symbol: IFI16
  Gene Name: interferon, gamma-inducible protein 16
  ENSP ID: ENSP00000407052
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSPSPKTSLSAPPNSS

SEQ ID NO: 41221 - protein, 74 aa, Homo sapiens
  Payload ID: 8382
  Gene Symbol: IFI16
  Gene Name: interferon, gamma-inducible protein 16
  ENSP ID: ENSP00000456094
MSTAMGRSPSPKTSLSAPPNSSSTENPKTVAKCQVTPRRNVLQKRPVIVKVLSTTKPFEYETPEMEKKIMFHAT

SEQ ID NO: 41222 - protein, 229 aa, Homo sapiens
  Payload ID: 8382
  Gene Symbol: IFI16
  Gene Name: interferon, gamma-inducible protein 16
  ENSP ID: ENSP00000456129
MSTAMGRSPSPKTSLSAPPNSSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQ

SEQ ID NO: 41223 - protein, 83 aa, Homo sapiens
  Payload ID: 8382
  Gene Symbol: IFI16
  Gene Name: interferon, gamma-inducible protein 16
  ENSP ID: ENSP00000458084
MGKKYKNIVLLKGLEVINDYHFRMVKSLLSNDLKLNLKMREEYDKIQIADLMEEKFRGDAGLGKLIKIFEDIPTLEDLAETLK

SEQ ID NO: 41224 - protein, 250 aa, Homo sapiens
  Payload ID: 8383
  Gene Symbol: IFI30
  Gene Name: interferon, gamma-inducible protein 30
  Uniprot ID: P13284
  ENSP ID: ENSP00000384886
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQEQNVSGRWEFKCQHGEEECKFNKVEACVLDELDMELAFLTIVCMEEFEDMERSLPLCLQLYAPGLSPDTIMECAMGDRGMQLMHANAQRTDALQPPHEYVPWVTVNGKPLEDQTQLLTLVCQLYQGKKPDVCPSSTSSLRSVCFK

SEQ ID NO: 41225 - protein, 105 aa, Homo sapiens
  Payload ID: 8383
  Gene Symbol: IFI30
  Gene Name: interferon, gamma-inducible protein 30
  ENSP ID: ENSP00000470527
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQ

SEQ ID NO: 41226 - protein, 207 aa, Homo sapiens
  Payload ID: 8384
  Gene Symbol: IFNK
  Gene Name: interferon, kappa
  Uniprot ID: Q9P0W0
  ENSP ID: ENSP00000276943
MSTKPDMIQKCLWLEILMGIFIAGTLSLDCNLLNVHLRRVTWQNLRHLSSMSNSFPVECLRENIAFELPQEFLQYTQPMKRDIKKAFYEMSLQAFNIFSQHTFKYWKERHLKQIQIGLDQQAEYLNQCLEEDKNENEDMKEMKENEMKPSEARVPQLSSLELRRYFHRIDNFLKEKKYSDCAWEIVRVEIRRCLYYFYKFTALFRRK

SEQ ID NO: 41227 - protein, 200 aa, Homo sapiens
  Payload ID: 8385
  Gene Symbol: IFNL1
  Gene Name: interferon, lambda 1
  Uniprot ID: Q8IU54
  ENSP ID: ENSP00000329991
MAAAWTVVLVTLVLGLAVAGPVPTSKPTTTGKGCHIGRFKSLSPQELASFKKARDALEESLKLKNWSCSSPVFPGNWDLRLLQVRERPVALEAELALTLKVLEAAAGPALEDVLDQPLHTLHHILSQLQACIQPQPTAGPRPRGRLHHWLHRLQEAPKKESAGCLEASVTFNLFRLLTRDLKYVADGNLCLRTSTHPEST

SEQ ID NO: 41228 - protein, 200 aa, Homo sapiens
  Payload ID: 8386
  Gene Symbol: IFNL2
  Gene Name: interferon, lambda 2
  Uniprot ID: Q8IZJ0
  ENSP ID: ENSP00000333639
MKLDMTGDCTPVLVLMAAVLTVTGAVPVARLHGALPDARGCHIAQFKSLSPQELQAFKRAKDALEESLLLKDCRCHSRLFPRTWDLRQLQVRERPMALEAELALTLKVLEATADTDPALVDVLDQPLHTLHHILSQFRACIQPQPTAGPRTRGRLHHWLYRLQEAPKKESPGCLEASVTFNLFRLLTRDLNCVASGDLCV

SEQ ID NO: 41229 - protein, 196 aa, Homo sapiens
  Payload ID: 8387
  Gene Symbol: IFNL3
  Gene Name: interferon, lambda 3
  Uniprot ID: Q8IZI9
  ENSP ID: ENSP00000409000
MTGDCMPVLVLMAAVLTVTGAVPVARLRGALPDARGCHIAQFKSLSPQELQAFKRAKDALEESLLLKDCKCRSRLFPRTWDLRQLQVRERPVALEAELALTLKVLEATADTDPALGDVLDQPLHTLHHILSQLRACIQPQPTAGPRTRGRLHHWLHRLQEAPKKESPGCLEASVTFNLFRLLTRDLNCVASGDLCV

SEQ ID NO: 41230 - protein, 200 aa, Homo sapiens
  Payload ID: 8387
  Gene Symbol: IFNL3
  Gene Name: interferon, lambda 3
  ENSP ID: ENSP00000481633
MKLDMTGDCMPVLVLMAAVLTVTGAVPVARLRGALPDARGCHIAQFKSLSPQELQAFKRAKDALEESLLLKDCKCRSRLFPRTWDLRQLQVRERPVALEAELALTLKVLEATADTDPALGDVLDQPLHTLHHILSQLRACIQPQPTAGPRTRGRLHHWLHRLQEAPKKESPGCLEASVTFNLFRLLTRDLNCVASGDLCV

SEQ ID NO: 41231 - protein, 179 aa, Homo sapiens
  Payload ID: 8388
  Gene Symbol: IFNL4
  Gene Name: interferon, lambda 4 (gene/pseudogene)
  ENSP ID: ENSP00000476098
MRPSVWAAVAAGLWVLCTVIAEGPPALPALALPLAGAPDAGGCQGAEGPLRGRGAELGAAQLLLPPQEGSSAAIVLRSAPPRGPGHRGRPGSAQRPAPLGAAPRRRPDPGAAGGRGEGCGGLPAGTARLLQEGPRGPEEASQTPESGLASVPQSQRGLQPPAPAHVGAPAGCTLWALPL

SEQ ID NO: 41232 - protein, 143 aa, Homo sapiens
  Payload ID: 8388
  Gene Symbol: IFNL4
  Gene Name: interferon, lambda 4 (gene/pseudogene)
  ENSP ID: ENSP00000480679
MRPSVWAAVAAGLWVLCTVIAEGPPALPALALPLAGAPDAGGCQGAEGPLRGRGAELGAAQLLLPPQEGSSAAIASLHPQAHGEPQRFANLSCLAEKPIQTGVGSSGCPEIRARVCGWEGHGQMQRGASSFAFSICLMSHLQL

SEQ ID NO: 41233 - protein, 179 aa, Homo sapiens
  Payload ID: 8388
  Gene Symbol: IFNL4
  Gene Name: interferon, lambda 4 (gene/pseudogene)
  ENSP ID: ENSP00000481371
MRPSVWAAVAAGLWVLCTVIAEAPRRCLLSHYRSLEPRTLAAAKALRDRYEEEALSWGQRNCSFRPRRDPPRPSSCARLRHVARGIADAQAVLSGLHRSELLPGAGPILELLAAAGRDVAACLELARPGSSRKVPGAQKRRHKPRRADSPRCRKASVVFNLLRLLTWELRLAAHSGPCL

SEQ ID NO: 41234 - protein, 107 aa, Homo sapiens
  Payload ID: 8388
  Gene Symbol: IFNL4
  Gene Name: interferon, lambda 4 (gene/pseudogene)
  ENSP ID: ENSP00000489240
MRPSVWAAVAAGLWVLCTVIAEGPPALPALALPLAGAPDAGGCQGAEGPLPAGTARLLQEGPRGPEEASQTPESGLASVPQSQRGLQPPAPAHVGAPAGCTLWALPL

SEQ ID NO: 41235 - protein, 131 aa, Homo sapiens
  Payload ID: 8388
  Gene Symbol: IFNL4
  Gene Name: interferon, lambda 4 (gene/pseudogene)
  ENSP ID: ENSP00000489559
MRPSVWAAVAAGLWVLCTVIAEGPPALPALALPLAGAPDAGGCQGAEGPLRGRGAELGAAQLLLPPQEGSSAAIAAGTARLLQEGPRGPEEASQTPESGLASVPQSQRGLQPPAPAHVGAPAGCTLWALPL

SEQ ID NO: 41236 - protein, 520 aa, Homo sapiens
  Payload ID: 8389
  Gene Symbol: IFNLR1
  Gene Name: interferon, lambda receptor 1
  Uniprot ID: Q8IU57
  ENSP ID: ENSP00000327824
MAGPERWGPLLLCLLQAAPGRPRLAPPQNVTLLSQNFSVYLTWLPGLGNPQDVTYFVAYQSSPTRRRWREVEECAGTKELLCSMMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPEANWAFLVLPSLLILLLVIAAGGVIWKTLMGNPWFQRAKMPRALDFSGHTHPVATFQPSRPESVNDLFLCPQKELTRGVRPTPRVRAPATQQTRWKKDLAEDEEEEDEEDTEDGVSFQPYIEPPSFLGQEHQAPGHSEAGGVDSGRPRAPLVPSEGSSAWDSSDRSWASTVDSSWDRAGSSGYLAEKGPGQGPGGDGHQESLPPPEFSKDSGFLEELPEDNLSSWATWGTLPPEPNLVPGGPPVSLQTLTFCWESSPEEEEEARESEIEDSDAGSWGAESTQRTEDRGRTLGHYMAR

SEQ ID NO: 41237 - protein, 244 aa, Homo sapiens
  Payload ID: 8389
  Gene Symbol: IFNLR1
  Gene Name: interferon, lambda receptor 1
  Uniprot ID: Q8IU57
  ENSP ID: ENSP00000328994
MAGPERWGPLLLCLLQAAPGRPRLAPPQNVTLLSQNFSVYLTWLPGLGNPQDVTYFVAYQSSPTRRRWREVEECAGTKELLCSMMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPGLFWTHTPCGNLSAQQTRVRE

SEQ ID NO: 41238 - protein, 211 aa, Homo sapiens
  Payload ID: 8389
  Gene Symbol: IFNLR1
  Gene Name: interferon, lambda receptor 1
  Uniprot ID: Q8IU57
  ENSP ID: ENSP00000363539
MAGPERWGPLLLCLLQAAPGRPRLAPPQNVTLLSQNFSVYLTWLPGLGNPQDVTYFVAYQSSPTRRRWREVEECAGTKELLCSMMCLKKQDLYNKFKGRVRTVSPSSKSPWVESEYLDYLFEVEPAPPVLVLTQTEEILSANATYQLPPCMPPLDLKYEVAFWKEGAGNKVGSSFPAPRLGPLLHPFLLRFFSPSQPAPAPLLQEVFPVHS

SEQ ID NO: 41239 - protein, 185 aa, Homo sapiens
  Payload ID: 8389
  Gene Symbol: IFNLR1
  Gene Name: interferon, lambda receptor 1
  ENSP ID: ENSP00000363540
MMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPEANWAFLVLPSLLILLLVIAAGGVIWKTLMGNPWFQRAKMPRALV

SEQ ID NO: 41240 - protein, 491 aa, Homo sapiens
  Payload ID: 8389
  Gene Symbol: IFNLR1
  Gene Name: interferon, lambda receptor 1
  Uniprot ID: Q8IU57
  ENSP ID: ENSP00000363542
MAGPERWGPLLLCLLQAAPGRPRLAPPQNVTLLSQNFSVYLTWLPGLGNPQDVTYFVAYQSSPTRRRWREVEECAGTKELLCSMMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPEANWAFLVLPSLLILLLVIAAGGVIWKTLMGNPWFQRAKMPRALELTRGVRPTPRVRAPATQQTRWKKDLAEDEEEEDEEDTEDGVSFQPYIEPPSFLGQEHQAPGHSEAGGVDSGRPRAPLVPSEGSSAWDSSDRSWASTVDSSWDRAGSSGYLAEKGPGQGPGGDGHQESLPPPEFSKDSGFLEELPEDNLSSWATWGTLPPEPNLVPGGPPVSLQTLTFCWESSPEEEEEARESEIEDSDAGSWGAESTQRTEDRGRTLGHYMAR

SEQ ID NO: 41241 - protein, 195 aa, Homo sapiens
  Payload ID: 8390
  Gene Symbol: IFNW1
  Gene Name: interferon, omega 1
  Uniprot ID: P05000
  ENSP ID: ENSP00000369578
MALLFPLLAALVMTSYSPVGSLGCDLPQNHGLLSRNTLVLLHQMRRISPFLCLKDRRDFRFPQEMVKGSQLQKAHVMSVLHEMLQQIFSLFHTERSSAAWNMTLLDQLHTGLHQQLQHLETCLLQVVGEGESAGAISSPALTLRRYFQGIRVYLKEKKYSDCAWEVVRMEIMKSLFLSTNMQERLRSKDRDLGSS

SEQ ID NO: 41242 - protein, 286 aa, Homo sapiens
  Payload ID: 8391
  Gene Symbol: IFI35
  Gene Name: interferon-induced protein 35
  Uniprot ID: P80217
  ENSP ID: ENSP00000394579
MSAPLDAALHALQEEQARLKMRLWDLQQLRKELGDSPKDKVPFSVPKIPLVFRGHTQQDPEVPKSLVSNLRIHCPLLAGSALITFDDPKVAEQVLQQKEHTINMEECRLRVQVQPLELPMVTTIQMSSQLSGRRVLVTGFPASLRLSEEELLDKLEIFFGKTRNGGGDVDVRELLPGSVMLGFARDGVAQRLCQIGQFTVPLGGQQVPLRVSPYVNGEIQKAEIRSQPVPRSVLVLNIPDILDGPELHDVLEIHFQKPTRGGGEVEALTVVPQGQQGLAVFTSESG

SEQ ID NO: 41243 - protein, 288 aa, Homo sapiens
  Payload ID: 8391
  Gene Symbol: IFI35
  Gene Name: interferon-induced protein 35
  Uniprot ID: P80217
  ENSP ID: ENSP00000395590
MSAPLDAALHALQEEQARLKMRLWDLQQLRKELGDSPKDKVPFSVPKIPLVFRGHTQQDPEVPKSLVSNLRIHCPLLAGSALITFDDPKVAEQVLQQKEHTINMEECRLRVQVQPLELPMVTTIQVMMSSQLSGRRVLVTGFPASLRLSEEELLDKLEIFFGKTRNGGGDVDVRELLPGSVMLGFARDGVAQRLCQIGQFTVPLGGQQVPLRVSPYVNGEIQKAEIRSQPVPRSVLVLNIPDILDGPELHDVLEIHFQKPTRGGGEVEALTVVPQGQQGLAVFTSESG

SEQ ID NO: 41244 - protein, 444 aa, Homo sapiens
  Payload ID: 8392
  Gene Symbol: IFI44
  Gene Name: interferon-induced protein 44
  Uniprot ID: Q8TCB0
  ENSP ID: ENSP00000359783
MAVTTRLTWLHEKILQNHFGGKRLSLLYKGSVHGFRNGVLLDRCCNQGPTLTVIYSEDHIIGAYAEESYQEGKYASIILFALQDTKISEWKLGLCTPETLFCCDVTKYNSPTNFQIDGRNRKVIMDLKTMENLGLAQNCTISIQDYEVFRCEDSLDERKIKGVIELRKSLLSALRTYEPYGSLVQQIRILLLGPIGAGKSSFFNSVRSVFQGHVTHQALVGTNTTGISEKYRTYSIRDGKDGKYLPFILCDSLGLSEKEGGLCRDDIFYILNGNIRDRYQFNPMESIKLNHHDYIDSPSLKDRIHCVAFVFDASSIQYFSSQMIVKIKRIRRELVNAGVVHVALLTHVDSMDLITKGDLIEIERCEPVRSKLEEVQRKLGFALSDISVVSNYSSEWELDPVKDVLILSALRRMLWAADDFLEDLPFEQIGNLREEIINCAQGKK

SEQ ID NO: 41245 - protein, 195 aa, Homo sapiens
  Payload ID: 8392
  Gene Symbol: IFI44
  Gene Name: interferon-induced protein 44
  ENSP ID: ENSP00000399477
MDLKTMENLGLAQNCTISIQDYEVFRCEDSLDERKIKGVIELRKSLLSALRTYEPYGSLVQQIRILLLGPIGAGKSSFFNSVRSVFQGHVTHQALVGTNTTGISEKYRTYSIRDGKDGKYLPFILCDSLGLSEKEGGLCRDDIFYILNGNIRDRYQFNPMESIKLNHHDYIDSPSLKDRIHCVAFVFDASSIQYF

SEQ ID NO: 41246 - protein, 76 aa, Homo sapiens
  Payload ID: 8392
  Gene Symbol: IFI44
  Gene Name: interferon-induced protein 44
  ENSP ID: ENSP00000400001
  MOD_RES (1)..(1): Any amino acid
XLSDISVVSNYSSEWELDPVKDVLILSALRRMLWAADDFLEDLPFEQIGRWFGGVEAWKRSGNLREEIINCAQGKK

SEQ ID NO: 41247 - protein, 452 aa, Homo sapiens
  Payload ID: 8393
  Gene Symbol: IFI44L
  Gene Name: interferon-induced protein 44-like
  Uniprot ID: Q53G44
  ENSP ID: ENSP00000359787
MEVTTRLTWNDENHLRKLLGNVSLSLLYKSSVHGGSIEDMVERCSRQGCTITMAYIDYNMIVAFMLGNYINLHESSTEPNDSLWFSLQKKNDTTEIETLLLNTAPKIIDEQLVCRLSKTDIFIICRDNKIYLDKMITRNLKLRFYGHRQYLECEVFRVEGIKDNLDDIKRIIKAREHRNRLLADIRDYRPYADLVSEIRILLVGPVGSGKSSFFNSVKSIFHGHVTGQAVVGSDITSITERYRIYSVKDGKNGKSLPFMLCDTMGLDGAEGAGLCMDDIPHILKGCMPDRYQFNSRKPITPEHSTFITSPSLKDRIHCVAYVLDINSIDNLYSKMLAKVKQVHKEVLNCGIAYVALLTKVDDCSEVLQDNFLNMSRSMTSQSRVMNVHKMLGIPISNILMVGNYASDLELDPMKDILILSALRQMLRAADDFLEDLPLEETGAIERALQPCI

SEQ ID NO: 41248 - protein, 232 aa, Homo sapiens
  Payload ID: 8393
  Gene Symbol: IFI44L
  Gene Name: interferon-induced protein 44-like
  ENSP ID: ENSP00000400784
LSLLYKSSVHGGSIEDMVERCSRQGCTITMAYIDYNMIVAFMLGNYINLHESSTEPNDSLWFSLQKKNDTTEIETLLLNTAPKIIDEQLVCRLSKTDIFIICRDNKIYLDKMITRNLKLRFYGHRQYLECEVFRVEGIKDNLDDIKRIIKAREHRNRLLADIRDYRPYADLVSEIRILLVGPVGSGKSSFFNSVKSIFHGHVTGQAVVGSDITSITERGNPNIQLNAKSNGK

SEQ ID NO: 41249 - protein, 97 aa, Homo sapiens
  Payload ID: 8393
  Gene Symbol: IFI44L
  Gene Name: interferon-induced protein 44-like
  ENSP ID: ENSP00000409914
MEVTTRLTWNDENHLRKLLGNVSLSLLYKSSVHGGSIEDMVERCSRQGCTITMAYIDYNMIVAFMLGNYINLHESSTEPNDSLWFSLQKKNDTTEIE

SEQ ID NO: 41250 - protein, 478 aa, Homo sapiens
  Payload ID: 8394
  Gene Symbol: IFIT1
  Gene Name: interferon-induced protein with tetratricopeptide repeats 1
  Uniprot ID: P09914
  ENSP ID: ENSP00000360869
MSTNGDDHQVKDSLEQLRCHFTWELSIDDDEMPDLENRVLDQIEFLDTKYSVGIHNLLAYVKHLKGQNEEALKSLKEAENLMQEEHDNQANVRSLVTWGNFAWMYYHMGRLAEAQTYLDKVENICKKLSNPFRYRMECPEIDCEEGWALLKCGGKNYERAKACFEKVLEVDPENPESSAGYAISAYRLDGFKLATKNHKPFSLLPLRQAVRLNPDNGYIKVLLALKLQDEGQEAEGEKYIEEALANMSSQTYVFRYAAKFYRRKGSVDKALELLKKALQETPTSVLLHHQIGLCYKAQMIQIKEATKGQPRGQNREKLDKMIRSAIFHFESAVEKKPTFEVAHLDLARMYIEAGNHRKAEENFQKLLCMKPVVEETMQDIHFHYGRFQEFQKKSDVNAIIHYLKAIKIEQASLTRDKSINSLKKLVLRKLRRKALDLESLSLLGFVYKLEGNMNEALEYYERALRLAADFENSVRQGP

SEQ ID NO: 41251 - protein, 447 aa, Homo sapiens
  Payload ID: 8394
  Gene Symbol: IFIT1
  Gene Name: interferon-induced protein with tetratricopeptide repeats 1
  Uniprot ID: P09914
  ENSP ID: ENSP00000441968
MPDLENRVLDQIEFLDTKYSVGIHNLLAYVKHLKGQNEEALKSLKEAENLMQEEHDNQANVRSLVTWGNFAWMYYHMGRLAEAQTYLDKVENICKKLSNPFRYRMECPEIDCEEGWALLKCGGKNYERAKACFEKVLEVDPENPESSAGYAISAYRLDGFKLATKNHKPFSLLPLRQAVRLNPDNGYIKVLLALKLQDEGQEAEGEKYIEEALANMSSQTYVFRYAAKFYRRKGSVDKALELLKKALQETPTSVLLHHQIGLCYKAQMIQIKEATKGQPRGQNREKLDKMIRSAIFHFESAVEKKPTFEVAHLDLARMYIEAGNHRKAEENFQKLLCMKPVVEETMQDIHFHYGRFQEFQKKSDVNAIIHYLKAIKIEQASLTRDKSINSLKKLVLRKLRRKALDLESLSLLGFVYKLEGNMNEALEYYERALRLAADFENSVRQGP

SEQ ID NO: 41252 - protein, 474 aa, Homo sapiens
  Payload ID: 8395
  Gene Symbol: IFIT1B
  Gene Name: interferon-induced protein with tetratricopeptide repeats 1B
  Uniprot ID: Q5T764
  ENSP ID: ENSP00000360874
MSEESDGKLIEDSLIQLRCHFTWKLLIEAPEIPDLENRIWEEIQFLDTKYNVGIHNLLAYVKHLKGQNEEALVSLKKAEDLIQKEHANQADIRSLVTWGNFAWVYYHMGRLAEAQTYLDKVENTCKKFANPSRYRMECPEVDCEEGWALAKCGGKNYERAKTCFEKALEGNPENPEFNTGYAITVYRLDKFNTASGRNKAFSLHVLKRAVRLNPDDVYIRVLLALKLQDEGQEAEGEKYIEEALTSISSQAYVFQYAAKFYRRKGSVDKALELLKMALETTPTSAFLHHQMGLCYRAQMIQIKEATNWQPRGQDRETVDRLVQLAICKFEKTIMLKRTFEMAYVDLAETYAEIGHHRKAEEHFQKGLRMKIFEDQLKQEIHYHYGRFQEHHGKSQDKAITHYLKGLKIEKMSHSREKLLNALEKLAKRCIHQNVRVVESVSLLGLIHKLKGEVSDALLCYERALRLAADLNPIF

SEQ ID NO: 41253 - protein, 472 aa, Homo sapiens
  Payload ID: 8396
  Gene Symbol: IFIT2
  Gene Name: interferon-induced protein with tetratricopeptide repeats 2
  Uniprot ID: P09913
  ENSP ID: ENSP00000360891
MSENNKNSLESSLRQLKCHFTWNLMEGENSLDDFEDKVFYRTEFQNREFKATMCNLLAYLKHLKGQNEAALECLRKAEELIQQEHADQAEIRSLVTWGNYAWVYYHMGRLSDVQIYVDKVKHVCEKFSSPYRIESPELDCEEGWTRLKCGGNQNERAKVCFEKALEKKPKNPEFTSGLAIASYRLDNWPPSQNAIDPLRQAIRLNPDNQYLKVLLALKLHKMREEGEEEGEGEKLVEEALEKAPGVTDVLRSAAKFYRRKDEPDKAIELLKKALEYIPNNAYLHCQIGCCYRAKVFQVMNLRENGMYGKRKLLELIGHAVAHLKKADEANDNLFRVCSILASLHALADQYEDAEYYFQKEFSKELTPVAKQLLHLRYGNFQLYQMKCEDKAIHHFIEGVKINQKSREKEKMKDKLQKIAKMRLSKNGADSEALHVLAFLQELNEKMQQADEDSERGLESGSLIPSASSWNGE

SEQ ID NO: 41254 - protein, 483 aa, Homo sapiens
  Payload ID: 8396
  Gene Symbol: IFIT2
  Gene Name: interferon-induced protein with tetratricopeptide repeats 2
  ENSP ID: ENSP00000484770
MSENNKNSLESSLRQLKCHFTWNLMEGENSLDDFEDKVFYRTEFQNREFKATMCNLLAYLKHLKGQNEAALECLRKAEELIQQEHADQAEIRSLVTWGNYAWVYYHMGRLSDVQIYVDKVKHVCEKFSSPYRIESPELDCEEGWTRLKCGGNQNERAKVCFEKALEKKPKNPEFTSGLAIASYRLDNWPPSQNAIDPLRQAIRLNPDNQYLKVLLALKLHKMREEGEEEGEGEKLVEEALEKAPGVTDVLRSAAKFYRRKDEPDKAIELLKKALEYIPNNAYLHCQIGCCYRAKVFQVMNLRENGMYGKRKLLELIGHAVAHLKKADEANDNLFRVCSILASLHALADQYEDAEYYFQKEFSKELTPVAKQLLHLRYGNFQLYQMKCEDKAIHHFIEGVKINQKSREKEKMKDKLQKIAKMRLSKNGADSEALHVLAFLQELNEKMQQADEDSERGLESGSLIPSASSWNGERIEMWCPLGYC

SEQ ID NO: 41255 - protein, 490 aa, Homo sapiens
  Payload ID: 8397
  Gene Symbol: IFIT3
  Gene Name: interferon-induced protein with tetratricopeptide repeats 3
  Uniprot ID: O14879
  ENSP ID: ENSP00000360876
MSEVTKNSLEKILPQLKCHFTWNLFKEDSVSRDLEDRVCNQIEFLNTEFKATMYNLLAYIKHLDGNNEAALECLRQAEELIQQEHADQAEIRSLVTWGNYAWVYYHLGRLSDAQIYVDKVKQTCKKFSNPYSIEYSELDCEEGWTQLKCGRNERAKVCFEKALEEKPNNPEFSSGLAIAMYHLDNHPEKQFSTDVLKQAIELSPDNQYVKVLLGLKLQKMNKEAEGEQFVEEALEKSPCQTDVLRSAAKFYRRKGDLDKAIELFQRVLESTPNNGYLYHQIGCCYKAKVRQMQNTGESEASGNKEMIEALKQYAMDYSNKALEKGLNPLNAYSDLAEFLETECYQTPFNKEVPDAEKQQSHQRYCNLQKYNGKSEDTAVQHGLEGLSISKKSTDKEEIKDQPQNVSENLLPQNAPNYWYLQGLIHKQNGDLLQAAKCYEKELGRLLRDAPSGIGSIFLSASELEDGSEEMGQGAVSSSPRELLSNSEQLN

SEQ ID NO: 41256 - protein, 490 aa, Homo sapiens; identical to SEQ ID NO: 41255
  Payload ID: 8397
  Gene Symbol: IFIT3
  Gene Name: interferon-induced protein with tetratricopeptide repeats 3
  Uniprot ID: O14879
  ENSP ID: ENSP00000360883

SEQ ID NO: 41257 - protein, 482 aa, Homo sapiens
  Payload ID: 8398
  Gene Symbol: IFIT5
  Gene Name: interferon-induced protein with tetratricopeptide repeats 5
  Uniprot ID: Q13325
  ENSP ID: ENSP00000360860
MSEIRKDTLKAILLELECHFTWNLLKEDIDLFEVEDTIGQQLEFLTTKSRLALYNLLAYVKHLKGQNKDALECLEQAEEIIQQEHSDKEEVRSLVTWGNYAWVYYHMDQLEEAQKYTGKIGNVCKKLSSPSNYKLECPETDCEKGWALLKFGGKYYQKAKAAFEKALEVEPDNPEFNIGYAITVYRLDDSDREGSVKSFSLGPLRKAVTLNPDNSYIKVFLALKLQDVHAEAEGEKYIEEILDQISSQPYVLRYAAKFYRRKNSWNKALELLKKALEVTPTSSFLHHQMGLCYRAQMIQIKKATHNRPKGKDKLKVDELISSAIFHFKAAMERDSMFAFAYTDLANMYAEGGQYSNAEDIFRKALRLENITDDHKHQIHYHYGRFQEFHRKSENTAIHHYLEALKVKDRSPLRTKLTSALKKLSTKRLCHNALDVQSLSALGFVYKLEGEKRQAAEYYEKAQKIDPENAEFLTALCELRLSI

SEQ ID NO: 41258 - protein, 451 aa, Homo sapiens
  Payload ID: 8399
  Gene Symbol: IFRD1
  Gene Name: interferon-related developmental regulator 1
  Uniprot ID: O00458
  ENSP ID: ENSP00000005558
MPKNKKRNTPHRGSSAGGGGSGAAAATAATAGGQHRNVQPFSDEDASIETMSHCSGYSDPSSFAEDGPEVLDEEGTQEDLEYKLKGLIDLTLDKSAKTRQAALEGIKNALASKMLYEFILERRMTLTDSIERCLKKGKSDEQRAAAALASVLCIQLGPGIESEEILKTLGPILKKIICDGSASMQARQTCATCFGVCCFIATDDITELYSTLECLENIFTKSYLKEKDTTVICSTPNTVLHISSLLAWTLLLTICPINEVKKKLEMHFHKLPSLLSCDDVNMRIAAGESLALLFELARGIESDFFYEDMESLTQMLRALATDGNKHRAKVDKRKQRSVFRDVLRAVEERDFPTETIKFGPERMYIDCWVKKHTYDTFKEVLGSGMQYHLQSNEFLRNVFELGPPVMLDAATLKTMKISRFERHLYNSAAFKARTKARSKCRDKRADVGEFF

SEQ ID NO: 41259 - protein, 451 aa, Homo sapiens; identical to SEQ ID NO: 41258
  Payload ID: 8399
  Gene Symbol: IFRD1
  Gene Name: interferon-related developmental regulator 1
  Uniprot ID: O00458
  ENSP ID: ENSP00000384477

SEQ ID NO: 41260 - protein, 30 aa, Homo sapiens
  Payload ID: 8399
  Gene Symbol: IFRD1
  Gene Name: interferon-related developmental regulator 1
  ENSP ID: ENSP00000391379
MPKNKKRNTPHRGSSAGGGGSGAAAATAAT

SEQ ID NO: 41261 - protein, 148 aa, Homo sapiens
  Payload ID: 8399
  Gene Symbol: IFRD1
  Gene Name: interferon-related developmental regulator 1
  ENSP ID: ENSP00000397314
MPKNKKRNTPHRGSSAGGGGSGAAAATAATAGGQHRNVQPFSDEDASIETMSHCSGYSDPSSFAEDGPEVLDEEGTQEDLEYKLKGLIDLTLDKSAKTRQAALEGIKNALASKMLYEFILERRMTLTDSIERCLKKGNALIFESQTYN

SEQ ID NO: 41262 - protein, 40 aa, Homo sapiens
  Payload ID: 8399
  Gene Symbol: IFRD1
  Gene Name: interferon-related developmental regulator 1
  ENSP ID: ENSP00000397592
MSHCSGYSDPSSFAEDGPEVLDEEGTQEDLEYKLKGLIDL

SEQ ID NO: 41263 - protein, 127 aa, Homo sapiens
  Payload ID: 8399
  Gene Symbol: IFRD1
  Gene Name: interferon-related developmental regulator 1
  ENSP ID: ENSP00000402177
MSHCSGYSDPSSFAEDGPEVLDEEGTQEDLEYKLKGLIDLTLDKSAKTRQAALEGIKNALASKMLYEFILERRMTLTDSIERCLKKGKSDEQRAAAALASVLCIQLGPGIESEEILKTLGPILKKII

SEQ ID NO: 41264 - protein, 62 aa, Homo sapiens
  Payload ID: 8399
  Gene Symbol: IFRD1
  Gene Name: interferon-related developmental regulator 1
  ENSP ID: ENSP00000402453
MPKNKKRNTPHRGSSAGGGGSGAAAATAATAGGQHRNVQPFSDEDASIETMSHCSGYSDPSS

SEQ ID NO: 41265 - protein, 90 aa, Homo sapiens
  Payload ID: 8399
  Gene Symbol: IFRD1
  Gene Name: interferon-related developmental regulator 1
  ENSP ID: ENSP00000403203
MHFHKLPSLLSCDDVNMRIAAGESLALLFELARGIESDFFYEDMESLTQMLRALATDGNKHRAKVDKRKQRSVFRDVLRAVEERDFPTET

SEQ ID NO: 41266 - protein, 17 aa, Homo sapiens
  Payload ID: 8399
  Gene Symbol: IFRD1
  Gene Name: interferon-related developmental regulator 1
  ENSP ID: ENSP00000413893
MPKNKKRNTPHRGSSAG

SEQ ID NO: 41267 - protein, 98 aa, Homo sapiens
  Payload ID: 8399
  Gene Symbol: IFRD1
  Gene Name: interferon-related developmental regulator 1
  ENSP ID: ENSP00000435635
VFRDVLRAVEERDFPTETIKFGPERMYIDCWVKKHTYDTFKEVLGSGMQYHLQSNEFLRNVFELGPPVMLDAATLKTMKISRFERFSGLSGVFASQSS

SEQ ID NO: 41268 - protein, 103 aa, Homo sapiens
  Payload ID: 8399
  Gene Symbol: IFRD1
  Gene Name: interferon-related developmental regulator 1
  ENSP ID: ENSP00000437250
MSHCSGYSDPSSFAEDGPEVLDEEGTQEDLEYKLKGLIDLTLDKSAKTRQAALEGIKNALASKMLYEFILERRMTLTDSIERCLKKGKSDEQRAAAALASVLC

SEQ ID NO: 41269 - protein, 401 aa, Homo sapiens
  Payload ID: 8399
  Gene Symbol: IFRD1
  Gene Name: interferon-related developmental regulator 1
  Uniprot ID: O00458
  ENSP ID: ENSP00000439188
MSHCSGYSDPSSFAEDGPEVLDEEGTQEDLEYKLKGLIDLTLDKSAKTRQAALEGIKNALASKMLYEFILERRMTLTDSIERCLKKGKSDEQRAAAALASVLCIQLGPGIESEEILKTLGPILKKIICDGSASMQARQTCATCFGVCCFIATDDITELYSTLECLENIFTKSYLKEKDTTVICSTPNTVLHISSLLAWTLLLTICPINEVKKKLEMHFHKLPSLLSCDDVNMRIAAGESLALLFELARGIESDFFYEDMESLTQMLRALATDGNKHRAKVDKRKQRSVFRDVLRAVEERDFPTETIKFGPERMYIDCWVKKHTYDTFKEVLGSGMQYHLQSNEFLRNVFELGPPVMLDAATLKTMKISRFERHLYNSAAFKARTKARSKCRDKRADVGEFF

SEQ ID NO: 41270 - protein, 401 aa, Homo sapiens; identical to SEQ ID NO: 41269
  Payload ID: 8399
  Gene Symbol: IFRD1
  Gene Name: interferon-related developmental regulator 1
  Uniprot ID: O00458
  ENSP ID: ENSP00000483255

SEQ ID NO: 41271 - protein, 442 aa, Homo sapiens
  Payload ID: 8400
  Gene Symbol: IFRD2
  Gene Name: interferon-related developmental regulator 2
  ENSP ID: ENSP00000392316
MPRARKGNTLRKGGQRRGGGARSSAQADSGSSDDEAASEARSTASECPSLLSTTAEDSLGGDVVDEQGQQEDLEEKLKEYVDCLTDKSAKTRQGALESLRLALASRLLPDFLLERRLTLADALEKCLKKGKGEEQALAAAVLGLLCVQLGPGPKGEELFHSLQPLLVSVLSDSTASPAARLHCASALGLGCYVAAADIQDLVSCLACLESVFSRFYGLGGSSTSPVVPASLHGLLSAALQAWALLLTICPSTQISHILDRQLPRLPQLLSSESVNLRIAAGETIALLFELARDLEEEFVYEDMEALCSVLRTLATDSNKYRAKADRRRQRSTFRAVLHSVEGGECEEEIVRFGFEVLYMDSWARHRIYAAFKEVLGSGMHHHLQNNELLRDIFGLGPVLLLDATALKACKVPRFEKHLYNAAAFKARTKARSRVRDKRADIL

SEQ ID NO: 41272 - protein, 506 aa, Homo sapiens
  Payload ID: 8400
  Gene Symbol: IFRD2
  Gene Name: interferon-related developmental regulator 2
  Uniprot ID: Q12894
  ENSP ID: ENSP00000402849
MAWNSPSRRPVWQGGAPREDGGARGVWLPSSGQVSAQRTGRRLVGLEPTPTGSLTPRPPRPVPGMPRARKGNTLRKGGQRRGGGARSSAQADSGSSDDEAASEARSTASECPSLLSTTAEDSLGGDVVDEQGQQEDLEEKLKEYVDCLTDKSAKTRQGALESLRLALASRLLPDFLLERRLTLADALEKCLKKGKGEEQALAAAVLGLLCVQLGPGPKGEELFHSLQPLLVSVLSDSTASPAARLHCASALGLGCYVAAADIQDLVSCLACLESVFSRFYGLGGSSTSPVVPASLHGLLSAALQAWALLLTICPSTQISHILDRQLPRLPQLLSSESVNLRIAAGETIALLFELARDLEEEFVYEDMEALCSVLRTLATDSNKYRAKADRRRQRSTFRAVLHSVEGGECEEEIVRFGFEVLYMDSWARHRIYAAFKEVLGSGMHHHLQNNELLRDIFGLGPVLLLDATALKACKVPRFEKHLYNAAAFKARTKARSRVRDKRADIL

SEQ ID NO: 41273 - protein, 71 aa, Homo sapiens
  Payload ID: 8400
  Gene Symbol: IFRD2
  Gene Name: interferon-related developmental regulator 2
  ENSP ID: ENSP00000408549
RIYAAFKEVLGSGMHHHLQNNELLRDIFGLGPVLLLDATALKACKHLYNAAAFKARTKARSRVRDKRADIL

SEQ ID NO: 41274 - protein, 74 aa, Homo sapiens
  Payload ID: 8400
  Gene Symbol: IFRD2
  Gene Name: interferon-related developmental regulator 2
  ENSP ID: ENSP00000413726
MPRARKGNTLRKGGQRRGGGARSSAQADSGSSDDEAASEARSTASECPSLLSTTAEDSLVPRPGRVLLRACAWP

SEQ ID NO: 41275 - protein, 170 aa, Homo sapiens
  Payload ID: 8400
  Gene Symbol: IFRD2
  Gene Name: interferon-related developmental regulator 2
  ENSP ID: ENSP00000415448
LASRLLPDFLLERRLTLADALEKCLKKGKGEEQALAAAVLGLLCVQLGPGPKGEELFHSLQPLLVSVLSDSTASPAARLHCASALGLGCYVAAADIQDLVSCLACLESVFSRFYGLGGSSTSPVVPASLHGLLSAALQAWALLLTICPSTQISHILDSCPGCPSSCPVKV

SEQ ID NO: 41276 - protein, 152 aa, Homo sapiens
  Payload ID: 8401
  Gene Symbol: IL1F10
  Gene Name: interleukin 1 family, member 10 (theta)
  Uniprot ID: Q8WWZ1
  ENSP ID: ENSP00000341794
MCSLPMARYYIIKYADQKALYTRDGQLLVGDPVADNCCAEKICILPNRGLARTKVPIFLGIQGGSRCLACVETEEGPSLQLEDVNIEELYKGGEEATRFTFFQSSSGSAFRLEAAAWPGWFLCGPAEPQQPVQLTKESEPSARTKFYFEQSW

SEQ ID NO: 41277 - protein, 152 aa, Homo sapiens; identical to SEQ ID NO: 41276
  Payload ID: 8401
  Gene Symbol: IL1F10
  Gene Name: interleukin 1 family, member 10 (theta)
  Uniprot ID: Q8WWZ1
  ENSP ID: ENSP00000376893

SEQ ID NO: 41278 - protein, 570 aa, Homo sapiens
  Payload ID: 8402
  Gene Symbol: IL1RAP
  Gene Name: interleukin 1 receptor accessory protein
  Uniprot ID: Q9NPH3
  ENSP ID: ENSP00000072516
MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKVPAPRYTVELACGFGATVLLVVILIVVYHVYWLEMVLFYRAHFGTDETILDGKEYDIYVSYARNAEEEEFVLLTLRGVLENEFGYKLCIFDRDSLPGGIVTDETLSFIQKSRRLLVVLSPNYVLQGTQALLELKAGLENMASRGNINVILVQYKAVKETKVKELKRAKTVLTVIKWKGEKSKYPQGRFWKQLQVAMPVKKSPRRSSSDEQGLSYSSLKNV

SEQ ID NO: 41279 - protein, 687 aa, Homo sapiens
  Payload ID: 8402
  Gene Symbol: IL1RAP
  Gene Name: interleukin 1 receptor accessory protein
  Uniprot ID: Q9NPH3
  ENSP ID: ENSP00000314807
MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKVPAPRYTVELACGFGATVLLVVILIVVYHVYWLEMVLFYRAHFGTDETILDGKEYDIYVSYARNAEEEEFVLLTLRGVLENEFGYKLCIFDRDSLPGGNTVEAVFDFIQRSRRMIVVLSPDYVTEKSISMLEFKLGVMCQNSIATKLIVVEYRPLEHPHPGILQLKESVSFVSWKGEKSKHSGSKFWKALRLALPLRSLSASSGWNESCSSQSDISLDHVQRRRSRLKEPPELQSSERAAGSPPAPGTMSKHRGKSSATCRCCVTYCEGENHLRNKSRAEIHNQPQWETHLCKPVPQESETQWIQNGTRLEPPAPQISALALHHFTDLSNNNDFYIL

SEQ ID NO: 41280 - protein, 346 aa, Homo sapiens
  Payload ID: 8402
  Gene Symbol: IL1RAP
  Gene Name: interleukin 1 receptor accessory protein
  Uniprot ID: Q9NPH3
  ENSP ID: ENSP00000345829
MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESASSKIHSGTGLWFWSHSPASGDSHCCLPCLLARDGPILPGSFWNR

SEQ ID NO: 41281 - protein, 356 aa, Homo sapiens
  Payload ID: 8402
  Gene Symbol: IL1RAP
  Gene Name: interleukin 1 receptor accessory protein
  Uniprot ID: Q9NPH3
  ENSP ID: ENSP00000387371
MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKGNRCGQ

SEQ ID NO: 41282 - protein, 113 aa, Homo sapiens
  Payload ID: 8402
  Gene Symbol: IL1RAP
  Gene Name: interleukin 1 receptor accessory protein
  ENSP ID: ENSP00000389149
MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYT

SEQ ID NO: 41283 - protein, 570 aa, Homo sapiens; identical to SEQ ID NO: 41278
  Payload ID: 8402
  Gene Symbol: IL1RAP
  Gene Name: interleukin 1 receptor accessory protein
  Uniprot ID: Q9NPH3
  ENSP ID: ENSP00000390541

SEQ ID NO: 41284 - protein, 215 aa, Homo sapiens
  Payload ID: 8402
  Gene Symbol: IL1RAP
  Gene Name: interleukin 1 receptor accessory protein
  ENSP ID: ENSP00000391899
MKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKGNRCGQ

SEQ ID NO: 41285 - protein, 570 aa, Homo sapiens; identical to SEQ ID NO: 41278
  Payload ID: 8402
  Gene Symbol: IL1RAP
  Gene Name: interleukin 1 receptor accessory protein
  Uniprot ID: Q9NPH3
  ENSP ID: ENSP00000401132

SEQ ID NO: 41286 - protein, 687 aa, Homo sapiens; identical to SEQ ID NO: 41279
  Payload ID: 8402
  Gene Symbol: IL1RAP
  Gene Name: interleukin 1 receptor accessory protein
  Uniprot ID: Q9NPH3
  ENSP ID: ENSP00000408893

SEQ ID NO: 41287 - protein, 356 aa, Homo sapiens; identical to SEQ ID NO: 41281
  Payload ID: 8402
  Gene Symbol: IL1RAP
  Gene Name: interleukin 1 receptor accessory protein
  Uniprot ID: Q9NPH3
  ENSP ID: ENSP00000409352

SEQ ID NO: 41288 - protein, 145 aa, Homo sapiens
  Payload ID: 8402
  Gene Symbol: IL1RAP
  Gene Name: interleukin 1 receptor accessory protein
  ENSP ID: ENSP00000412008
MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLP

SEQ ID NO: 41289 - protein, 570 aa, Homo sapiens; identical to SEQ ID NO: 41278
  Payload ID: 8402
  Gene Symbol: IL1RAP
  Gene Name: interleukin 1 receptor accessory protein
  Uniprot ID: Q9NPH3
  ENSP ID: ENSP00000412053

SEQ ID NO: 41290 - protein, 193 aa, Homo sapiens
  Payload ID: 8402
  Gene Symbol: IL1RAP
  Gene Name: interleukin 1 receptor accessory protein
  ENSP ID: ENSP00000414102
  MOD_RES (1)..(1): Any amino acid
XFIHIGTSKHIEVKTQGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKGNRCGQ

SEQ ID NO: 41291 - protein, 346 aa, Homo sapiens; identical to SEQ ID NO: 41280
  Payload ID: 8402
  Gene Symbol: IL1RAP
  Gene Name: interleukin 1 receptor accessory protein
  Uniprot ID: Q9NPH3
  ENSP ID: ENSP00000416296

SEQ ID NO: 41292 - protein, 437 aa, Homo sapiens
  Payload ID: 8403
  Gene Symbol: IL1RAPL1
  Gene Name: interleukin 1 receptor accessory protein-like 1
  ENSP ID: ENSP00000305200
GDSANLTCRAFFGYSGDVSPLIYWMKGEKFIEDLDENRVWESDIRILKEHLGEQEVSISLIVDSVEEGDLGNYSCYVENGNGRRHASVLLHKRELMYTVELAGGLGAILLLLVCLVTIYKCYKIEIMLFYRNHFGAEELDGDNKDYDAYLSYTKVDPDQWNQETGEEERFALEILPDMLEKHYGYKLFIPDRDLIPTGTYIEDVARCVDQSKRLIIVMTPNYVVRRGWSIFELETRLRNMLVTGEIKVILIECSELRGIMNYQEVEALKHTIKLLTVIKWHGPKCNKLNSKFWKRLQYEMPFKRIEPITHEQALDVSEQGPFGELQTVSAISMAAATSTALATAHPDLRSTFHNTYHSQMRQKHYYRSYEYDVPPTGTLPLTSIGNQHTYCNIPMTLINGQRPQTKSSREQNPDEAHTNSAILPLLPRETSISSVIW

SEQ ID NO: 41293 - protein, 696 aa, Homo sapiens
  Payload ID: 8403
  Gene Symbol: IL1RAPL1
  Gene Name: interleukin 1 receptor accessory protein-like 1
  Uniprot ID: Q9NZN1
  ENSP ID: ENSP00000368278
MKAPIPHLILLYATFTQSLKVVTKRGSADGCTDWSIDIKKYQVLVGEPVRIKCALFYGYIRTNYSLAQSAGLSLMWYKSSGPGDFEEPIAFDGSRMSKEEDSIWFRPTLLQDSGLYACVIRNSTYCMKVSISLTVGENDTGLCYNSKMKYFEKAELSKSKEISCRDIEDFLLPTREPEILWYKECRTKTWRPSIVFKRDTLLIREVREDDIGNYTCELKYGGFVVRRTTELTVTAPLTDKPPKLLYPMESKLTIQETQLGDSANLTCRAFFGYSGDVSPLIYWMKGEKFIEDLDENRVWESDIRILKEHLGEQEVSISLIVDSVEEGDLGNYSCYVENGNGRRHASVLLHKRELMYTVELAGGLGAILLLLVCLVTIYKCYKIEIMLFYRNHFGAEELDGDNKDYDAYLSYTKVDPDQWNQETGEEERFALEILPDMLEKHYGYKLFIPDRDLIPTGTYIEDVARCVDQSKRLIIVMTPNYVVRRGWSIFELETRLRNMLVTGEIKVILIECSELRGIMNYQEVEALKHTIKLLTVIKWHGPKCNKLNSKFWKRLQYEMPFKRIEPITHEQALDVSEQGPFGELQTVSAISMAAATSTALATAHPDLRSTFHNTYHSQMRQKHYYRSYEYDVPPTGTLPLTSIGNQHTYCNIPMTLINGQRPQTKSSREQNPDEAHTNSAILPLLPRETSISSVIW

SEQ ID NO: 41294 - protein, 429 aa, Homo sapiens
  Payload ID: 8404
  Gene Symbol: IL1RAPL2
  Gene Name: interleukin 1 receptor accessory protein-like 2
  ENSP ID: ENSP00000344976
GKPLNIPCKAFFGFSGESGPMIYWMKGEKFIEELAGHIREGEIRLLKEHLGEKEVELALIFDSVVEADLANYTCHVENRNGRKHASVLLRKKDLIYKIELAGGLGAIFLLLVLLVVIYKCYNIELMLFYRQHFGADETNDDNKEYDAYLSYTKVDQDTLDCDNPEEEQFALEVLPDVLEKHYGYKLFIPERDLIPSGTYMEDLTRYVEQSRRLIIVLTPDYILRRGWSIFELESRLHNMLVSGEIKVILIECTELKGKVNCQEVESLKRSIKLLSLIKWKGSKSSKLNSKFWKHLVYEMPIKKKEMLPRCHVLDSAEQGLFGELQPIPSIAMTSTSATLVSSQADLPEFHPSDSMQIRHCCRGYKHEIPATTLPVPSLGNHHTYCNLPLTLLNGQLPLNNTLKDTQEFHRNSSLLPLSSKELSFTSDIW

SEQ ID NO: 41295 - protein, 686 aa, Homo sapiens
  Payload ID: 8404
  Gene Symbol: IL1RAPL2
  Gene Name: interleukin 1 receptor accessory protein-like 2
  Uniprot ID: Q9NP60
  ENSP ID: ENSP00000361663
MKPPFLLALVVCSVVSTNLKMVSKRNSVDGCIDWSVDLKTYMALAGEPVRVKCALFYSYIRTNYSTAQSTGLRLMWYKNKGDLEEPIIFSEVRMSKEEDSIWFHSAEAQDSGFYTCVLRNSTYCMKVSMSLTVAENESGLCYNSRIRYLEKSEVTKRKEISCPDMDDFKKSDQEPDVVWYKECKPKMWRSIIIQKGNALLIQEVQEEDGGNYTCELKYEGKLVRRTTELKVTALLTDKPPKPLFPMENQPSVIDVQLGKPLNIPCKAFFGFSGESGPMIYWMKGEKFIEELAGHIREGEIRLLKEHLGEKEVELALIFDSVVEADLANYTCHVENRNGRKHASVLLRKKDLIYKIELAGGLGAIFLLLVLLVVIYKCYNIELMLFYRQHFGADETNDDNKEYDAYLSYTKVDQDTLDCDNPEEEQFALEVLPDVLEKHYGYKLFIPERDLIPSGTYMEDLTRYVEQSRRLIIVLTPDYILRRGWSIFELESRLHNMLVSGEIKVILIECTELKGKVNCQEVESLKRSIKLLSLIKWKGSKSSKLNSKFWKHLVYEMPIKKKEMLPRCHVLDSAEQGLFGELQPIPSIAMTSTSATLVSSQADLPEFHPSDSMQIRHCCRGYKHEIPATTLPVPSLGNHHTYCNLPLTLLNGQLPLNNTLKDTQEFHRNSSLLPLSSKELSFTSDIW

SEQ ID NO: 41296 - protein, 180 aa, Homo sapiens
  Payload ID: 8405
  Gene Symbol: IL1RN
  Gene Name: interleukin 1 receptor antagonist
  Uniprot ID: P18510
  ENSP ID: ENSP00000259206
MALADLYEEGGGGGGEGEDNADSKETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 41297 - protein, 159 aa, Homo sapiens
  Payload ID: 8405
  Gene Symbol: IL1RN
  Gene Name: interleukin 1 receptor antagonist
  Uniprot ID: P18510
  ENSP ID: ENSP00000329072
MALETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 41298 - protein, 143 aa, Homo sapiens
  Payload ID: 8405
  Gene Symbol: IL1RN
  Gene Name: interleukin 1 receptor antagonist
  Uniprot ID: P18510
  ENSP ID: ENSP00000354816
MQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 41299 - protein, 177 aa, Homo sapiens
  Payload ID: 8405
  Gene Symbol: IL1RN
  Gene Name: interleukin 1 receptor antagonist
  Uniprot ID: P18510
  ENSP ID: ENSP00000387173
MEICRGLRSHLITLLLFLFHSETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 41300 - protein, 143 aa, Homo sapiens; identical to SEQ ID NO: 41298
  Payload ID: 8405
  Gene Symbol: IL1RN
  Gene Name: interleukin 1 receptor antagonist
  Uniprot ID: P18510
  ENSP ID: ENSP00000387210

SEQ ID NO: 41301 - protein, 569 aa, Homo sapiens
  Payload ID: 8406
  Gene Symbol: IL1R1
  Gene Name: interleukin 1 receptor, type I
  Uniprot ID: P14778
  ENSP ID: ENSP00000386380
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLIVMNVAEKHRGNYTCHASYTYLGKQYPITRVIEFITLEENKPTRPVIVSPANETMEVDLGSQIQLICNVTGQLSDIAYWKWNGSVIDEDDPVLGEDYYSVENPANKRRSTLITVLNISEIESRFYKHPFTCFAKNTHGIDAAYIQLIYPVTNFQKHMIGICVTLTVIIVCSVFIYKIFKIDIVLWYRDSCYDFLPIKASDGKTYDAYILYPKTVGEGSTSDCDIFVFKVLPEVLEKQCGYKLFIYGRDDYVGEDIVEVINENVKKSRRLIIILVRETSGFSWLGGSSEEQIAMYNALVQDGIKVVLLELEKIQDYEKMPESIKFIKQKHGAIRWSGDFTQGPQSAKTRFWKNVRYHMPVQRRSPSSKHQLLSPATKEKLQREAHVPLG

SEQ ID NO: 41302 - protein, 447 aa, Homo sapiens
  Payload ID: 8406
  Gene Symbol: IL1R1
  Gene Name: interleukin 1 receptor, type I
  ENSP ID: ENSP00000386478
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLIVMNVAEKHRGNYTCHASYTYLGKQYPITRVIEFITLEENKPTRPVIVSPANETMEVDLGSQIQLICNVTGQLSDIAYWKWNGSVIDEDDPVLGEDYYSVENPANKRRSTLITVLNISEIESRFYKHPFTCFAKNTHGIDAAYIQLIYPVTNFQKHMIGICVTLTVIIVCSVFIYKIFKIDIVLWYRDSCYDFLPIKASDGKTYDAYILYPKTVGEGSTSDCDIFVFKVLPEVLEKQCGYKLFIYGRDDYVGEGMCVMEQSKGLLL

SEQ ID NO: 41303 - protein, 173 aa, Homo sapiens
  Payload ID: 8406
  Gene Symbol: IL1R1
  Gene Name: interleukin 1 receptor, type I
  ENSP ID: ENSP00000386555
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKVAVSRVWATAL

SEQ ID NO: 41304 - protein, 538 aa, Homo sapiens
  Payload ID: 8406
  Gene Symbol: IL1R1
  Gene Name: interleukin 1 receptor, type I
  ENSP ID: ENSP00000386776
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLIVMNVAEKHRGNYTCHASYTYLGKQYPITRVIEFITLEENKPTRPVIVSPANETMEVDLGSQIQLICNVTGQLSDIAYWKWNGSVIDEDDPVLGEDYYSVENPANKRRSTLITVLNISEIESRFYKHPFTCFAKNTHGIDAAYIQLIYPVTNFQKHMIGICVTLTVIIVCSVFIYKIFKIDIVLWYRDSCYDFLPIKVLPEVLEKQCGYKLFIYGRDDYVGEDIVEVINENVKKSRRLIIILVRETSGFSWLGGSSEEQIAMYNALVQDGIKVVLLELEKIQDYEKMPESIKFIKQKHGAIRWSGDFTQGPQSAKTRFWKNVRYHMPVQRRSPSSKHQLLSPATKEKLQREAHVPLG

SEQ ID NO: 41305 - protein, 447 aa, Homo sapiens; identical to SEQ ID NO: 41302
  Payload ID: 8406
  Gene Symbol: IL1R1
  Gene Name: interleukin 1 receptor, type I
  ENSP ID: ENSP00000387131

SEQ ID NO: 41306 - protein, 124 aa, Homo sapiens
  Payload ID: 8406
  Gene Symbol: IL1R1
  Gene Name: interleukin 1 receptor, type I
  ENSP ID: ENSP00000390349
  MOD_RES (1)..(1): Any amino acid
XKCKEREEKIILVSSANEIDVRPCPLNPNEHKGTITWYKDDSKTPVSTEQASRIHQHKEKLWFVPAKVEDSGHYYCVETEDLCALIWSFLKMKIMSYLNYSGIRIANLYFLTIYTLVESKIGSS

SEQ ID NO: 41307 - protein, 114 aa, Homo sapiens
  Payload ID: 8406
  Gene Symbol: IL1R1
  Gene Name: interleukin 1 receptor, type I
  ENSP ID: ENSP00000393296
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFV

SEQ ID NO: 41308 - protein, 80 aa, Homo sapiens
  Payload ID: 8406
  Gene Symbol: IL1R1
  Gene Name: interleukin 1 receptor, type I
  ENSP ID: ENSP00000401646
MKVLLRLICFIALLISSLEADKCKEREEKIILVSSANEIDVRPCPLNPNEHKGTITWYKDDSKTPVSTEQASRIHQHKEK

SEQ ID NO: 41309 - protein, 119 aa, Homo sapiens
  Payload ID: 8406
  Gene Symbol: IL1R1
  Gene Name: interleukin 1 receptor, type I
  ENSP ID: ENSP00000407017
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRIANLYFLTIYTLVESKIGSS

SEQ ID NO: 41310 - protein, 182 aa, Homo sapiens
  Payload ID: 8406
  Gene Symbol: IL1R1
  Gene Name: interleukin 1 receptor, type I
  ENSP ID: ENSP00000408101
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLI

SEQ ID NO: 41311 - protein, 298 aa, Homo sapiens
  Payload ID: 8406
  Gene Symbol: IL1R1
  Gene Name: interleukin 1 receptor, type I
  ENSP ID: ENSP00000410461
MEFFKNENNELPKLQWYKDCKPLLLDNIHFSGVKDRLIVMNVAEKHRGNYTCHASYTYLGKQYPITRVIEFITLEENKPTRPVIVSPANETMEVDLGSQIQLICNVTGQLSDIAYWKWNGSVIDEDDPVLGEDYYSVENPANKRRSTLITVLNISEIESRFYKHPFTCFAKNTHGIDAAYIQLIYPVTNFQKHMIGICVTLTVIIVCSVFIYKIFKIDIVLWYRDSCYDFLPIKASDGKTYDAYILYPKTVGEGSTSDCDIFVFKVLPEVLEKQCGYKLFIYGRDDYVGEDIVEVINE

SEQ ID NO: 41312 - protein, 106 aa, Homo sapiens
  Payload ID: 8406
  Gene Symbol: IL1R1
  Gene Name: interleukin 1 receptor, type I
  ENSP ID: ENSP00000411627
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLR

SEQ ID NO: 41313 - protein, 447 aa, Homo sapiens; identical to SEQ ID NO: 41302
  Payload ID: 8406
  Gene Symbol: IL1R1
  Gene Name: interleukin 1 receptor, type I
  ENSP ID: ENSP00000415366

SEQ ID NO: 41314 - protein, 398 aa, Homo sapiens
  Payload ID: 8407
  Gene Symbol: IL1R2
  Gene Name: interleukin 1 receptor, type II
  Uniprot ID: P27930
  ENSP ID: ENSP00000330959
MLRLYVLVMGVSAFTLQPAAHTGAARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIKKKKEETIPVIISPLKTISASLGSRLTIPCKVFLGTGTPLTTMLWWTANDTHIESAYPGGRVTEGPRQEYSENNENYIEVPLIFDPVTREDLHMDFKCVVHNTLSFQTLRTTVKEASSTFSWGIVLAPLSLAFLVLGGIWMHRRCKHRTGKADGLTVLWPHHQDFQSYPK

SEQ ID NO: 41315 - protein, 398 aa, Homo sapiens; identical to SEQ ID NO: 41314
  Payload ID: 8407
  Gene Symbol: IL1R2
  Gene Name: interleukin 1 receptor, type II
  Uniprot ID: P27930
  ENSP ID: ENSP00000377066

SEQ ID NO: 41316 - protein, 229 aa, Homo sapiens
  Payload ID: 8407
  Gene Symbol: IL1R2
  Gene Name: interleukin 1 receptor, type II
  ENSP ID: ENSP00000408415
MLRLYVLVMGVSAFTLQPAAHTGAARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIK

SEQ ID NO: 41317 - protein, 296 aa, Homo sapiens
  Payload ID: 8407
  Gene Symbol: IL1R2
  Gene Name: interleukin 1 receptor, type II
  Uniprot ID: P27930
  ENSP ID: ENSP00000414611
MLRLYVLVMGVSAFTLQPAAHTGAARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIKKKKEETIPVIISPLKTISASLGSRLTIPCKVFLGTGTPLTTMLWWTANDTHIESAYPGGRVTEGPRQ

SEQ ID NO: 41318 - protein, 556 aa, Homo sapiens
  Payload ID: 8408
  Gene Symbol: IL1RL1
  Gene Name: interleukin 1 receptor-like 1
  Uniprot ID: Q01638
  ENSP ID: ENSP00000233954
MGFWILAILTILMYSTAAKFSKQSWGLENEALIVRCPRQGKPSYTVDWYYSQTNKSIPTQERNRVFASGQLLKFLPAAVADSGIYTCIVRSPTFNRTGYANVTIYKKQSDCNVPDYLMYSTVSGSEKNSKIYCPTIDLYNWTAPLEWFKNCQALQGSRYRAHKSFLVIDNVMTEDAGDYTCKFIHNENGANYSVTATRSFTVKDEQGFSLFPVIGAPAQNEIKEVEIGKNANLTCSACFGKGTQFLAAVLWQLNGTKITDFGEPRIQQEEGQNQSFSNGLACLDMVLRIADVKEEDLLLQYDCLALNLHGLRRHTVRLSRKNPIDHHSIYCIIAVCSVFLMLINVLVIILKMFWIEATLLWRDIAKPYKTRNDGKLYDAYVVYPRNYKSSTDGASRVEHFVHQILPDVLENKCGYTLCIYGRDMLPGEDVVTAVETNIRKSRRHIFILTPQITHNKEFAYEQEVALHCALIQNDAKVILIEMEALSELDMLQAEALQDSLQHLMKVQGTIKWREDHIANKRSLNSKFWKHVRYQMPVPSKIPRKASSLTPLAAQKQ

SEQ ID NO: 41319 - protein, 328 aa, Homo sapiens
  Payload ID: 8408
  Gene Symbol: IL1RL1
  Gene Name: interleukin 1 receptor-like 1
  Uniprot ID: Q01638
  ENSP ID: ENSP00000310371
MGFWILAILTILMYSTAAKFSKQSWGLENEALIVRCPRQGKPSYTVDWYYSQTNKSIPTQERNRVFASGQLLKFLPAAVADSGIYTCIVRSPTFNRTGYANVTIYKKQSDCNVPDYLMYSTVSGSEKNSKIYCPTIDLYNWTAPLEWFKNCQALQGSRYRAHKSFLVIDNVMTEDAGDYTCKFIHNENGANYSVTATRSFTVKDEQGFSLFPVIGAPAQNEIKEVEIGKNANLTCSACFGKGTQFLAAVLWQLNGTKITDFGEPRIQQEEGQNQSFSNGLACLDMVLRIADVKEEDLLLQYDCLALNLHGLRRHTVRLSRKNPSKECF

SEQ ID NO: 41320 - protein, 211 aa, Homo sapiens
  Payload ID: 8408
  Gene Symbol: IL1RL1
  Gene Name: interleukin 1 receptor-like 1
  Uniprot ID: Q01638
  ENSP ID: ENSP00000384822
MYSTVSGSEKNSKIYCPTIDLYNWTAPLEWFKNCQALQGSRYRAHKSFLVIDNVMTEDAGDYTCKFIHNENGANYSVTATRSFTVKDEQGFSLFPVIGAPAQNEIKEVEIGKNANLTCSACFGKGTQFLAAVLWQLNGTKITDFGEPRIQQEEGQNQSFSNGLACLDMVLRIADVKEEDLLLQYDCLALNLHGLRRHTVRLSRKNPSKECF

SEQ ID NO: 41321 - protein, 314 aa, Homo sapiens
  Payload ID: 8408
  Gene Symbol: IL1RL1
  Gene Name: interleukin 1 receptor-like 1
  ENSP ID: ENSP00000386618
MGFWILAILTILMYSTAAKFSKQSWGLENEALIVRCPRQGKPSYTVDWYYSQTNKSIPTQERNRVFASGQLLKFLPAAVADSGIYTCIVRSPTFNRTGYANVTIYKKQSDCNVPDYLMYSTVSGSEKNSKIYCPTIDLYNWTAPLEWFKNCQALQGSRYRAHKSFLVIDNVMTEDAGDYTCKFIHNENGANYSVTATRSFTVKDEQGFSLFPVIGAPAQNEIKEVEIGTQFLAAVLWQLNGTKITDFGEPRIQQEEGQNQSFSNGLACLDMVLRIADVKEEDLLLQYDCLALNLHGLRRHTVRLSRKNPSKECF

SEQ ID NO: 41322 - protein, 259 aa, Homo sapiens
  Payload ID: 8408
  Gene Symbol: IL1RL1
  Gene Name: interleukin 1 receptor-like 1
  Uniprot ID: Q01638
  ENSP ID: ENSP00000391120
MGFWILAILTILMYSTAAKFSKQSWGLENEALIVRCPRQGKPSYTVDWYYSQTNKSIPTQERNRVFASGQLLKFLPAAVADSGIYTCIVRSPTFNRTGYANVTIYKKQSDCNVPDYLMYSTVSGSEKNSKIYCPTIDLYNWTAPLEWFKNCQALQGSRYRAHKSFLVIDNVMTEDAGDYTCKFIHNENGANYSVTATRSFTVKVWCQSFCKLKKSLIFSNTHWIQSLMRGFVMVYYGVHKCCRVVFNLCLQYFQHHQWP

SEQ ID NO: 41323 - protein, 38 aa, Homo sapiens
  Payload ID: 8408
  Gene Symbol: IL1RL1
  Gene Name: interleukin 1 receptor-like 1
  ENSP ID: ENSP00000409437
MGFWILAILTILMYSTAAKFSKQSWGLENEALIVRCPR

SEQ ID NO: 41324 - protein, 575 aa, Homo sapiens
  Payload ID: 8409
  Gene Symbol: IL1RL2
  Gene Name: interleukin 1 receptor-like 2
  Uniprot ID: Q9HB29
  ENSP ID: ENSP00000264257
MWSLLLCGLSIALPLSVTADGCKDIFMKNEILSASQPFAFNCTFPPITSGEVSVTWYKNSSKIPVSKIIQSRIHQDETWILFLPMEWGDSGVYQCVIKGRDSCHRIHVNLTVFEKHWCDTSIGGLPNLSDEYKQILHLGKDDSLTCHLHFPKSCVLGPIKWYKDCNEIKGERFTVLETRLLVSNVSAEDRGNYACQAILTHSGKQYEVLNGITVSITERAGYGGSVPKIIYPKNHSIEVQLGTTLIVDCNVTDTKDNTNLRCWRVNNTLVDDYYDESKRIREGVETHVSFREHNLYTVNITFLEVKMEDYGLPFMCHAGVSTAYIILQLPAPDFRAYLIGGLIALVAVAVSVVYIYNIFKIDIVLWYRSAFHSTETIVDGKLYDAYVLYPKPHKESQRHAVDALVLNILPEVLERQCGYKLFIFGRDEFPGQAVANVIDENVKLCRRLIVIVVPESLGFGLLKNLSEEQIAVYSALIQDGMKVILIELEKIEDYTVMPESIQYIKQKHGAIRWHGDFTEQSQCMKTKFWKTVRYHMPPRRCRPFPPVQLLQHTPCYRTAGPELGSRRKKCTLTTG

SEQ ID NO: 41325 - protein, 172 aa, Homo sapiens
  Payload ID: 8409
  Gene Symbol: IL1RL2
  Gene Name: interleukin 1 receptor-like 2
  ENSP ID: ENSP00000387611
MWSLLLCGLSIALPLSVTADGCKDIFMKNEILSASQPFAFNCTFPPITSGEVSVTWYKNSSKIPVSKIIQSRIHQDETWILFLPMEWGDSGVYQCVIKGRDSCHRIHVNLTVFEKHWCDTSIGGLPNLSDEYKQILHLGKDDSLTCHLHFPKSCVLGPIKWYKDCNEIKGER

SEQ ID NO: 41326 - protein, 457 aa, Homo sapiens
  Payload ID: 8409
  Gene Symbol: IL1RL2
  Gene Name: interleukin 1 receptor-like 2
  Uniprot ID: Q9HB29
  ENSP ID: ENSP00000413348
MTGLVSLSYFPLSTRSCALQSCSPVWGCGPCCSAGCPSPFHCLSQQDCNEIKGERFTVLETRLLVSNVSAEDRGNYACQAILTHSGKQYEVLNGITVSIKRAGYGGSVPKIIYPKNHSIEVQLGTTLIVDCNVTDTKDNTNLRCWRVNNTLVDDYYDESKRIREGVETHVSFREHNLYTVNITFLEVKMEDYGLPFMCHAGVSTAYIILQLPAPDFRAYLIGGLIALVAVAVSVVYIYNIFKIDIVLWYRSAFHSTETIVDGKLYDAYVLYPKPHKESQRHAVDALVLNILPEVLERQCGYKLFIFGRDEFPGQAVANVIDENVKLCRRLIVIVVPESLGFGLLKNLSEEQIAVYSALIQDGMKVILIELEKIEDYTVMPESIQYIKQKHGAIRWHGDFTEQSQCMKTKFWKTVRYHMPPRRCRPFPPVQLLQHTPCYRTAGPELGSRRKKCTLTTG

SEQ ID NO: 41327 - protein, 271 aa, Homo sapiens
  Payload ID: 8410
  Gene Symbol: IL1A
  Gene Name: interleukin 1, alpha
  Uniprot ID: P01583
  ENSP ID: ENSP00000263339
MAKVPDMFEDLKNCYSENEEDSSSIDHLSLNQKSFYHVSYGPLHEGCMDQSVSLSISETSKTSKLTFKESMVVVATNGKVLKKRRLSLSQSITDDDLEAIANDSEEEIIKPRSAPFSFLSNVKYNFMRIIKYEFILNDALNQSIIRANDQYLTAAALHNLDEAVKFDMGAYKSSKDDAKITVILRISKTQLYVTAQDEDQPVLLKEMPEIPKTITGSETNLLFFWETHGTKNYFTSVAHPNLFIATKQDYWVCLAGGPPSITDFQILENQA

SEQ ID NO: 41328 - protein, 269 aa, Homo sapiens
  Payload ID: 8411
  Gene Symbol: IL1B
  Gene Name: interleukin 1, beta
  Uniprot ID: P01584
  ENSP ID: ENSP00000263341
MAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 41329 - protein, 111 aa, Homo sapiens
  Payload ID: 8411
  Gene Symbol: IL1B
  Gene Name: interleukin 1, beta
  ENSP ID: ENSP00000400854
MAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNE

SEQ ID NO: 41330 - protein, 143 aa, Homo sapiens
  Payload ID: 8411
  Gene Symbol: IL1B
  Gene Name: interleukin 1, beta
  ENSP ID: ENSP00000407219
MAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELK

SEQ ID NO: 41331 - protein, 125 aa, Homo sapiens
  Payload ID: 8411
  Gene Symbol: IL1B
  Gene Name: interleukin 1, beta
  ENSP ID: ENSP00000409680
MAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCT

SEQ ID NO: 41332 - protein, 178 aa, Homo sapiens
  Payload ID: 8412
  Gene Symbol: IL10
  Gene Name: interleukin 10
  Uniprot ID: P22301
  ENSP ID: ENSP00000412237
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 41333 - protein, 578 aa, Homo sapiens
  Payload ID: 8413
  Gene Symbol: IL10RA
  Gene Name: interleukin 10 receptor, alpha
  Uniprot ID: Q13651
  ENSP ID: ENSP00000227752
MLPCLVVLLAALLSLRLGSDAHGTELPSPPSVWFEAEFFHHILHWTPIPNQSESTCYEVALLRYGIESWNSISNCSQTLSYDLTAVTLDLYHSNGYRARVRAVDGSRHSNWTVTNTRFSVDEVTLTVGSVNLEIHNGFILGKIQLPRPKMAPANDTYESIFSHFREYEIAIRKVPGNFTFTHKKVKHENFSLLTSGEVGEFCVQVKPSVASRSNKGMWSKEECISLTRQYFTVTNVIIFFAFVLLLSGALAYCLALQLYVRRRKKLPSVLLFKKPSPFIFISQRPSPETQDTIHPLDEEAFLKVSPELKNLDLHGSTDSGFGSTKPSLQTEEPQFLLPDPHPQADRTLGNREPPVLGDSCSSGSSNSTDSGICLQEPSLSPSTGPTWEQQVGSNSRGQDDSGIDLVQNSEGRAGDTQGGSALGHHSPPEPEVPGEEDPAAVAFQGYLRQTRCAEEKATKTGCLEEESPLTDGLGPKFGRCLVDEAGLHPPALAKGYLKQDPLEMTLASSGAPTGQWNQPTEEWSLLALSSCSDLGISDWSFAHDLAPLGCVAAPGGLLGSFNSDLVTLPLISSLQSSE

SEQ ID NO: 41334 - protein, 94 aa, Homo sapiens
  Payload ID: 8413
  Gene Symbol: IL10RA
  Gene Name: interleukin 10 receptor, alpha
  ENSP ID: ENSP00000435317
MLPCLVVLLAALLSLRLGSDAHGTELPSPPSVWFEAEFFHHILHWTPIPNQSESTCYEVALLSDSDSWQCEPRDPQWLHPREDSATQAQDGPRK

SEQ ID NO: 41335 - protein, 88 aa, Homo sapiens
  Payload ID: 8413
  Gene Symbol: IL10RA
  Gene Name: interleukin 10 receptor, alpha
  ENSP ID: ENSP00000436328
MLPCLVVLLAALLSLRLGSDAHVESPGWLALWQSGARVLPYSGKPGSQAHLLWKWKRLKLTGTDGLGRIEKYAQGQTPNPQTSSSTHF

SEQ ID NO: 41336 - protein, 325 aa, Homo sapiens
  Payload ID: 8414
  Gene Symbol: IL10RB
  Gene Name: interleukin 10 receptor, beta
  Uniprot ID: Q08334
  ENSP ID: ENSP00000290200
MAWSLGSWLGGCLLVSALGMVPPPENVRMNSVNFKNILQWESPAFAKGNLTFTAQYLSYRIFQDKCMNTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWSEPVCEQTTHDETVPSWMVAVILMASVFMVCLALLGCFALLWCVYKKTKYAFSPRNSLPQHLKEFLGHPHHNTLLFFSFPLSDENDVFDKLSVIAEDSESGKQNPGDSCSLGTPPGQGPQS

SEQ ID NO: 41337 - protein, 216 aa, Homo sapiens
  Payload ID: 8414
  Gene Symbol: IL10RB
  Gene Name: interleukin 10 receptor, beta
  ENSP ID: ENSP00000397611
DKCMNTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWSEPVCEQTTHDETVPSWMVAVILMASVFMVCLALLGCFALLWCVYKKTKYAFSPRNSLPQHLKERNWSDRKEQTE

SEQ ID NO: 41338 - protein, 71 aa, Homo sapiens
  Payload ID: 8414
  Gene Symbol: IL10RB
  Gene Name: interleukin 10 receptor, beta
  ENSP ID: ENSP00000414682
MAWSLGSWLGGCLLVSALGMVPPPENVRMNSVNFKNILQWESPAFAKGNLTFTAQYLSHYWTPWNASRSTC

SEQ ID NO: 41339 - protein, 199 aa, Homo sapiens
  Payload ID: 8415
  Gene Symbol: IL11
  Gene Name: interleukin 11
  Uniprot ID: P20809
  ENSP ID: ENSP00000264563
MNCVCRLVLVVLSLWPDTAVAPGPPPGPPRVSPDPRAELDSTVLLTRSLLADTRQLAAQLRDKFPADGDHNLDSLPTLAMSAGALGALQLPGVLTRLRADLLSYLRHVQWLRRAGGSSLKTLEPELGTLQARLDRLLRRLQLLMSRLALPQPPPDPPAPPLAPPSSAWGGIRAAHAILGGLHLTLDWAVRGLLLLKTRL

SEQ ID NO: 41340 - protein, 120 aa, Homo sapiens
  Payload ID: 8415
  Gene Symbol: IL11
  Gene Name: interleukin 11
  Uniprot ID: P20809
  ENSP ID: ENSP00000465705
MSAGALGALQLPGVLTRLRADLLSYLRHVQWLRRAGGSSLKTLEPELGTLQARLDRLLRRLQLLMSRLALPQPPPDPPAPPLAPPSSAWGGIRAAHAILGGLHLTLDWAVRGLLLLKTRL

SEQ ID NO: 41341 - protein, 199 aa, Homo sapiens; identical to SEQ ID NO: 41339
  Payload ID: 8415
  Gene Symbol: IL11
  Gene Name: interleukin 11
  Uniprot ID: P20809
  ENSP ID: ENSP00000467355

SEQ ID NO: 41342 - protein, 40 aa, Homo sapiens
  Payload ID: 8415
  Gene Symbol: IL11
  Gene Name: interleukin 11
  ENSP ID: ENSP00000468663
MSAGALGALQLPGVLTRLRADLLSYLRHVQWLRRAGGSSL

SEQ ID NO: 41343 - protein, 422 aa, Homo sapiens
  Payload ID: 8416
  Gene Symbol: IL11RA
  Gene Name: interleukin 11 receptor, alpha
  Uniprot ID: Q14626
  ENSP ID: ENSP00000326500
MSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISGLPTRYLTSYRKKTVLGADSQRRSPSTGPWPCPQDPLGAARCVVHGAEFWSQYRINVTEVNPLGASTRLLDVSLQSILRPDPPQGLRVESVPGYPRRLRASWTYPASWPCQPHFLLKFRLQYRPAQHPAWSTVEPAGLEEVITDAVAGLPHAVRVSARDFLDAGTWSTWSPEAWGTPSTGTIPKEIPAWGQLHTQPEVEPQVDSPAPPRPSLQPHPRLLDHRDSVEQVAVLASLGILSFLGLVAGALALGLWLRLRRGGKDGSPKPGFLASVIPVDRRPGAPNL

SEQ ID NO: 41344 - protein, 422 aa, Homo sapiens; identical to SEQ ID NO: 41343
  Payload ID: 8416
  Gene Symbol: IL11RA
  Gene Name: interleukin 11 receptor, alpha
  Uniprot ID: Q14626
  ENSP ID: ENSP00000394391

SEQ ID NO: 41345 - protein, 77 aa, Homo sapiens
  Payload ID: 8416
  Gene Symbol: IL11RA
  Gene Name: interleukin 11 receptor, alpha
  ENSP ID: ENSP00000432263
  MOD_RES (1)..(1): Any amino acid
XTPSTGTIPKEIPAWGQLHTQPEVEPQVDSPAPPRPSLQPHPRLLDHRDSVEQVAVLASLGILSFLGLVAGALALGL

SEQ ID NO: 41346 - protein, 139 aa, Homo sapiens
  Payload ID: 8416
  Gene Symbol: IL11RA
  Gene Name: interleukin 11 receptor, alpha
  ENSP ID: ENSP00000450543
MSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISG

SEQ ID NO: 41347 - protein, 422 aa, Homo sapiens; identical to SEQ ID NO: 41343
  Payload ID: 8416
  Gene Symbol: IL11RA
  Gene Name: interleukin 11 receptor, alpha
  Uniprot ID: Q14626
  ENSP ID: ENSP00000450565

SEQ ID NO: 41348 - protein, 270 aa, Homo sapiens
  Payload ID: 8416
  Gene Symbol: IL11RA
  Gene Name: interleukin 11 receptor, alpha
  ENSP ID: ENSP00000450640
MSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISGLPTRYLTSYRKKTVLGADSQRRSPSTGPWPCPQDPLGAARCVVHGAEFWSQYRINVTEVNPLGASTRLLDVSLQSILRPDPPQGLRVESVPGYPRRLRASWTYPASWPCQPHFLLKFRLQYRPAQHPAWST

SEQ ID NO: 41349 - protein, 54 aa, Homo sapiens
  Payload ID: 8416
  Gene Symbol: IL11RA
  Gene Name: interleukin 11 receptor, alpha
  ENSP ID: ENSP00000450707
MSSSCSGLSRVLVAVATALVSASSPCPQAWGPPGTQCPGFGMGSQSCSRDLTLG

SEQ ID NO: 41350 - protein, 167 aa, Homo sapiens
  Payload ID: 8416
  Gene Symbol: IL11RA
  Gene Name: interleukin 11 receptor, alpha
  ENSP ID: ENSP00000451447
MSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISGLPTRYLTSYRKKTVLGADSQRRSPSTGP

SEQ ID NO: 41351 - protein, 68 aa, Homo sapiens
  Payload ID: 8416
  Gene Symbol: IL11RA
  Gene Name: interleukin 11 receptor, alpha
  ENSP ID: ENSP00000451553
MSSSCSGLSRVLVAVATALVSASSPCPQAWGPPGVQYGQPGRSVKLCCPGVTAGPSSPPCCLLPSSRL

SEQ ID NO: 41352 - protein, 152 aa, Homo sapiens
  Payload ID: 8416
  Gene Symbol: IL11RA
  Gene Name: interleukin 11 receptor, alpha
  ENSP ID: ENSP00000452207
MSSSCSGLSRVLVAVATALVSASSPCPQAWGPPDPPARPVVSCQAADYENFSCTWSPSQISGLPTRYLTSYRKKTVLGADSQRRSPSTGPWPCPQDPLGAARCVVHGAEFWSQYRINVTEVNPLGASTRLLDVSLQSILRPDPPQGLRVESV

SEQ ID NO: 41353 - protein, 390 aa, Homo sapiens
  Payload ID: 8416
  Gene Symbol: IL11RA
  Gene Name: interleukin 11 receptor, alpha
  Uniprot ID: Q14626
  ENSP ID: ENSP00000473647
MSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISGLPTRYLTSYRKKTVLGADSQRRSPSTGPWPCPQDPLGAARCVVHGAEFWSQYRINVTEVNPLGASTRLLDVSLQSILRPDPPQGLRVESVPGYPRRLRASWTYPASWPCQPHFLLKFRLQYRPAQHPAWSTVEPAGLEEVITDAVAGLPHAVRVSARDFLDAGTWSTWSPEAWGTPSTGTIPKEIPAWGQLHTQPEVEPQVDSPAPPRPSLQPHPRLLDHRDSVEQVAVLASLGILSFLGLVAGALALGLW

SEQ ID NO: 41354 - protein, 381 aa, Homo sapiens
  Payload ID: 8417
  Gene Symbol: IL12RB1
  Gene Name: interleukin 12 receptor, beta 1
  Uniprot ID: P42701
  ENSP ID: ENSP00000314425
MEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTDGMISAHCNLRLPDSRDSPASASRVAGITGICHHTRLILYF

SEQ ID NO: 41355 - protein, 118 aa, Homo sapiens
  Payload ID: 8417
  Gene Symbol: IL12RB1
  Gene Name: interleukin 12 receptor, beta 1
  ENSP ID: ENSP00000403103
MEPLVTWVVPLLFLFLLSRQGAACRTSECCFQDPPYPDADSGSLPGSASGPRDLRCYRISSDRYECSWQYEGPTAGVSHFLRCCLSSGRCCYFAAGSATRLQFSDQAGVSVLYTVTLW

SEQ ID NO: 41356 - protein, 67 aa, Homo sapiens
  Payload ID: 8417
  Gene Symbol: IL12RB1
  Gene Name: interleukin 12 receptor, beta 1
  ENSP ID: ENSP00000468831
MEPLVTWVVPLLFLFLLSRQGAACRTSECCFQDPPYPDADSGSASGPRDLRCYRISSDRYECSWQYE

SEQ ID NO: 41357 - protein, 662 aa, Homo sapiens
  Payload ID: 8417
  Gene Symbol: IL12RB1
  Gene Name: interleukin 12 receptor, beta 1
  Uniprot ID: P42701
  ENSP ID: ENSP00000470788
MEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSDWLIFFASLGSFLSILLVGVLGYLGLNRAARHLCPPLPTPCASSAIEFPGGKETWQWINPVDFQEEASLQEALVVEMSWDKGERTEPLEKTELPEGAPELALDTELSLEDGDRCKAKM

SEQ ID NO: 41358 - protein, 662 aa, Homo sapiens; identical to SEQ ID NO: 41357
  Payload ID: 8417
  Gene Symbol: IL12RB1
  Gene Name: interleukin 12 receptor, beta 1
  Uniprot ID: P42701
  ENSP ID: ENSP00000472165

SEQ ID NO: 41359 - protein, 51 aa, Homo sapiens
  Payload ID: 8417
  Gene Symbol: IL12RB1
  Gene Name: interleukin 12 receptor, beta 1
  ENSP ID: ENSP00000473051
MEPLVTWVVPLLFLFLLSRQGAACRTSECCFQDPPYPDADSGSASGPRDLR

SEQ ID NO: 41360 - protein, 862 aa, Homo sapiens
  Payload ID: 8418
  Gene Symbol: IL12RB2
  Gene Name: interleukin 12 receptor, beta 2
  Uniprot ID: Q99665
  ENSP ID: ENSP00000262345
MAHTFRGCSLAFMFIITWLLIKAKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDSNSQPQLCEIPYRVSQNSHPINSLQPRVTYVLWMTALTAAGESSHGNEREFCLQGKANWMAFVAPSICIAIIMVGIFSTHYFQQKVFVLLAALRPQWCSREIPDPANSTCAKKYPIAEEKTQLPLDRLLIDWPTPEDPEPLVISEVLHQVTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLML

SEQ ID NO: 41361 - protein, 659 aa, Homo sapiens
  Payload ID: 8418
  Gene Symbol: IL12RB2
  Gene Name: interleukin 12 receptor, beta 2
  Uniprot ID: Q99665
  ENSP ID: ENSP00000360039
MAHTFRGCSLAFMFIITWLLIKAKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDSNSQPQLCEIPYRVSQNSHPINSLQPRVTYVLWMTALTAAGESSHGNEREFCLQGKANWMAFVAPSICIAIIMVGIFSTHYFQQKRRHSCPWTGS

SEQ ID NO: 41362 - protein, 229 aa, Homo sapiens
  Payload ID: 8418
  Gene Symbol: IL12RB2
  Gene Name: interleukin 12 receptor, beta 2
  ENSP ID: ENSP00000400959
  MOD_RES (1)..(1): Any amino acid
XQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKVSFKRQLKTQGNKTE

SEQ ID NO: 41363 - protein, 776 aa, Homo sapiens
  Payload ID: 8418
  Gene Symbol: IL12RB2
  Gene Name: interleukin 12 receptor, beta 2
  Uniprot ID: Q99665
  ENSP ID: ENSP00000442443
MAHTFRGCSLAFMFIITWLLIKAKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISEIPYRVSQNSHPINSLQPRVTYVLWMTALTAAGESSHGNEREFCLQGKANWMAFVAPSICIAIIMVGIFSTHYFQQKVFVLLAALRPQWCSREIPDPANSTCAKKYPIAEEKTQLPLDRLLIDWPTPEDPEPLVISEVLHQVTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLML

SEQ ID NO: 41364 - protein, 635 aa, Homo sapiens
  Payload ID: 8418
  Gene Symbol: IL12RB2
  Gene Name: interleukin 12 receptor, beta 2
  ENSP ID: ENSP00000445276
MAHTFRGCSLAFMFIITWLLIKAKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDSNSQPQLCEIPYRVSQNSHPINSLQPRVTYVLWMTALTAAGESSHGNEREFCLQGEDTAALGQAPDRLAHA

SEQ ID NO: 41365 - protein, 253 aa, Homo sapiens
  Payload ID: 8419
  Gene Symbol: IL12A
  Gene Name: interleukin 12A
  Uniprot ID: P29459
  ENSP ID: ENSP00000303231
MWPPGSASQPPPSPAAATGLHPAARPVSLQCRLSMCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 41366 - protein, 239 aa, Homo sapiens
  Payload ID: 8419
  Gene Symbol: IL12A
  Gene Name: interleukin 12A
  ENSP ID: ENSP00000419046
MWPPGSASQPPPSPAAATGLHPAARPVSLQCRLSMCPARSLLLVATLVLLDHLSLARNLPVATPDPGMFPCLHHSQNLLRAVSNMLQKARQTLEFYPCTSEEIDHEDITKDKTSTVEACLPLELTKNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 41367 - protein, 215 aa, Homo sapiens
  Payload ID: 8419
  Gene Symbol: IL12A
  Gene Name: interleukin 12A
  ENSP ID: ENSP00000420184
MWPPGSASQPPPSPAAATGLHPAARPVSLQCRLSMCPARSLLLVATLVLLDHLSLARNLPVATPDPGMFPCLHHSQNLLRAVSNMLQKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 41368 - protein, 328 aa, Homo sapiens
  Payload ID: 8420
  Gene Symbol: IL12B
  Gene Name: interleukin 12B
  Uniprot ID: P29460
  ENSP ID: ENSP00000231228
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 41369 - protein, 146 aa, Homo sapiens
  Payload ID: 8421
  Gene Symbol: IL13
  Gene Name: interleukin 13
  Uniprot ID: P35225
  ENSP ID: ENSP00000304915
MHPLLNPLLLALGLMALLLTTVIALTCLGGFASPGPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGQFN

SEQ ID NO: 41370 - protein, 144 aa, Homo sapiens
  Payload ID: 8421
  Gene Symbol: IL13
  Gene Name: interleukin 13
  ENSP ID: ENSP00000479835
MALLLTTVIALTCLGGFASPGPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGQFNNFESIIICRDRT

SEQ ID NO: 41371 - protein, 279 aa, Homo sapiens
  Payload ID: 8422
  Gene Symbol: IL13RA1
  Gene Name: interleukin 13 receptor, alpha 1
  Uniprot ID: P78552
  ENSP ID: ENSP00000360705
MEWPARLCGLWALLLCAGGGGGGGGAAPTETQPPVTNLSVSVENLCTVIWTWNPPEGASSNCSLWYFSHFGDKQDKKIAPETRRSIEVPLNERICLQVGSQCSTNESEKPSILVEKCISPPEGDPESAVTELQCIWHNLSYMKCSWLPGRNTSPDTNYTLYYWHRSLEKIHQCENIFREGQYFGCSFDLTKVKDSSFEQHSVQIMVKDNAGKIKPSFNIVPLTSRVKPDPPHIKNLSFHNDDLYVQWENPQNFISRCLFYEVEVNNSQTETHNVFYVRF

SEQ ID NO: 41372 - protein, 427 aa, Homo sapiens
  Payload ID: 8422
  Gene Symbol: IL13RA1
  Gene Name: interleukin 13 receptor, alpha 1
  Uniprot ID: P78552
  ENSP ID: ENSP00000360730
MEWPARLCGLWALLLCAGGGGGGGGAAPTETQPPVTNLSVSVENLCTVIWTWNPPEGASSNCSLWYFSHFGDKQDKKIAPETRRSIEVPLNERICLQVGSQCSTNESEKPSILVEKCISPPEGDPESAVTELQCIWHNLSYMKCSWLPGRNTSPDTNYTLYYWHRSLEKIHQCENIFREGQYFGCSFDLTKVKDSSFEQHSVQIMVKDNAGKIKPSFNIVPLTSRVKPDPPHIKNLSFHNDDLYVQWENPQNFISRCLFYEVEVNNSQTETHNVFYVQEAKCENPEFERNVENTSCFMVPGVLPDTLNTVRIRVKTNKLCYEDDKLWSNWSQEMSIGKKRNSTLYITMLLIVPVIVAGAIIVLLLYLKRLKIIIFPPIPDPGKIFKEMFGDQNDDTLHWKKYDIYEKQTKEETDSVVLIENLKKASQ

SEQ ID NO: 41373 - protein, 380 aa, Homo sapiens
  Payload ID: 8423
  Gene Symbol: IL13RA2
  Gene Name: interleukin 13 receptor, alpha 2
  Uniprot ID: Q14627
  ENSP ID: ENSP00000243213
MAFVCLAIGCLYTFLISTTFGCTSSSDTEIKVNPPQDFEIVDPGYLGYLYLQWQPPLSLDHFKECTVEYELKYRNIGSETWKTIITKNLHYKDGFDLNKGIEAKIHTLLPWQCTNGSEVQSSWAETTYWISPQGIPETKVQDMDCVYYNWQYLLCSWKPGIGVLLDTNYNLFYWYEGLDHALQCVDYIKADGQNIGCRFPYLEASDYKDFYICVNGSSENKPIRSSYFTFQLQNIVKPLPPVYLTFTRESSCEIKLKWSIPLGPIPARCFDYEIEIREDDTTLVTATVENETYTLKTTNETRQLCFVVRSKVNIYCSDDGIWSEWSDKQCWEGEDLSKKTLLRFWLPFGFILILVIFVTGLLLRKPNTYPKMIPEFFCDT

SEQ ID NO: 41374 - protein, 380 aa, Homo sapiens; identical to SEQ ID NO: 41373
  Payload ID: 8423
  Gene Symbol: IL13RA2
  Gene Name: interleukin 13 receptor, alpha 2
  Uniprot ID: Q14627
  ENSP ID: ENSP00000361004

SEQ ID NO: 41375 - protein, 162 aa, Homo sapiens
  Payload ID: 8424
  Gene Symbol: IL15
  Gene Name: interleukin 15
  Uniprot ID: P40933
  ENSP ID: ENSP00000296545
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 41376 - protein, 162 aa, Homo sapiens; identical to SEQ ID NO: 41375
  Payload ID: 8424
  Gene Symbol: IL15
  Gene Name: interleukin 15
  Uniprot ID: P40933
  ENSP ID: ENSP00000323505

SEQ ID NO: 41377 - protein, 135 aa, Homo sapiens
  Payload ID: 8424
  Gene Symbol: IL15
  Gene Name: interleukin 15
  Uniprot ID: P40933
  ENSP ID: ENSP00000377714
MVLGTIDLCSCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 41378 - protein, 135 aa, Homo sapiens; identical to SEQ ID NO: 41377
  Payload ID: 8424
  Gene Symbol: IL15
  Gene Name: interleukin 15
  Uniprot ID: P40933
  ENSP ID: ENSP00000422271

SEQ ID NO: 41379 - protein, 162 aa, Homo sapiens; identical to SEQ ID NO: 41375
  Payload ID: 8424
  Gene Symbol: IL15
  Gene Name: interleukin 15
  Uniprot ID: P40933
  ENSP ID: ENSP00000435462

SEQ ID NO: 41380 - protein, 135 aa, Homo sapiens; identical to SEQ ID NO: 41377
  Payload ID: 8424
  Gene Symbol: IL15
  Gene Name: interleukin 15
  Uniprot ID: P40933
  ENSP ID: ENSP00000436914

SEQ ID NO: 41381 - protein, 154 aa, Homo sapiens
  Payload ID: 8425
  Gene Symbol: IL15RA
  Gene Name: interleukin 15 receptor, alpha
  Uniprot ID: Q13261
  ENSP ID: ENSP00000369306
MAPRRARGCRTLGLPALLLLLLLRPPATREPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRASVCSCHPRSAGHTCSVGSVC

SEQ ID NO: 41382 - protein, 267 aa, Homo sapiens
  Payload ID: 8425
  Gene Symbol: IL15RA
  Gene Name: interleukin 15 receptor, alpha
  Uniprot ID: Q13261
  ENSP ID: ENSP00000369312
MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 41383 - protein, 172 aa, Homo sapiens
  Payload ID: 8425
  Gene Symbol: IL15RA
  Gene Name: interleukin 15 receptor, alpha
  ENSP ID: ENSP00000380420
MSVEHADIWVKSYSLYSRERYICNSGFKRKAGTSSLTECVLNKATNVAHWTTPSLKCIKPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEM

SEQ ID NO: 41384 - protein, 353 aa, Homo sapiens
  Payload ID: 8425
  Gene Symbol: IL15RA
  Gene Name: interleukin 15 receptor, alpha
  ENSP ID: ENSP00000380421
MRLAGRQVPEQRSPPPPGLGSARPGSPAVSCGAAAMAPRRARGCRTLGLPALLLLLLLRPPATRDARDRLAVLAGRSRISESFNHEVQTHEACVRLRTMENCPQCHHHRTSRQQAGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 41385 - protein, 169 aa, Homo sapiens
  Payload ID: 8425
  Gene Symbol: IL15RA
  Gene Name: interleukin 15 receptor, alpha
  Uniprot ID: Q13261
  ENSP ID: ENSP00000380422
MAPRRARGCRTLGLPALLLLLLLRPPATREPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 41386 - protein, 308 aa, Homo sapiens
  Payload ID: 8425
  Gene Symbol: IL15RA
  Gene Name: interleukin 15 receptor, alpha
  ENSP ID: ENSP00000380423
MAPRRARGCRTLGLPALLLLLLLRPPATRDARDRLAVLAGRSRISESFNHEVQTHEACVRLRTMENCPQCHHHRTSRQQAGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSSLDAFIKIRGGFSTWLLGLPHSTVGSG

SEQ ID NO: 41387 - protein, 252 aa, Homo sapiens
  Payload ID: 8425
  Gene Symbol: IL15RA
  Gene Name: interleukin 15 receptor, alpha
  Uniprot ID: Q13261
  ENSP ID: ENSP00000380426
MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRASVCSCHPRSAGHTCSVGSVC

SEQ ID NO: 41388 - protein, 198 aa, Homo sapiens
  Payload ID: 8425
  Gene Symbol: IL15RA
  Gene Name: interleukin 15 receptor, alpha
  ENSP ID: ENSP00000393612
  MOD_RES (1)..(1): Any amino acid
XPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSSSQRKVTYLRLSVNYKAPPGVGDVYREDTSVWAPPNDPVSSCAARTDREPEKVEEMLSPVNPLHRRIQEEENSSQRHFTYICIYTSLSVISTHYI

SEQ ID NO: 41389 - protein, 172 aa, Homo sapiens
  Payload ID: 8425
  Gene Symbol: IL15RA
  Gene Name: interleukin 15 receptor, alpha
  ENSP ID: ENSP00000395113
MAPRRARGCRTLGLPALLLLLLLRPPATRGITCPPPMSVEHADIWVKSYSLYSRERYICNSGFKRKAGTSSLTECVLNKATNVAHWTTPSLKCIKPAASSPSSNNTAATTAAIVPGSQLMPSKSPSTGTTEISSHESSHGTPSQTTAKNWELTASASHQPPGVYPQGHSDTT

SEQ ID NO: 41390 - protein, 148 aa, Homo sapiens
  Payload ID: 8425
  Gene Symbol: IL15RA
  Gene Name: interleukin 15 receptor, alpha
  ENSP ID: ENSP00000405107
MSVEHADIWVKSYSLYSRERYICNSGFKRKAGTSSLTECVLNKATNVAHWTTPSLKCINPALVHQRPAPPSTVTTAGVTPQPESLSPSGKEPAASSPSSNNTAATTAAIVPGSQLMPSKSPSTGTTEISSHESSHGTPSQTTAKNWEL

SEQ ID NO: 41391 - protein, 155 aa, Homo sapiens
  Payload ID: 8425
  Gene Symbol: IL15RA
  Gene Name: interleukin 15 receptor, alpha
  ENSP ID: ENSP00000405128
  MOD_RES (1)..(1): Any amino acid
XLVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRASVCSCHPRSAGHTCSVGSVC

SEQ ID NO: 41392 - protein, 231 aa, Homo sapiens
  Payload ID: 8425
  Gene Symbol: IL15RA
  Gene Name: interleukin 15 receptor, alpha
  Uniprot ID: Q13261
  ENSP ID: ENSP00000431529
MSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 41393 - protein, 209 aa, Homo sapiens
  Payload ID: 8425
  Gene Symbol: IL15RA
  Gene Name: interleukin 15 receptor, alpha
  ENSP ID: ENSP00000432691
  MOD_RES (1)..(1): Any amino acid
XITCPPPMSVEHADIWVKSYSLYSRERYICNSGFKRKAGTSSLTECVLNKATNVAHWTTPSLKCIRTTEISSHESSHGTPSQTTAKNWELTASASHQPPGVYPQGHSDTTGRKQHLLPDFQASFQRDCINKHIEDKECWTVASFLLFLAISTSTVLLCGLSAVSLLACYLKSRQTPPLASVEMEAMEALPVTWGTSSRDEDLENCSHHL

SEQ ID NO: 41394 - protein, 234 aa, Homo sapiens
  Payload ID: 8425
  Gene Symbol: IL15RA
  Gene Name: interleukin 15 receptor, alpha
  Uniprot ID: Q13261
  ENSP ID: ENSP00000435454
MAPRRARGCRTLGLPALLLLLLLRPPATRGITCPPPMSVEHADIWVKSYSLYSRERYICNSGFKRKAGTSSLTECVLNKATNVAHWTTPSLKCIKPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 41395 - protein, 219 aa, Homo sapiens
  Payload ID: 8425
  Gene Symbol: IL15RA
  Gene Name: interleukin 15 receptor, alpha
  Uniprot ID: Q13261
  ENSP ID: ENSP00000435995
MAPRRARGCRTLGLPALLLLLLLRPPATRGITCPPPMSVEHADIWVKSYSLYSRERYICNSGFKRKAGTSSLTECVLNKATNVAHWTTPSLKCIKPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRASVCSCHPRSAGHTCSVGSVC

SEQ ID NO: 41396 - protein, 305 aa, Homo sapiens
  Payload ID: 8425
  Gene Symbol: IL15RA
  Gene Name: interleukin 15 receptor, alpha
  ENSP ID: ENSP00000478525
MAPRRARGCRTLGLPALLLLLLLRPPATRDARDRLAVLAGRSRISESFNHEVQTHEACVRLRTMENCPQCHHHRTSRQQAGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTGRKQHLLPDFQASFQRDCINKHIEDKECWTVASFLLFCTMFVSTCWYTL

SEQ ID NO: 41397 - protein, 331 aa, Homo sapiens
  Payload ID: 8425
  Gene Symbol: IL15RA
  Gene Name: interleukin 15 receptor, alpha
  ENSP ID: ENSP00000479839
MAPRRARGCRTLGLPALLLLLLLRPPATRDARDRLAVLAGRSRISESFNHEVQTHEACVRLRTMENCPQCHHHRTSRQQAGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRWLAKRSLPGDAEAPNMSRGGRNAWEQLSRAPATSLLRTPVESALSASRP

SEQ ID NO: 41398 - protein, 316 aa, Homo sapiens
  Payload ID: 8425
  Gene Symbol: IL15RA
  Gene Name: interleukin 15 receptor, alpha
  ENSP ID: ENSP00000479938
MAPRRARGCRTLGLPALLLLLLLRPPATRDARDRLAVLAGRSRISESFNHEVQTHEACVRLRTMENCPQCHHHRTSRQQAGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSSDSAVGKSKLEKEKVQNDSADADITQRYASAMVPV

SEQ ID NO: 41399 - protein, 346 aa, Homo sapiens
  Payload ID: 8425
  Gene Symbol: IL15RA
  Gene Name: interleukin 15 receptor, alpha
  ENSP ID: ENSP00000480949
MAPRRARGCRTLGLPALLLLLLLRPPATRDARDRLAVLAGRSRISESFNHEVQTHEACVRLRTMENCPQCHHHRTSRQQAGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSSSHSRELTLLTLKWPKELLLLRRDISPALVEGAGQMPRASAPRQLQTGQPRMTSVLPRLCLSFGS

SEQ ID NO: 41400 - protein, 1332 aa, Homo sapiens
  Payload ID: 8426
  Gene Symbol: IL16
  Gene Name: interleukin 16
  Uniprot ID: Q14005
  ENSP ID: ENSP00000302935
MESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKESSTASSREKPGKLEAQSSNFLFPKACHQRARSNSTSVNPYCTREIDFPMTKKSAAPTDRQPYSLCSNRKSLSQQLDCPAGKAAGTSRPTRSLSTAQLVQPSGGLQASVISNIVLMKGQAKGLGFSIVGGKDSIYGPIGIYVKTIFAGGAAAADGRLQEGDEILELNGESMAGLTHQDALQKFKQAKKGLLTLTVRTRLTAPPSLCSHLSPPLCRSLSSSTCITKDSSSFALESPSAPISTAKPNYRIMVEVSLQKEAGVGLGIGLCSVPYFQCISGIFVHTLSPGSVAHLDGRLRCGDEIVEISDSPVHCLTLNEVYTILSHCDPGPVPIIVSRHPDPQVSEQQLKEAVAQAVENTKFGKERHQWSLEGVKRLESSWHGRPTLEKEREKNSAPPHRRAQKVMIRSSSDSSYMSGSPGGSPGSGSAEKPSSDVDISTHSPSLPLAREPVVLSIASSRLPQESPPLPESRDSHPPLRLKKSFEILVRKPMSSKPKPPPRKYFKSDSDPQKSLEERENSSCSSGHTPPTCGQEARELLPLLLPQEDTAGRSPSASAGCPGPGIGPQTKSSTEGEPGWRRASPVTQTSPIKHPLLKRQARMDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTAEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDS

SEQ ID NO: 41401 - protein, 631 aa, Homo sapiens
  Payload ID: 8426
  Gene Symbol: IL16
  Gene Name: interleukin 16
  Uniprot ID: Q14005
  ENSP ID: ENSP00000378147
MDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTAEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDS

SEQ ID NO: 41402 - protein, 1331 aa, Homo sapiens
  Payload ID: 8426
  Gene Symbol: IL16
  Gene Name: interleukin 16
  Uniprot ID: Q14005
  ENSP ID: ENSP00000378155
MESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKESSTASSREKPGKLEAQSSNFLFPKACHQRARSNSTSVNPYCTREIDFPMTKKSAAPTDRQPYSLCSNRKSLSQQLDCPAGKAAGTSRPTRSLSTAQLVQPSGGLQASVISNIVLMKGQAKGLGFSIVGGKDSIYGPIGIYVKTIFAGGAAAADGRLQEGDEILELNGESMAGLTHQDALQKFKQAKKGLLTLTVRTRLTAPPSLCSHLSPPLCRSLSSSTCITKDSSSFALESPSAPISTAKPNYRIMVEVSLQKEAGVGLGIGLCSVPYFQCISGIFVHTLSPGSVAHLDGRLRCGDEIVEISDSPVHCLTLNEVYTILSHCDPGPVPIIVSRHPDPQVSEQQLKEAVAQAVENTKFGKERHQWSLEGVKRLESSWHGRPTLEKEREKNSAPPHRRAQKVMIRSSSDSSYMSGSPGGSPGSGSAEKPSSDVDISTHSPSLPLAREPVVLSIASSRLPQESPPLPESRDSHPPLRLKKSFEILVRKPMSSKPKPPPRKYFKSDSDPQKSLEERENSSCSSGHTPPTCGQEARELLPLLLPQEDTAGRSPSASAGCPGPGIGPQTKSSTEGEPGWRRASPVTQTSPIKHPLLKRQARMDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDS

SEQ ID NO: 41403 - protein, 454 aa, Homo sapiens
  Payload ID: 8426
  Gene Symbol: IL16
  Gene Name: interleukin 16
  ENSP ID: ENSP00000452738
MESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKESSTASSREKPGKLEAQSSNFLFPKACHQRARSNSTSVNPYCTREIDFPMTKKSAAPTDRQPYSLCSNRKSLSQQLDCPAGKAAGTSRPTRSLSTAQLVQPSGGLQASVISNIVLMKGQAKGLGFSIVGGKDSIYGPIGIYVKTIFAGGAAAADGRLQEGDEILELNGESMAGLTHQDALQKFKQAKKGLLTLTVRTRLTAPPSLCSHLSPPLCRSLSSSTCITKDSSSFALESPSAPISTAKPNYRIMVEVSLQKEAGVGLGIGLCSVPYFQCISGIFVHTLSPGSVAHLDGRLRCGDEIVEISDSPVHCLTLNEVYTILSHCDPGPVPIIVSRHPDPQKEEMEAQEVK

SEQ ID NO: 41404 - protein, 44 aa, Homo sapiens
  Payload ID: 8426
  Gene Symbol: IL16
  Gene Name: interleukin 16
  ENSP ID: ENSP00000453131
SASAGCPGPGIGPQTKSSTEGEPGWRRASPAWKLEFRKKSHCMM

SEQ ID NO: 41405 - protein, 611 aa, Homo sapiens
  Payload ID: 8426
  Gene Symbol: IL16
  Gene Name: interleukin 16
  ENSP ID: ENSP00000453214
  MOD_RES (1)..(1): Any amino acid
XRQARMDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTEATVCTVTLEKMSAGLGFSLEGGKGSLHGDKPLTINRIFKGVGCVWFFACSPVVGMWPGPQKASGHFLGYVVSHNSMSSS

SEQ ID NO: 41406 - protein, 594 aa, Homo sapiens
  Payload ID: 8426
  Gene Symbol: IL16
  Gene Name: interleukin 16
  ENSP ID: ENSP00000453250
MESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKESSTASSREKPGKLEAQSSNFLFPKACHQRARSNSTSVNPYCTREIDFPMTKKSAAPTDRQPYSLCSNRKSLSQQLDCPAGKAAGTSRPTRSLSTAQLVQPSGGLQASVISNIVLMKGQAKGLGFSIVGGKDSIYGPIGIYVKTIFAGGAAAADGRLQEGDEILELNGESMAGLTHQDALQKFKQAKKGLLTLTVRTRLTAPPSLCSHLSPPLCRSLSSSTCITKDSSSFALESPSAPISTAKPNYRIMVEVSLQKEAGVGLGIGLCSVPYFQCISGIFVHTLSPGSVAHLDGRLRCGDEIVEISDSPVHCLTLNEVYTILSHCDPGPVPIIVSRHPDPQVSEQQLKEAVAQAVENTKFGKERHQWSLEGVKRLESSWHGRPTLEKEREKNSAPPHRRAQKVMIRSSSDSSYMSGSPGGSPGSGSAEKPSSDVDISTHSPSLPLAREPVVLSIASSRLPQESPPLPESRDSHPPLRLKKSFEILVRKPMS

SEQ ID NO: 41407 - protein, 201 aa, Homo sapiens
  Payload ID: 8426
  Gene Symbol: IL16
  Gene Name: interleukin 16
  ENSP ID: ENSP00000454636
  MOD_RES (1)..(1): Any amino acid
XQKFKQAKKGLLTLTVRTRLTAPPSLCSHLSPPLCRSLSSSTCITKDSSSFALESPSAPISTAKPNYRIMVEVSLQKEAGVGLGIGLCSVPYFQCISGIFVHTLSPGSVAHLDGRLRCGDEIVEISDSPVHCLTLNEVYTILSHCDPGPVPIIVSRHPDPQVSEQQLKEAVAQAVENTKFGKERHQWSLEDAEMELGPPGS

SEQ ID NO: 41408 - protein, 484 aa, Homo sapiens
  Payload ID: 8426
  Gene Symbol: IL16
  Gene Name: interleukin 16
  ENSP ID: ENSP00000456972
MESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKESSTASSREKPGKLEAQSSNFLFPKACHQRARSNSTSVNPYCTREIDFPMTKKSAAPTDRQPYSLCSNRKSLSQQLDCPAGKAAGTSRPTRSLSTAQLVQPSGGLQASVISNIVLMKGQAKGLGFSIVGGKDSIYGPIGIYVKTIFAGGAAAADGRLQEGDEILELNGESMAGLTHQDALQKFKQAKKGLLTLTVRTRLTAPPSLCSHLSPPLCRSLSSSTCITKDSSSFALESPSAPISTAKPNYRIMVEVSLQKEAGVGLGIGLCSVPYFQCISGIFVHTLSPGSVAHLDGRLRCGDEIVEISDSPVHCLTLNEVYTILSHCDPGPVPIIVSRHPDPQVSEQQLKEAVAQAVENTKFGKERHQWSLEDAEMELGPPGS

SEQ ID NO: 41409 - protein, 560 aa, Homo sapiens
  Payload ID: 8426
  Gene Symbol: IL16
  Gene Name: interleukin 16
  Uniprot ID: Q14005
  ENSP ID: ENSP00000458125
MDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTEATVCTVTLEDVGRAGLQPGRREGLPTRRQASHH

SEQ ID NO: 41410 - protein, 866 aa, Homo sapiens
  Payload ID: 8427
  Gene Symbol: IL17RA
  Gene Name: interleukin 17 receptor A
  Uniprot ID: Q96F46
  ENSP ID: ENSP00000320936
MGAARSPPSAVPGPLLGLLLLLLGVLAPGGASLRLLDHRALVCSQPGLNCTVKNSTCLDDSWIHPRNLTPSSPKDLQIQLHFAHTQQGDLFPVAHIEWTLQTDASILYLEGAELSVLQLNTNERLCVRFEFLSKLRHHHRRWRFTFSHFVVDPDQEYEVTVHHLPKPIPDGDPNHQSKNFLVPDCEHARMKVTTPCMSSGSLWDPNITVETLEAHQLRVSFTLWNESTHYQILLTSFPHMENHSCFEHMHHIPAPRPEEFHQRSNVTLTLRNLKGCCRHQVQIQPFFSSCLNDCLRHSATVSCPEMPDTPEPIPDYMPLWVYWFITGISILLVGSVILLIVCMTWRLAGPGSEKYSDDTKYTDGLPAADLIPPPLKPRKVWIIYSADHPLYVDVVLKFAQFLLTACGTEVALDLLEEQAISEAGVMTWVGRQKQEMVESNSKIIVLCSRGTRAKWQALLGRGAPVRLRCDHGKPVGDLFTAAMNMILPDFKRPACFGTYVVCYFSEVSCDGDVPDLFGAAPRYPLMDRFEEVYFRIQDLEMFQPGRMHRVGELSGDNYLRSPGGRQLRAALDRFRDWQVRCPDWFECENLYSADDQDAPSLDEEVFEEPLLPPGTGIVKRAPLVREPGSQACLAIDPLVGEEGGAAVAKLEPHLQPRGQPAPQPLHTLVLAAEEGALVAAVEPGPLADGAAVRLALAGEGEACPLLGSPGAGRNSVLFLPVDPEDSPLGSSTPMASPDLLPEDVREHLEGLMLSLFEQSLSCQAQGGCSRPAMVLTDPHTPYEEEQRQSVQSDQGYISRSSPQPPEGLTEMEEEEEEEQDPGKPALPLSPEDLESLRSLQRQLLFRQLQKNSGWDTMGSESEGPSA

SEQ ID NO: 41411 - protein, 832 aa, Homo sapiens
  Payload ID: 8427
  Gene Symbol: IL17RA
  Gene Name: interleukin 17 receptor A
  Uniprot ID: Q96F46
  ENSP ID: ENSP00000479970
MGAARSPPSAVPGPLLGLLLLLLGVLAPGGASLRLLDHRALVCSQPGLNCTVKNSTCLDDSWIHPRNLTPSSPKDLQIQLHFAHTQQGDLFPVAHIEWTLQTDASILYLEGAELSVLQLNTNERLCVRFEFLSKLRHHHRRWRFTFSHFVVDPDQEYEVTVHHLPKPIPDGDPNHQSKNFLVPDCEHARMKVTTPCMSSGSLWDPNITVETLEAHQLRVSFTLWNESTHYQILLTSFPHMENHSCFEHMHHIPAPRPEEFHQRSNVTLTLRNLKGCCRHQVQIQPFFSSCLNDCLRHSATVSCPEMPDTPEPIPGPGSEKYSDDTKYTDGLPAADLIPPPLKPRKVWIIYSADHPLYVDVVLKFAQFLLTACGTEVALDLLEEQAISEAGVMTWVGRQKQEMVESNSKIIVLCSRGTRAKWQALLGRGAPVRLRCDHGKPVGDLFTAAMNMILPDFKRPACFGTYVVCYFSEVSCDGDVPDLFGAAPRYPLMDRFEEVYFRIQDLEMFQPGRMHRVGELSGDNYLRSPGGRQLRAALDRFRDWQVRCPDWFECENLYSADDQDAPSLDEEVFEEPLLPPGTGIVKRAPLVREPGSQACLAIDPLVGEEGGAAVAKLEPHLQPRGQPAPQPLHTLVLAAEEGALVAAVEPGPLADGAAVRLALAGEGEACPLLGSPGAGRNSVLFLPVDPEDSPLGSSTPMASPDLLPEDVREHLEGLMLSLFEQSLSCQAQGGCSRPAMVLTDPHTPYEEEQRQSVQSDQGYISRSSPQPPEGLTEMEEEEEEEQDPGKPALPLSPEDLESLRSLQRQLLFRQLQKNSGWDTMGSESEGPSA

SEQ ID NO: 41412 - protein, 502 aa, Homo sapiens
  Payload ID: 8428
  Gene Symbol: IL17RB
  Gene Name: interleukin 17 receptor B
  Uniprot ID: Q9NRM6
  ENSP ID: ENSP00000288167
MSLVLLSLAALCRSAVPREPTVQCGSETGPSPEWMLQHDLIPGDLRDLRVEPVTTSVATGDYSILMNVSWVLRADASIRLLKATKICVTGKSNFQSYSCVRCNYTEAFQTQTRPSGGKWTFSYIGFPVELNTVYFIGAHNIPNANMNEDGPSMSVNFTSPGCLDHIMKYKKKCVKAGSLWDPNITACKKNEETVEVNFTTTPLGNRYMALIQHSTIIGFSQVFEPHQKKQTRASVVIPVTGDSEGATVQLTPYFPTCGSDCIRHKGTVVLCPQTGVPFPLDNNKSKPGGWLPLLLLSLLVATWVLVAGIYLMWRHERIKKTSFSTTTLLPPIKVLVVYPSEICFHHTICYFTEFLQNHCRSEVILEKWQKKKIAEMGPVQWLATQKKAADKVVFLLSNDVNSVCDGTCGKSEGSPSENSQDLFPLAFNLFCSDLRSQIHLHKYVVVYFREIDTKDDYNALSVCPKYHLMKDATAFCAELLHVKQQVSAGKRSQACHDGCCSL

SEQ ID NO: 41413 - protein, 348 aa, Homo sapiens
  Payload ID: 8428
  Gene Symbol: IL17RB
  Gene Name: interleukin 17 receptor B
  ENSP ID: ENSP00000418638
MSLVLLSLAALCRSAVPREPTVQCGSETGPSPEWMLQHDLIPGDLRDLRVEPVTTSVATGDYSILMNVSWVLRADASIRLLKATKICVTGKSNFQSYSCVRCNYTEAFQTQTRPSGGKWTFSYIGFPVELNTVYFIGAHNIPNANMNEDGPSMSVNFTSPGSLWDPNITACKKNEETVEVNFTTTPLGNRYMALIQHSTIIGFSQVFEPHQKKQTRASVVIPVTGDSEGATVQLTPYFPTCGSDCIRHKGTVVLCPQTGVPFPLDNNKSKPGGWLPLLLLSLLVATWVLVAGIYLMWRHERIKKTSFSTTTLLPPIKVLVVYPSEICFHHTICYFTEFLQNHCRSEVI

SEQ ID NO: 41414 - protein, 791 aa, Homo sapiens
  Payload ID: 8429
  Gene Symbol: IL17RC
  Gene Name: interleukin 17 receptor C
  Uniprot ID: Q8NAC3
  ENSP ID: ENSP00000295981
MPVPWFLLSLALGRSPVVLSLERLVGPQDATHCSPVSLEPWGDEERLRVQFLAQQSLSLAPVTAATARTALSGLSGADGRREERGRGKSWVCLSLGGSGNTEPQKKGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPDCRGLEVWNSIPSCWALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 41415 - protein, 705 aa, Homo sapiens
  Payload ID: 8429
  Gene Symbol: IL17RC
  Gene Name: interleukin 17 receptor C
  Uniprot ID: Q8NAC3
  ENSP ID: ENSP00000373323
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 41416 - protein, 720 aa, Homo sapiens
  Payload ID: 8429
  Gene Symbol: IL17RC
  Gene Name: interleukin 17 receptor C
  Uniprot ID: Q8NAC3
  ENSP ID: ENSP00000384969
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPDCRGLEVWNSIPSCWALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 41417 - protein, 91 aa, Homo sapiens
  Payload ID: 8429
  Gene Symbol: IL17RC
  Gene Name: interleukin 17 receptor C
  ENSP ID: ENSP00000387675
MPVPWFLLSLALGRSPVVLSLERLVGPQDATHCSPGLSCRLWGATKFWAWNSFSSHPLLHTQTVTYSACLGTSCLLRAPCWRLRTCRQSWC

SEQ ID NO: 41418 - protein, 156 aa, Homo sapiens
  Payload ID: 8429
  Gene Symbol: IL17RC
  Gene Name: interleukin 17 receptor C
  ENSP ID: ENSP00000390080
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGLCGI

SEQ ID NO: 41419 - protein, 98 aa, Homo sapiens
  Payload ID: 8429
  Gene Symbol: IL17RC
  Gene Name: interleukin 17 receptor C
  ENSP ID: ENSP00000394996
MPVPWFLLSLALGRSPVVLSLERLVGPQDATHCSPGLSCRLWDSDILCLPGDIVPAPGPVLAPTHLQTELVLRCQKETDCDLCLRVAVHLAVHGLCGI

SEQ ID NO: 41420 - protein, 690 aa, Homo sapiens
  Payload ID: 8429
  Gene Symbol: IL17RC
  Gene Name: interleukin 17 receptor C
  ENSP ID: ENSP00000395315
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPDCRGLEVWNSIPSCWALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 41421 - protein, 707 aa, Homo sapiens
  Payload ID: 8429
  Gene Symbol: IL17RC
  Gene Name: interleukin 17 receptor C
  Uniprot ID: Q8NAC3
  ENSP ID: ENSP00000396064
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPDCRGLEVWNSIPSCWALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 41422 - protein, 242 aa, Homo sapiens
  Payload ID: 8429
  Gene Symbol: IL17RC
  Gene Name: interleukin 17 receptor C
  ENSP ID: ENSP00000399396
MPVPWFLLSLALGRSPVVLSLERLVGPQDATHCSPGLSCRLWDSDILCLPGDIVPAPGPVLAPTHLQTELVLRCQKETDCDLCLRVAVHLAVHASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLVRPPPSQVHSHCRPMPVQRTQCHIREDP

SEQ ID NO: 41423 - protein, 416 aa, Homo sapiens
  Payload ID: 8429
  Gene Symbol: IL17RC
  Gene Name: interleukin 17 receptor C
  ENSP ID: ENSP00000401128
MPVPWFLLSLALGRSPVVLSLERLVGPQDATHCSPGLSCRLWDSDILCLPGDIVPAPGPVLAPTHLQTELVLRCQKETDCDLCLRVAVHLAVHASLQAQVVLSFQAYPTARCVLLEVQVPAALVQFGQSVGSVVYDCFEAALGSEVRIWSYTQPRYEKELNHTQQLPDCRGLEVWNSIPSCWALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQS

SEQ ID NO: 41424 - protein, 688 aa, Homo sapiens
  Payload ID: 8429
  Gene Symbol: IL17RC
  Gene Name: interleukin 17 receptor C
  Uniprot ID: Q8NAC3
  ENSP ID: ENSP00000407894
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 41425 - protein, 123 aa, Homo sapiens
  Payload ID: 8429
  Gene Symbol: IL17RC
  Gene Name: interleukin 17 receptor C
  ENSP ID: ENSP00000410834
MPVPWFLLSLALGRSPVVLSLERLVGPQDATHCSPGLSCRLWDSDILCLPGDIVPAPGPVLAPTHLQTELVLRCQKETDCDLCLRVAVHLAVHGLPYCPLRPAGGASACCPCAVWSVCGLCGI

SEQ ID NO: 41426 - protein, 70 aa, Homo sapiens
  Payload ID: 8429
  Gene Symbol: IL17RC
  Gene Name: interleukin 17 receptor C
  ENSP ID: ENSP00000412777
MPVPWFLLSLALGRSPVVLSLERLVGPQDATHCSPGLSCRLWVTYSACLGTSCLLRAPCWRLRTCRQSWC

SEQ ID NO: 41427 - protein, 99 aa, Homo sapiens
  Payload ID: 8429
  Gene Symbol: IL17RC
  Gene Name: interleukin 17 receptor C
  ENSP ID: ENSP00000413914
MPVPWFLLSLALGRSPVVLSLERLVGPQDATHCSPGLSCRLWDSDILCLPGDIVPAPGPVLAPTHLQTELVLRCQKETDCDLCLRVAVHLAVHGEQVIL

SEQ ID NO: 41428 - protein, 330 aa, Homo sapiens
  Payload ID: 8429
  Gene Symbol: IL17RC
  Gene Name: interleukin 17 receptor C
  ENSP ID: ENSP00000414609
MPVPWFLLSLALGRSPVVLSLERLVGPQDATHCSPGLSCRLWDSDILCLPGDIVPAPGPVLAPTHLQTELVLRCQKETDCDLCLRVAVHLAVHASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDKVLEFPLLKGHPNLCVQ

SEQ ID NO: 41429 - protein, 44 aa, Homo sapiens
  Payload ID: 8429
  Gene Symbol: IL17RC
  Gene Name: interleukin 17 receptor C
  ENSP ID: ENSP00000432564
MPVPWFLLSLALGRSPVVLSLERLVGPQDATHCSPNCPVWSVWC

SEQ ID NO: 41430 - protein, 739 aa, Homo sapiens
  Payload ID: 8430
  Gene Symbol: IL17RD
  Gene Name: interleukin 17 receptor D
  Uniprot ID: Q8NFM7
  ENSP ID: ENSP00000296318
MAPWLQLCSVFFTVNACLNGSQLAVAAGGSGRARGADTCGWRGVGPASRNSGLYNITFKYDNCTTYLNPVGKHVIADAQNITISQYACHDQVAVTILWSPGALGIEFLKGFRVILEELKSEGRQCQQLILKDPKQLNSSFKRTGMESQPFLNMKFETDYFVKVVPFPSIKNESNYHPFFFRTRACDLLLQPDNLACKPFWKPRNLNISQHGSDMQVSFDHAPHNFGFRFFYLHYKLKHEGPFKRKTCKQEQTTETTSCLLQNVSPGDYIIELVDDTNTTRKVMHYALKPVHSPWAGPIRAVAITVPLVVISAFATLFTVMCRKKQQENIYSHLDEESSESSTYTAALPRERLRPRPKVFLCYSSKDGQNHMNVVQCFAYFLQDFCGCEVALDLWEDFSLCREGQREWVIQKIHESQFIIVVCSKGMKYFVDKKNYKHKGGGRGSGKGELFLVAVSAIAEKLRQAKQSSSAALSKFIAVYFDYSCEGDVPGILDLSTKYRLMDNLPQLCSHLHSRDHGLQEPGQHTRQGSRRNYFRSKSGRSLYVAICNMHQFIDEEPDWFEKQFVPFHPPPLRYREPVLEKFDSGLVLNDVMCKPGPESDFCLKVEAAVLGATGPADSQHESQHGGLDQDGEARPALDGSAALQPLLHTVKAGSPSDMPRDSGIYDSSVPSSELSLPLMEGLSTDQTETSSLTESVSSSSGLGEEEPPALPSKLLSSGSCKADLGCRSYTDELHAVAPL

SEQ ID NO: 41431 - protein, 595 aa, Homo sapiens
  Payload ID: 8430
  Gene Symbol: IL17RD
  Gene Name: interleukin 17 receptor D
  Uniprot ID: Q8NFM7
  ENSP ID: ENSP00000322250
MESQPFLNMKFETDYFVKVVPFPSIKNESNYHPFFFRTRACDLLLQPDNLACKPFWKPRNLNISQHGSDMQVSFDHAPHNFGFRFFYLHYKLKHEGPFKRKTCKQEQTTETTSCLLQNVSPGDYIIELVDDTNTTRKVMHYALKPVHSPWAGPIRAVAITVPLVVISAFATLFTVMCRKKQQENIYSHLDEESSESSTYTAALPRERLRPRPKVFLCYSSKDGQNHMNVVQCFAYFLQDFCGCEVALDLWEDFSLCREGQREWVIQKIHESQFIIVVCSKGMKYFVDKKNYKHKGGGRGSGKGELFLVAVSAIAEKLRQAKQSSSAALSKFIAVYFDYSCEGDVPGILDLSTKYRLMDNLPQLCSHLHSRDHGLQEPGQHTRQGSRRNYFRSKSGRSLYVAICNMHQFIDEEPDWFEKQFVPFHPPPLRYREPVLEKFDSGLVLNDVMCKPGPESDFCLKVEAAVLGATGPADSQHESQHGGLDQDGEARPALDGSAALQPLLHTVKAGSPSDMPRDSGIYDSSVPSSELSLPLMEGLSTDQTETSSLTESVSSSSGLGEEEPPALPSKLLSSGSCKADLGCRSYTDELHAVAPL

SEQ ID NO: 41432 - protein, 595 aa, Homo sapiens; identical to SEQ ID NO: 41431
  Payload ID: 8430
  Gene Symbol: IL17RD
  Gene Name: interleukin 17 receptor D
  Uniprot ID: Q8NFM7
  ENSP ID: ENSP00000417516

SEQ ID NO: 41433 - protein, 73 aa, Homo sapiens
  Payload ID: 8430
  Gene Symbol: IL17RD
  Gene Name: interleukin 17 receptor D
  ENSP ID: ENSP00000418368
MESQPFLNMKFETDYFVKVVPFPSIKNESNYHPFFFRTRACDLLLQPDNLACKPFWKPRNLNISQHGSDMQVS

SEQ ID NO: 41434 - protein, 667 aa, Homo sapiens
  Payload ID: 8431
  Gene Symbol: IL17RE
  Gene Name: interleukin 17 receptor E
  Uniprot ID: Q8NFR9
  ENSP ID: ENSP00000373325
MGSSRLAALLLPLLLIVIDLSDSAGIGFRHLPHWNTRCPLASHTDDSFTGSSAYIPCRTWWALFSTKPWCVRVWHCSRCLCQHLLSGGSGLQRGLFHLLVQKSKKSSTFKFYRRHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGGHTVELPYEFLLPCLCIEASYLQEDTVRRKKCPFQSWPEAYGSDFWKSVHFTDYSQHTQMVMALTLRCPLKLEAALCQRHDWHTLCKDLPNATARESDGWYVLEKVDLHPQLCFKFSFGNSSHVECPHQTGSLTSWNVSMDTQAQQLILHFSSRMHATFSAAWSLPGLGQDTLVPPVYTVSQARGSSPVSLDLIIPFLRPGCCVLVWRSDVQFAWKHLLCPDVSYRHLGLLILALLALLTLLGVVLALTCRRPQSGPGPARPVLLLHAADSEAQRRLVGALAELLRAALGGGRDVIVDLWEGRHVARVGPLPWLWAARTRVAREQGTVLLLWSGADLRPVSGPDPRAAPLLALLHAAPRPLLLLAYFSRLCAKGDIPPPLRALPRYRLLRDLPRLLRALDARPFAEATSWGRLGARQRRQSRLELCSRLEREAARLADLG

SEQ ID NO: 41435 - protein, 186 aa, Homo sapiens
  Payload ID: 8431
  Gene Symbol: IL17RE
  Gene Name: interleukin 17 receptor E
  ENSP ID: ENSP00000373326
MGSSRLAALLLPLLLIVIDLSDSAGIGFRHLPHWNTRCPLASHTEVLPISLAAPGGPSSPQSLGVCESGTVPAVCASICCQVAQVFNGASSTSWCRNPKSLPHSSSIGDTRCQHLLRGSCCLVVTCLRRAITFPSPPQTSPTRDFALKGPNLRIQRHGKVFPDWTHKGMEDPSSPLICCLRPGLFG

SEQ ID NO: 41436 - protein, 533 aa, Homo sapiens
  Payload ID: 8431
  Gene Symbol: IL17RE
  Gene Name: interleukin 17 receptor E
  Uniprot ID: Q8NFR9
  ENSP ID: ENSP00000388086
MGSSRLAALLLPLLLIVIDLSDSAGIGFRHLPHWNTRCPLASHTDDSFTGSSAYIPCRTWWALFSTKPWCVRVWHCSRCLCQHLLSGGSGLQRGLFHLLVQKSKKSSTFKFYRRHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGGHTVELPYEFLLPCLCIEASYLQEDTVRRKKCPFQSWPEAYGSDFWKSVHFTDYSQHTQMVMALTLRCPLKLEAALCQRHDWHTLCKDLPNATARESDGWYVLEKVDLHPQLCFKFSFGNSSHVECPHQTGSLTSWNVSMDTQAQQLILHFSSRMHATFSAAWSLPGLGQDTLVPPVYTVSQARGSSPVSLDLIIPFLRPGCCVLLHASLSSPGGEDAWLIGVGGSVPSGVAVRCPVCLEAPLVSGCLLQTPGALDPGTAGPPHPTGCCSGPHLPAPTVRPGPSAASAPPARGGLGGAAAPGGSAG

SEQ ID NO: 41437 - protein, 173 aa, Homo sapiens
  Payload ID: 8431
  Gene Symbol: IL17RE
  Gene Name: interleukin 17 receptor E
  ENSP ID: ENSP00000400768
MGSSRLAALLLPLLLIVIDLSDSAGIGFRHLPHWNTRCPLASHTDDSFTGLQRGLFHLLVQKSKKSSTFKFYRRHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECE

SEQ ID NO: 41438 - protein, 700 aa, Homo sapiens
  Payload ID: 8431
  Gene Symbol: IL17RE
  Gene Name: interleukin 17 receptor E
  ENSP ID: ENSP00000404916
MLAPFLLLLTHSRSPLSFRPCSHVPGALIAQKPMGSSRLAALLLPLLLIVIDLSDSAGIGFRHLPHWNTRCPLASHTDDSFTGSSAYIPCRTWWALFSTKPWCVRVWHCSRCLCQHLLSGGSGLQRGLFHLLVQKSKKSSTFKFYRRHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGGHTVELPYEFLLPCLCIEASYLQEDTVRRKKCPFQSWPEAYGSDFWKSVHFTDYSQHTQMVMALTLRCPLKLEAALCQRHDWHTLCKDLPNATARESDGWYVLEKVDLHPQLCFKFSFGNSSHVECPHQTGSLTSWNVSMDTQAQQLILHFSSRMHATFSAAWSLPGLGQDTLVPPVYTVSQARGSSPVSLDLIIPFLRPGCCVLVWRSDVQFAWKHLLCPDVSYRHLGLLILALLALLTLLGVVLALTCRRPQSGPGPARPVLLLHAADSEAQRRLVGALAELLRAALGGGRDVIVDLWEGRHVARVGPLPWLWAARTRVAREQGTVLLLWSGADLRPVSGPDPRAAPLLALLHAAPRPLLLLAYFSRLCAKGDIPPPLRALPRYRLLRDLPRLLRALDARPFAEATSWGRLGARQRRQSRLELCSRLEREAARLADLG

SEQ ID NO: 41439 - protein, 190 aa, Homo sapiens
  Payload ID: 8431
  Gene Symbol: IL17RE
  Gene Name: interleukin 17 receptor E
  ENSP ID: ENSP00000406076
MGSSRLAALLLPLLLIVIDLSDSAGIGFRHLPHWNTRCPLASHTRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGGHTVELPYEFLLPCLCIEMARTSGSQCTSLTTASTLRWSWP

SEQ ID NO: 41440 - protein, 146 aa, Homo sapiens
  Payload ID: 8431
  Gene Symbol: IL17RE
  Gene Name: interleukin 17 receptor E
  ENSP ID: ENSP00000415701
MGSSRLAALLLPLLLIVIDLSDSAGIGFRHLPHWNTRCPLASHTVFNGASSTSWCRNPKSLPHSSSIGDTRCQHLLRGSCCLVVTCLRRAITFPSPPQTSPTRDFALKGPNLRIQRHGKVFPDWTHKGMEDPSSPLICCLRPGLFG

SEQ ID NO: 41441 - protein, 336 aa, Homo sapiens
  Payload ID: 8432
  Gene Symbol: IL17REL
  Gene Name: interleukin 17 receptor E-like
  Uniprot ID: Q6ZVW7
  ENSP ID: ENSP00000342520
MSRSVLEALTSSTAMQCVPSDGCAMLLRVRASITLHERLRGLEACAMSLDTQETQCQSVWVARASHRQQGGQQLQVHFGCFAVSVAQHLYVTLRTIPHFCGVQLDQRHLVEAGKLSYWVDRRRKAILVQVPRASGSPDYYLRLCLKRFTCEDAGAPVRVTANSVSQAVFLPYSQELPCLCLEGWSATPDAVRIQICPFENDTEALEVLWDTVYYHPESQTLSWEPACPVSGHVSLCWRPGPGAGCRKLQQSSQLVHRRVQYPLVDTQPQLCLKFSTSWGSWVRCPFEQRRFPTPPTSRCTCVTGGSHSSLPANAHSRPARSLQPQVTWQPPLLLPS

SEQ ID NO: 41442 - protein, 336 aa, Homo sapiens; identical to SEQ ID NO: 41441
  Payload ID: 8432
  Gene Symbol: IL17REL
  Gene Name: interleukin 17 receptor E-like
  Uniprot ID: Q6ZVW7
  ENSP ID: ENSP00000374633

SEQ ID NO: 41443 - protein, 155 aa, Homo sapiens
  Payload ID: 8433
  Gene Symbol: IL17A
  Gene Name: interleukin 17A
  Uniprot ID: Q16552
  ENSP ID: ENSP00000344192
MTPGKTSLVSLLLLLSLEAIVKAGITIPRNPGCPNSEDKNFPRTVMVNLNIHNRNTNTNPKRSSDYYNRSTSPWNLHRNEDPERYPSVIWEAKCRHLGCINADGNVDYHMNSVPIQQEILVLRREPPHCPNSFRLEKILVSVGCTCVTPIVHHVA

SEQ ID NO: 41444 - protein, 180 aa, Homo sapiens
  Payload ID: 8434
  Gene Symbol: IL17B
  Gene Name: interleukin 17B
  Uniprot ID: Q9UHF5
  ENSP ID: ENSP00000261796
MDWPHNLLFLLTISIFLGLGQPRSPKSKRKGQGRPGPLAPGPHQVPLDLVSRMKPYARMEEYERNIEEMVAQLRNSSELAQRKCEVNLQLWMSNKRSLSPWGYSINHDPSRIPVDLPEARCLCLGCVNPFTMQEDRSMVSVPVFSQVPVRRRLCPPPPRTGPCRQRAVMETIAVGCTCIF

SEQ ID NO: 41445 - protein, 197 aa, Homo sapiens
  Payload ID: 8435
  Gene Symbol: IL17C
  Gene Name: interleukin 17C
  Uniprot ID: Q9P0M4
  ENSP ID: ENSP00000244241
MTLLPGLLFLTWLHTCLAHHDPSLRGHPHSHGTPHCYSAEELPLGQAPPHLLARGAKWGQALPVALVSSLEAASHRGRHERPSATTQCPVLRPEEVLEADTHQRSISPWRYRVDTDEDRYPQKLAFAECLCRGCIDARTGRETAALNSVRLLQSLLVLRRRPCSRDGSGLPTPGAFAFHTEFIHVPVGCTCVLPRSV

SEQ ID NO: 41446 - protein, 202 aa, Homo sapiens
  Payload ID: 8436
  Gene Symbol: IL17D
  Gene Name: interleukin 17D
  Uniprot ID: Q8TAD2
  ENSP ID: ENSP00000302924
MLVAGFLLALPPSWAAGAPRAGRRPARPRGCADRPEELLEQLYGRLAAGVLSAFHHTLQLGPREQARNASCPAGGRPADRRFRPPTNLRSVSPWAYRISYDPARYPRYLPEAYCLCRGCLTGLFGEEDVRFRSAPVYMPTVVLRRTPACAGGRSVYTEAYVTIPVGCTCVPEPEKDADSINSSIDKQGAKLLLGPNDAPAGP

SEQ ID NO: 41447 - protein, 35 aa, Homo sapiens
  Payload ID: 8436
  Gene Symbol: IL17D
  Gene Name: interleukin 17D
  ENSP ID: ENSP00000479852
MLGALVWMLVAGFLLALPPSWAAGAPRAGRRPARP

SEQ ID NO: 41448 - protein, 90 aa, Homo sapiens
  Payload ID: 8436
  Gene Symbol: IL17D
  Gene Name: interleukin 17D
  ENSP ID: ENSP00000480610
  MOD_RES (1)..(1): Any amino acid
XRPRGCADRPEELLEQLYGRLAAGVLSAFHHTLQLGPREQARNASCPAGGRPADRRFRPPTNLRSVSPWAYSSVSITSNHPWRTRPLFLD

SEQ ID NO: 41449 - protein, 163 aa, Homo sapiens
  Payload ID: 8437
  Gene Symbol: IL17F
  Gene Name: interleukin 17F
  Uniprot ID: Q96PD4
  ENSP ID: ENSP00000337432
MTVKTLHGPAMVKYLLLSILGLAFLSEAAARKIPKVGHTFFQKPESCPPVPGGSMKLDIGIINENQRVSMSRNIESRSTSPWNYTVTWDPNRYPSEVVQAQCRNLGCINAQGKEDISMNSVPIQQETLVVRRKHQGCSVSFQLEKVLVTVGCTCVTPVIHHVQ

SEQ ID NO: 41450 - protein, 193 aa, Homo sapiens
  Payload ID: 8438
  Gene Symbol: IL18
  Gene Name: interleukin 18
  Uniprot ID: Q14116
  ENSP ID: ENSP00000280357
MAAEPVEDNCINFVAMKFIDNTLYFIAEDDENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 41451 - protein, 193 aa, Homo sapiens; identical to SEQ ID NO: 41450
  Payload ID: 8438
  Gene Symbol: IL18
  Gene Name: interleukin 18
  Uniprot ID: Q14116
  ENSP ID: ENSP00000434161

SEQ ID NO: 41452 - protein, 189 aa, Homo sapiens
  Payload ID: 8438
  Gene Symbol: IL18
  Gene Name: interleukin 18
  Uniprot ID: Q14116
  ENSP ID: ENSP00000434561
MAAEPVEDNCINFVAMKFIDNTLYFIENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 41453 - protein, 194 aa, Homo sapiens
  Payload ID: 8439
  Gene Symbol: IL18BP
  Gene Name: interleukin 18 binding protein
  Uniprot ID: O95998
  ENSP ID: ENSP00000260049
MTMRHNWTPDLSPLWVLLLCAHVVTLLVRATPVSQTTTAATASVRSTKDPCPSQPPVFPAAKQCPALEVTWPEVEVPLNGTLSLSCVACSRFPNFSILYWLGNGSFIEHLPGRLWEGSTSRERGSTGTQLCKALVLEQLTPALHSTNFSCVLVDPEQVVQRHVVLAQLWAGLRATLPPTQEALPSSHSSPQQQG

SEQ ID NO: 41454 - protein, 194 aa, Homo sapiens; identical to SEQ ID NO: 41453
  Payload ID: 8439
  Gene Symbol: IL18BP
  Gene Name: interleukin 18 binding protein
  Uniprot ID: O95998
  ENSP ID: ENSP00000338723

SEQ ID NO: 41455 - protein, 163 aa, Homo sapiens
  Payload ID: 8439
  Gene Symbol: IL18BP
  Gene Name: interleukin 18 binding protein
  Uniprot ID: O95998
  ENSP ID: ENSP00000343309
MTMRHNWTPDLSPLWVLLLCAHVVTLLVRATPVSQTTTAATASVRSTKDPCPSQPPVFPAAKQCPALEVTWPEVEVPLNGTLSLSCVACSRFPNFSILYWLGNGSFIEHLPGRLWEGSTSRERGSTGWAEGNLAPHPRSPALQPQQSTAAGLRLSTGPAAAQP

SEQ ID NO: 41456 - protein, 194 aa, Homo sapiens; identical to SEQ ID NO: 41453
  Payload ID: 8439
  Gene Symbol: IL18BP
  Gene Name: interleukin 18 binding protein
  Uniprot ID: O95998
  ENSP ID: ENSP00000377306

SEQ ID NO: 41457 - protein, 194 aa, Homo sapiens; identical to SEQ ID NO: 41453
  Payload ID: 8439
  Gene Symbol: IL18BP
  Gene Name: interleukin 18 binding protein
  Uniprot ID: O95998
  ENSP ID: ENSP00000377308

SEQ ID NO: 41458 - protein, 115 aa, Homo sapiens
  Payload ID: 8439
  Gene Symbol: IL18BP
  Gene Name: interleukin 18 binding protein
  Uniprot ID: O95998
  ENSP ID: ENSP00000377310
MTMRHNWTPDLSPLWVLLLCAHVVTLLVRATPVSQTTTAATASVRSTKDPCPSQPPVFPAAKQCPALEVTWPEVEVPLSWAEGNLAPHPRSPALQPQQSTAAGLRLSTGPAAAQP

SEQ ID NO: 41459 - protein, 194 aa, Homo sapiens; identical to SEQ ID NO: 41453
  Payload ID: 8439
  Gene Symbol: IL18BP
  Gene Name: interleukin 18 binding protein
  Uniprot ID: O95998
  ENSP ID: ENSP00000384212

SEQ ID NO: 41460 - protein, 194 aa, Homo sapiens; identical to SEQ ID NO: 41453
  Payload ID: 8439
  Gene Symbol: IL18BP
  Gene Name: interleukin 18 binding protein
  Uniprot ID: O95998
  ENSP ID: ENSP00000434376

SEQ ID NO: 41461 - protein, 199 aa, Homo sapiens
  Payload ID: 8439
  Gene Symbol: IL18BP
  Gene Name: interleukin 18 binding protein
  ENSP ID: ENSP00000434717
MTMRHNWTPDLSPLWVLLLCAHVVTLLVRATPVSQTTTAATASVRSTKDPCPSQPPVFPAAKQCPALEVTWPEVEVPLNGTLSLSCVACSRFPNFSILYWLGNGSFIEHLPGRLWEGSTSRERGSTGTQLCKALVLEQLTPALHSTNFSCVLVDPEQVVQRHVVLAQLWVRSPRRGLQEQEELCFHMWGGKGGLCQSSL

SEQ ID NO: 41462 - protein, 199 aa, Homo sapiens; identical to SEQ ID NO: 41461
  Payload ID: 8439
  Gene Symbol: IL18BP
  Gene Name: interleukin 18 binding protein
  ENSP ID: ENSP00000434835

SEQ ID NO: 41463 - protein, 163 aa, Homo sapiens; identical to SEQ ID NO: 41455
  Payload ID: 8439
  Gene Symbol: IL18BP
  Gene Name: interleukin 18 binding protein
  Uniprot ID: O95998
  ENSP ID: ENSP00000480621

SEQ ID NO: 41464 - protein, 541 aa, Homo sapiens
  Payload ID: 8440
  Gene Symbol: IL18R1
  Gene Name: interleukin 18 receptor 1
  Uniprot ID: Q13478
  ENSP ID: ENSP00000233957
MNCRELPLTLWVLISVSTAESCTSRPHITVVEGEPFYLKHCSCSLAHEIETTTKSWYKSSGSQEHVELNPRSSSRIALHDCVLEFWPVELNDTGSYFFQMKNYTQKWKLNVIRRNKHSCFTERQVTSKIVEVKKFFQITCENSYYQTLVNSTSLYKNCKKLLLENNKNPTIKKNAEFEDQGYYSCVHFLHHNGKLFNITKTFNITIVEDRSNIVPVLLGPKLNHVAVELGKNVRLNCSALLNEEDVIYWMFGEENGSDPNIHEEKEMRIMTPEGKWHASKVLRIENIGESNLNVLYNCTVASTGGTDTKSFILVRKADMADIPGHVFTRGMIIAVLILVAVVCLVTVCVIYRVDLVLFYRHLTRRDETLTDGKTYDAFVSYLKECRPENGEEHTFAVEILPRVLEKHFGYKLCIFERDVVPGGAVVDEIHSLIEKSRRLIIVLSKSYMSNEVRYELESGLHEALVERKIKIILIEFTPVTDFTFLPQSLKLLKSHRVLKWKADKSLSYNSRFWKNLLYLMPAKTVKPGRDEPEVLPVLSES

SEQ ID NO: 41465 - protein, 170 aa, Homo sapiens
  Payload ID: 8440
  Gene Symbol: IL18R1
  Gene Name: interleukin 18 receptor 1
  ENSP ID: ENSP00000334030
MNCRELPLTLWVLISVSTAESCTSRPHITVVEGEPFYLKHCSCSLAHEIETTTKSWYKSSGSQEHVELNPRSSSRIALHDCVLEFWPVELNDTGSYFFQMKNYTQKWKLNVIRRNKHSCFTERQVTSKIVEVKKFFQITCENSYYQTLVNSTSLYKIGPPICRKTSSGLH

SEQ ID NO: 41466 - protein, 541 aa, Homo sapiens; identical to SEQ ID NO: 41464
  Payload ID: 8440
  Gene Symbol: IL18R1
  Gene Name: interleukin 18 receptor 1
  Uniprot ID: Q13478
  ENSP ID: ENSP00000386663

SEQ ID NO: 41467 - protein, 541 aa, Homo sapiens; identical to SEQ ID NO: 41464
  Payload ID: 8440
  Gene Symbol: IL18R1
  Gene Name: interleukin 18 receptor 1
  Uniprot ID: Q13478
  ENSP ID: ENSP00000387211

SEQ ID NO: 41468 - protein, 599 aa, Homo sapiens
  Payload ID: 8441
  Gene Symbol: IL18RAP
  Gene Name: interleukin 18 receptor accessory protein
  Uniprot ID: O95256
  ENSP ID: ENSP00000264260
MLCLGWIFLWLVAGERIKGFNISGCSTKKLLWTYSTRSEEEFVLFCDLPEPQKSHFCHRNRLSPKQVPEHLPFMGSNDLSDVQWYQQPSNGDPLEDIRKSYPHIIQDKCTLHFLTPGVNNSGSYICRPKMIKSPYDVACCVKMILEVKPQTNASCEYSASHKQDLLLGSTGSISCPSLSCQSDAQSPAVTWYKNGKLLSVERSNRIVVDEVYDYHQGTYVCDYTQSDTVSSWTVRAVVQVRTIVGDTKLKPDILDPVEDTLEVELGKPLTISCKARFGFERVFNPVIKWYIKDSDLEWEVSVPEAKSIKSTLKDEIIERNIILEKVTQRDLRRKFVCFVQNSIGNTTQSVQLKEKRGVVLLYILLGTIGTLVAVLAASALLYRHWIEIVLLYRTYQSKDQTLGDKKDFDAFVSYAKWSSFPSEATSSLSEEHLALSLFPDVLENKYGYSLCLLERDVAPGGVYAEDIVSIIKRSRRGIFILSPNYVNGPSIFELQAAVNLALDDQTLKLILIKFCYFQEPESLPHLVKKALRVLPTVTWRGLKSVPPNSRFWAKMRYHMPVKNSQGFTWNQLRITSRIFQWKGLSRTETTGRSSQPKEW

SEQ ID NO: 41469 - protein, 457 aa, Homo sapiens
  Payload ID: 8441
  Gene Symbol: IL18RAP
  Gene Name: interleukin 18 receptor accessory protein
  Uniprot ID: O95256
  ENSP ID: ENSP00000387201
MILEVKPQTNASCEYSASHKQDLLLGSTGSISCPSLSCQSDAQSPAVTWYKNGKLLSVERSNRIVVDEVYDYHQGTYVCDYTQSDTVSSWTVRAVVQVRTIVGDTKLKPDILDPVEDTLEVELGKPLTISCKARFGFERVFNPVIKWYIKDSDLEWEVSVPEAKSIKSTLKDEIIERNIILEKVTQRDLRRKFVCFVQNSIGNTTQSVQLKEKRGVVLLYILLGTIGTLVAVLAASALLYRHWIEIVLLYRTYQSKDQTLGDKKDFDAFVSYAKWSSFPSEATSSLSEEHLALSLFPDVLENKYGYSLCLLERDVAPGGVYAEDIVSIIKRSRRGIFILSPNYVNGPSIFELQAAVNLALDDQTLKLILIKFCYFQEPESLPHLVKKALRVLPTVTWRGLKSVPPNSRFWAKMRYHMPVKNSQGFTWNQLRITSRIFQWKGLSRTETTGRSSQPKEW

SEQ ID NO: 41470 - protein, 44 aa, Homo sapiens
  Payload ID: 8441
  Gene Symbol: IL18RAP
  Gene Name: interleukin 18 receptor accessory protein
  ENSP ID: ENSP00000389815
MLCLGWIFLWLVAGERIKGFNISGCSTKKLLWTYSTRSEEEFVL

SEQ ID NO: 41471 - protein, 177 aa, Homo sapiens
  Payload ID: 8442
  Gene Symbol: IL19
  Gene Name: interleukin 19
  Uniprot ID: Q9UHD0
  ENSP ID: ENSP00000270218
MKLQCVSLWLLGTILILCSVDNHGLRRCLISTDMHHIEESFQEIKRAIQAKDTFPNVTILSTLETLQIIKPLDVCCVTKNLLAFYVDRVFKDHQEPNPKILRKISSIANSFLYMQKTLRQCQEQRQCHCRQEATNATRVIHDNYDQLEVHAAAIKSLGELDVFLAWINKNHEVMFSA

SEQ ID NO: 41472 - protein, 215 aa, Homo sapiens
  Payload ID: 8442
  Gene Symbol: IL19
  Gene Name: interleukin 19
  Uniprot ID: Q9UHD0
  ENSP ID: ENSP00000343000
MCTEGAFPHRSACSLPLTHVHTHIHVCVPVLWGSVPRGMKLQCVSLWLLGTILILCSVDNHGLRRCLISTDMHHIEESFQEIKRAIQAKDTFPNVTILSTLETLQIIKPLDVCCVTKNLLAFYVDRVFKDHQEPNPKILRKISSIANSFLYMQKTLRQCQEQRQCHCRQEATNATRVIHDNYDQLEVHAAAIKSLGELDVFLAWINKNHEVMFSA

SEQ ID NO: 41473 - protein, 177 aa, Homo sapiens; identical to SEQ ID NO: 41471
  Payload ID: 8442
  Gene Symbol: IL19
  Gene Name: interleukin 19
  Uniprot ID: Q9UHD0
  ENSP ID: ENSP00000482668

SEQ ID NO: 41474 - protein, 153 aa, Homo sapiens
  Payload ID: 8443
  Gene Symbol: IL2
  Gene Name: interleukin 2
  Uniprot ID: P60568
  ENSP ID: ENSP00000226730
MYRMQLLSCIALSLALVTNSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 41475 - protein, 263 aa, Homo sapiens
  Payload ID: 8444
  Gene Symbol: IL2RA
  Gene Name: interleukin 2 receptor, alpha
  ENSP ID: ENSP00000256876
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEEKPQASPEGRPESETSCLVTTTDFQIQTEMAATMETSIFTTEYQVAVAGCVFLLISVLLLSGLTWQRRQRKSRRTI

SEQ ID NO: 41476 - protein, 200 aa, Homo sapiens
  Payload ID: 8444
  Gene Symbol: IL2RA
  Gene Name: interleukin 2 receptor, alpha
  ENSP ID: ENSP00000369287
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGEEKPQASPEGRPESETSCLVTTTDFQIQTEMAATMETSIFTTEYQVAVAGCVFLLISVLLLSGLTWQRRQRKSRRTI

SEQ ID NO: 41477 - protein, 272 aa, Homo sapiens
  Payload ID: 8444
  Gene Symbol: IL2RA
  Gene Name: interleukin 2 receptor, alpha
  Uniprot ID: P01589
  ENSP ID: ENSP00000369293
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 41478 - protein, 109 aa, Homo sapiens
  Payload ID: 8444
  Gene Symbol: IL2RA
  Gene Name: interleukin 2 receptor, alpha
  ENSP ID: ENSP00000402024
  MOD_RES (1)..(1): Any amino acid
XIPHATFKAMAYKEGTMLNCECKRGFRRIKSGSLYMLCTGNSSHSSWDNQCQCTSSATRNTTKQVTPQPEEQKERKTTEMQSPMQPVDQASLPDFQIQTEMAATMETSI

SEQ ID NO: 41479 - protein, 551 aa, Homo sapiens
  Payload ID: 8445
  Gene Symbol: IL2RB
  Gene Name: interleukin 2 receptor, beta
  Uniprot ID: P14784
  ENSP ID: ENSP00000216223
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 41480 - protein, 105 aa, Homo sapiens
  Payload ID: 8445
  Gene Symbol: IL2RB
  Gene Name: interleukin 2 receptor, beta
  ENSP ID: ENSP00000400416
TCFYNSRANISCVWSQDGALQDTSCQVHAWPDRRSLQLPWDQAGMREQDKVPMREECHGASGGGSAPHSGWHRGPSLALLPGAILAAERSEKSPLGQLCGSFLFF

SEQ ID NO: 41481 - protein, 88 aa, Homo sapiens
  Payload ID: 8445
  Gene Symbol: IL2RB
  Gene Name: interleukin 2 receptor, beta
  ENSP ID: ENSP00000401020
MAAPALSWRLPLLILLLPLATSWASAAVNGTSQFTCFYNSRANISCVWSQDGALQDTSCQVHAWPDRRRWNQTCELLPVSQASWACNL

SEQ ID NO: 41482 - protein, 146 aa, Homo sapiens
  Payload ID: 8445
  Gene Symbol: IL2RB
  Gene Name: interleukin 2 receptor, beta
  ENSP ID: ENSP00000402685
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETH

SEQ ID NO: 41483 - protein, 188 aa, Homo sapiens
  Payload ID: 8445
  Gene Symbol: IL2RB
  Gene Name: interleukin 2 receptor, beta
  ENSP ID: ENSP00000403731
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQ

SEQ ID NO: 41484 - protein, 98 aa, Homo sapiens
  Payload ID: 8446
  Gene Symbol: IL2RG
  Gene Name: interleukin 2 receptor, gamma
  ENSP ID: ENSP00000363303
MEPPNPLGEQYFKRTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 41485 - protein, 369 aa, Homo sapiens
  Payload ID: 8446
  Gene Symbol: IL2RG
  Gene Name: interleukin 2 receptor, gamma
  Uniprot ID: P31785
  ENSP ID: ENSP00000363318
MLKPSLPFTSLLFLQLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 41486 - protein, 179 aa, Homo sapiens
  Payload ID: 8446
  Gene Symbol: IL2RG
  Gene Name: interleukin 2 receptor, gamma
  Uniprot ID: P31785
  ENSP ID: ENSP00000388967
MGMKTPQLEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 41487 - protein, 65 aa, Homo sapiens
  Payload ID: 8446
  Gene Symbol: IL2RG
  Gene Name: interleukin 2 receptor, gamma
  ENSP ID: ENSP00000421262
  MOD_RES (1)..(1): Any amino acid
XWTEQSVDYRHKFSLPSVDGQKRYTFRVRSRFNPLCGSAQHWSEWSHPIHWGSNTSKGRCPEFPP

SEQ ID NO: 41488 - protein, 99 aa, Homo sapiens
  Payload ID: 8446
  Gene Symbol: IL2RG
  Gene Name: interleukin 2 receptor, gamma
  ENSP ID: ENSP00000423601
MGMKTPQLVGNLGLEGADFFLTTMPTDSLSVSTLPLPEVQCFVFNVEYMNCTWNSSSEPQPTNLTLHYWYKNSDNDKVQKCSHYLFSEEITSGCQLQKK

SEQ ID NO: 41489 - protein, 176 aa, Homo sapiens
  Payload ID: 8446
  Gene Symbol: IL2RG
  Gene Name: interleukin 2 receptor, gamma
  ENSP ID: ENSP00000423966
MSHRAWPPPSDHHFSFPPCLHFLPNLDFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQ

SEQ ID NO: 41490 - protein, 219 aa, Homo sapiens
  Payload ID: 8446
  Gene Symbol: IL2RG
  Gene Name: interleukin 2 receptor, gamma
  ENSP ID: ENSP00000425233
MPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAV

SEQ ID NO: 41491 - protein, 176 aa, Homo sapiens
  Payload ID: 8447
  Gene Symbol: IL20
  Gene Name: interleukin 20
  Uniprot ID: Q9NYY1
  ENSP ID: ENSP00000356063
MKASSLAFSLLSAAFYLLWTPSTGLKTLNLGSCVIATNLQEIRNGFSEIRGSVQAKDGNIDIRILRRTESLQDTKPANRCCLLRHLLRLYLDRVFKNYQTPDHYTLRKISSLANSFLTIKKDLRLCHAHMTCHCGEEAMKKYSQILSHFEKLEPQAAVVKALGELDILLQWMEETE

SEQ ID NO: 41492 - protein, 176 aa, Homo sapiens; identical to SEQ ID NO: 41491
  Payload ID: 8447
  Gene Symbol: IL20
  Gene Name: interleukin 20
  Uniprot ID: Q9NYY1
  ENSP ID: ENSP00000356065

SEQ ID NO: 41493 - protein, 151 aa, Homo sapiens
  Payload ID: 8447
  Gene Symbol: IL20
  Gene Name: interleukin 20
  Uniprot ID: Q9NYY1
  ENSP ID: ENSP00000375796
MKASSLAFSLLSAAFYLLWTPSTGLKTLNLGSCVIATNLQEIRNGFSEIRGSVQAKDGNIDIRILRRTESLQDTKPANRCCLLRHLLRLYLDRVFKNYQTPDHYTLRKISSLANSFLTIKKDLRLCLEPQAAVVKALGELDILLQWMEETE

SEQ ID NO: 41494 - protein, 311 aa, Homo sapiens
  Payload ID: 8448
  Gene Symbol: IL20RB
  Gene Name: interleukin 20 receptor beta
  Uniprot ID: Q6UXL0
  ENSP ID: ENSP00000328133
MQTFTMVLEEIWTSLFMWFFYALIPCLLTDEVAILPAPQNLSVLSTNMKHLLMWSPVIAPGETVYYSVEYQGEYESLYTSHIWIPSSWCSLTEGPECDVTDDITATVPYNLRVRATLGSQTSAWSILKHPFNRNSTILTRPGMEITKDGFHLVIELEDLGPQFEFLVAYWRREPGAEEHVKMVRSGGIPVHLETMEPGAAYCVKAQTFVKAIGRYSAFSQTECVEVQGEAIPLVLALFAFVGFMLILVVVPLFVWKMGRLLQYSCCPVVVLPDTLKITNSPQKLISCRREEVDACATAVMSPEELLRAWIS

SEQ ID NO: 41495 - protein, 55 aa, Homo sapiens
  Payload ID: 8448
  Gene Symbol: IL20RB
  Gene Name: interleukin 20 receptor beta
  ENSP ID: ENSP00000417437
MAGAPSPASLPPCSLISDCCASNQRDSVGVGPSEPGWSAVVQSQLTATSASEALH

SEQ ID NO: 41496 - protein, 49 aa, Homo sapiens
  Payload ID: 8448
  Gene Symbol: IL20RB
  Gene Name: interleukin 20 receptor beta
  ENSP ID: ENSP00000418637
MQTFTMVLEEIWTSLFMWFFYALIPCLLTGWSAVVQSQLTATSASEALH

SEQ ID NO: 41497 - protein, 120 aa, Homo sapiens
  Payload ID: 8448
  Gene Symbol: IL20RB
  Gene Name: interleukin 20 receptor beta
  ENSP ID: ENSP00000420725
AILPAPQNLSVLSTNMKHLLMWSPVIAPGETVYYSVEYQGEYESLYTSHIWIPSSWCSLTEGPECDVTDDITATVPYNLRVRATLGSQTSAWSILKHPFNRNSRTAFLLSVHLCPELVGS

SEQ ID NO: 41498 - protein, 553 aa, Homo sapiens
  Payload ID: 8449
  Gene Symbol: IL20RA
  Gene Name: interleukin 20 receptor, alpha
  Uniprot ID: Q9UHF4
  ENSP ID: ENSP00000314976
MRAPGRPALRPLPLPPLLLLLLAAPWGRAVPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPVSITVFLFSVMGYSIYRYIHVGKEKHPANLILIYGNEFDKRFFVPAEKIVINFITLNISDDSKISHQDMSLLGKSSDVSSLNDPQPSGNLRPPQEEEEVKHLGYASHLMEIFCDSEENTEGTSLTQQESLSRTIPPDKTVIEYEYDVRTTDICAGPEEQELSLQEEVSTQGTLLESQAALAVLGPQTLQYSYTPQLQDLDPLAQEHTDSEEGPEEEPSTTLVDWDPQTGRLCIPSLSSFDQDSEGCEPSEGDGLGEEGLLSRLYEEPAPDRPPGENETYLMQFMEEWGLYVQMEN

SEQ ID NO: 41499 - protein, 209 aa, Homo sapiens
  Payload ID: 8449
  Gene Symbol: IL20RA
  Gene Name: interleukin 20 receptor, alpha
  ENSP ID: ENSP00000356720
MRAPGRPALRPLPLPPLLLLLLAAPWGRAVPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTVSLKWNGAYIHVPLCS

SEQ ID NO: 41500 - protein, 442 aa, Homo sapiens
  Payload ID: 8449
  Gene Symbol: IL20RA
  Gene Name: interleukin 20 receptor, alpha
  Uniprot ID: Q9UHF4
  ENSP ID: ENSP00000356722
MSYNGLHQRVFKELKLLTLCSISSQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPVSITVFLFSVMGYSIYRYIHVGKEKHPANLILIYGNEFDKRFFVPAEKIVINFITLNISDDSKISHQDMSLLGKSSDVSSLNDPQPSGNLRPPQEEEEVKHLGYASHLMEIFCDSEENTEGTSLTQQESLSRTIPPDKTVIEYEYDVRTTDICAGPEEQELSLQEEVSTQGTLLESQAALAVLGPQTLQYSYTPQLQDLDPLAQEHTDSEEGPEEEPSTTLVDWDPQTGRLCIPSLSSFDQDSEGCEPSEGDGLGEEGLLSRLYEEPAPDRPPGENETYLMQFMEEWGLYVQMEN

SEQ ID NO: 41501 - protein, 504 aa, Homo sapiens
  Payload ID: 8449
  Gene Symbol: IL20RA
  Gene Name: interleukin 20 receptor, alpha
  Uniprot ID: Q9UHF4
  ENSP ID: ENSP00000437843
MKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPVSITVFLFSVMGYSIYRYIHVGKEKHPANLILIYGNEFDKRFFVPAEKIVINFITLNISDDSKISHQDMSLLGKSSDVSSLNDPQPSGNLRPPQEEEEVKHLGYASHLMEIFCDSEENTEGTSLTQQESLSRTIPPDKTVIEYEYDVRTTDICAGPEEQELSLQEEVSTQGTLLESQAALAVLGPQTLQYSYTPQLQDLDPLAQEHTDSEEGPEEEPSTTLVDWDPQTGRLCIPSLSSFDQDSEGCEPSEGDGLGEEGLLSRLYEEPAPDRPPGENETYLMQFMEEWGLYVQMEN

SEQ ID NO: 41502 - protein, 42 aa, Homo sapiens
  Payload ID: 8449
  Gene Symbol: IL20RA
  Gene Name: interleukin 20 receptor, alpha
  ENSP ID: ENSP00000489141
MRAPGRPALRPLPLPPLLLLLLAAPWGRAGYSRPLLGLWAKV

SEQ ID NO: 41503 - protein, 177 aa, Homo sapiens
  Payload ID: 8449
  Gene Symbol: IL20RA
  Gene Name: interleukin 20 receptor, alpha
  ENSP ID: ENSP00000489177
MSYNGLHQRVFKELKLLTLCSISSQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPVSITVFLFSVMGYSIYRYIHVGKEKHPANL

SEQ ID NO: 41504 - protein, 89 aa, Homo sapiens
  Payload ID: 8449
  Gene Symbol: IL20RA
  Gene Name: interleukin 20 receptor, alpha
  ENSP ID: ENSP00000489419
MSYNGLHQRVFKELKLLTLCSISSPEKWKRNPEDLPVSMQQIYSNLKYNVSVLNTKSNRTWSQCVTNHTLVLTWLEPNTLYCVHVESFV

SEQ ID NO: 41505 - protein, 162 aa, Homo sapiens
  Payload ID: 8450
  Gene Symbol: IL21
  Gene Name: interleukin 21
  Uniprot ID: Q9HBE4
  ENSP ID: ENSP00000264497
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 41506 - protein, 153 aa, Homo sapiens
  Payload ID: 8450
  Gene Symbol: IL21
  Gene Name: interleukin 21
  Uniprot ID: Q9HBE4
  ENSP ID: ENSP00000477555
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKVSTLSFI

SEQ ID NO: 41507 - protein, 538 aa, Homo sapiens
  Payload ID: 8451
  Gene Symbol: IL21R
  Gene Name: interleukin 21 receptor
  Uniprot ID: Q9HBE5
  ENSP ID: ENSP00000338010
MPRGWAAPLLLLLLQGGWGCPDLVCYTDYLQTVICILEMWNLHPSTLTLTWQDQYEELKDEATSCSLHRSAHNATHATYTCHMDVFHFMADDIFSVNITDQSGNYSQECGSFLLAESIKPAPPFNVTVTFSGQYNISWRSDYEDPAFYMLKGKLQYELQYRNRGDPWAVSPRRKLISVDSRSVSLLPLEFRKDSSYELQVRAGPMPGSSYQGTWSEWSDPVIFQTQSEELKEGWNPHLLLLLLLVIVFIPAFWSLKTHPLWRLWKKIWAVPSPERFFMPLYKGCSGDFKKWVGAPFTGSSLELGPWSPEVPSTLEVYSCHPPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQAS

SEQ ID NO: 41508 - protein, 538 aa, Homo sapiens; identical to SEQ ID NO: 41507
  Payload ID: 8451
  Gene Symbol: IL21R
  Gene Name: interleukin 21 receptor
  Uniprot ID: Q9HBE5
  ENSP ID: ENSP00000379103

SEQ ID NO: 41509 - protein, 538 aa, Homo sapiens; identical to SEQ ID NO: 41507
  Payload ID: 8451
  Gene Symbol: IL21R
  Gene Name: interleukin 21 receptor
  Uniprot ID: Q9HBE5
  ENSP ID: ENSP00000456707

SEQ ID NO: 41510 - protein, 179 aa, Homo sapiens
  Payload ID: 8452
  Gene Symbol: IL22
  Gene Name: interleukin 22
  Uniprot ID: Q9GZX6
  ENSP ID: ENSP00000329384
MAALQKSVSSFLMGTLATSCLLLLALLVQGGAAAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 41511 - protein, 179 aa, Homo sapiens; identical to SEQ ID NO: 41510
  Payload ID: 8452
  Gene Symbol: IL22
  Gene Name: interleukin 22
  Uniprot ID: Q9GZX6
  ENSP ID: ENSP00000442424

SEQ ID NO: 41512 - protein, 574 aa, Homo sapiens
  Payload ID: 8453
  Gene Symbol: IL22RA1
  Gene Name: interleukin 22 receptor, alpha 1
  Uniprot ID: Q8N6P7
  ENSP ID: ENSP00000270800
MRTLLTILTVGSLAAHAPEDPSDLLQHVKFQSSNFENILTWDSGPEGTPDTVYSIEYKTYGERDWVAKKGCQRITRKSCNLTVETGNLTELYYARVTAVSAGGRSATKMTDRFSSLQHTTLKPPDVTCISKVRSIQMIVHPTPTPIRAGDGHRLTLEDIFHDLFYHLELQVNRTYQMHLGGKQREYEFFGLTPDTEFLGTIMICVPTWAKESAPYMCRVKTLPDRTWTYSFSGAFLFSMGFLVAVLCYLSYRYVTKPPAPPNSLNVQRVLTFQPLRFIQEHVLIPVFDLSGPSSLAQPVQYSQIRVSGPREPAGAPQRHSLSEITYLGQPDISILQPSNVPPPQILSPLSYAPNAAPEVGPPSYAPQVTPEAQFPFYAPQAISKVQPSSYAPQATPDSWPPSYGVCMEGSGKDSPTGTLSSPKHLRPKGQLQKEPPAGSCMLGGLSLQEVTSLAMEESQEAKSLHQPLGICTDRTSDPNVLHSGEEGTPQYLKGQLPLLSSVQIEGHPMSLPLQPPSRPCSPSDQGPSPWGLLESLVCPKDEAKSPAPETSDLEQPTELDSLFRGLALTVQWES

SEQ ID NO: 41513 - protein, 231 aa, Homo sapiens
  Payload ID: 8454
  Gene Symbol: IL22RA2
  Gene Name: interleukin 22 receptor, alpha 2
  Uniprot ID: Q969J5
  ENSP ID: ENSP00000296979
MMPKHCFLGFLISFFLTGVAGTQSTHESLKPQRVQFQSRNFHNILQWQPGRALTGNSSVYFVQYKIYGQRQWKNKEDCWGTQELSCDLTSETSDIQEPYYGRVRAASAGSYSEWSMTPRFTPWWETKIDPPVMNITQVNGSLLVILHAPNLPYRYQKEKNVSIEDYYELLYRVFIINNSLEKEQKVYEGAHRAVEIEALTPHSSYCVVAEIYQPMLDRRSQRSEERCVEIP

SEQ ID NO: 41514 - protein, 263 aa, Homo sapiens
  Payload ID: 8454
  Gene Symbol: IL22RA2
  Gene Name: interleukin 22 receptor, alpha 2
  Uniprot ID: Q969J5
  ENSP ID: ENSP00000296980
MMPKHCFLGFLISFFLTGVAGTQSTHESLKPQRVQFQSRNFHNILQWQPGRALTGNSSVYFVQYKIMFSCSMKSSHQKPSGCWQHISCNFPGCRTLAKYGQRQWKNKEDCWGTQELSCDLTSETSDIQEPYYGRVRAASAGSYSEWSMTPRFTPWWETKIDPPVMNITQVNGSLLVILHAPNLPYRYQKEKNVSIEDYYELLYRVFIINNSLEKEQKVYEGAHRAVEIEALTPHSSYCVVAEIYQPMLDRRSQRSEERCVEIP

SEQ ID NO: 41515 - protein, 130 aa, Homo sapiens
  Payload ID: 8454
  Gene Symbol: IL22RA2
  Gene Name: interleukin 22 receptor, alpha 2
  Uniprot ID: Q969J5
  ENSP ID: ENSP00000340920
MMPKHCFLGFLISFFLTGVAGTQSTHESLKPQRVQFQSRNFHNILQWQPGRALTGNSSVYFVQYKIYGQRQWKNKEDCWGTQELSCDLTSETSDIQEPYYGRVRAASAGSYSEWSMTPRFTPWWERAKGL

SEQ ID NO: 41516 - protein, 629 aa, Homo sapiens
  Payload ID: 8455
  Gene Symbol: IL23R
  Gene Name: interleukin 23 receptor
  Uniprot ID: Q5VWK5
  ENSP ID: ENSP00000321345
MNQVTIQWDAVIALYILFSWCHGGITNINCSGHIWVEPATIFKMGMNISIYCQAAIKNCQPRKLHFYKNGIKERFQITRINKTTARLWYKNFLEPHASMYCTAECPKHFQETLICGKDISSGYPPDIPDEVTCVIYEYSGNMTCTWNAGKLTYIDTKYVVHVKSLETEEEQQYLTSSYINISTDSLQGGKKYLVWVQAANALGMEESKQLQIHLDDIVIPSAAVISRAETINATVPKTIIYWDSQTTIEKVSCEMRYKATTNQTWNVKEFDTNFTYVQQSEFYLEPNIKYVFQVRCQETGKRYWQPWSSLFFHKTPETVPQVTSKAFQHDTWNSGLTVASISTGHLTSDNRGDIGLLLGMIVFAVMLSILSLIGIFNRSFRTGIKRRILLLIPKWLYEDIPNMKNSNVVKMLQENSELMNNNSSEQVLYVDPMITEIKEIFIPEHKPTDYKKENTGPLETRDYPQNSLFDNTTVVYIPDLNTGYKPQISNFLPEGSHLSNNNEITSLTLKPPVDSLDSGNNPRLQKHPNFAFSVSSVNSLSNTIFLGELSLILNQGECSSPDIQNSVEEETTMLLENDSPSETIPEQTLLPDEFVSCLGIVNEELPSINTYFPQNILESHFNRISLLEK

SEQ ID NO: 41517 - protein, 227 aa, Homo sapiens
  Payload ID: 8455
  Gene Symbol: IL23R
  Gene Name: interleukin 23 receptor
  Uniprot ID: Q5VWK5
  ENSP ID: ENSP00000378652
MKNSNVVKMLQENSELMNNNSSEQVLYVDPMITEIKEIFIPEHKPTDYKKENTGPLETRDYPQNSLFDNTTVVYIPDLNTGYKPQISNFLPEGSHLSNNNEITSLTLKPPVDSLDSGNNPRLQKHPNFAFSVSSVNSLSNTIFLGELSLILNQGECSSPDIQNSVEEETTMLLENDSPSETIPEQTLLPDEFVSCLGIVNEELPSINTYFPQNILESHFNRISLLEK

SEQ ID NO: 41518 - protein, 374 aa, Homo sapiens
  Payload ID: 8455
  Gene Symbol: IL23R
  Gene Name: interleukin 23 receptor
  Uniprot ID: Q5VWK5
  ENSP ID: ENSP00000387640
MILRPYQPCGTVKEFDTNFTYVQQSEFYLEPNIKYVFQVRCQETGKRYWQPWSSLFFHKTPETVPQVTSKAFQHDTWNSGLTVASISTGHLTSDNRGDIGLLLGMIVFAVMLSILSLIGIFNRSFRTGIKRRILLLIPKWLYEDIPNMKNSNVVKMLQENSELMNNNSSEQVLYVDPMITEIKEIFIPEHKPTDYKKENTGPLETRDYPQNSLFDNTTVVYIPDLNTGYKPQISNFLPEGSHLSNNNEITSLTLKPPVDSLDSGNNPRLQKHPNFAFSVSSVNSLSNTIFLGELSLILNQGECSSPDIQNSVEEETTMLLENDSPSETIPEQTLLPDEFVSCLGIVNEELPSINTYFPQNILESHFNRISLLEK

SEQ ID NO: 41519 - protein, 71 aa, Homo sapiens
  Payload ID: 8455
  Gene Symbol: IL23R
  Gene Name: interleukin 23 receptor
  ENSP ID: ENSP00000486667
MILRPYQPCGTVKEFDTNFTYVQQSEFYLEPNIKYVFQVRCQETGKRYWQPWSSLFFHKTPETGLKEGSYC

SEQ ID NO: 41520 - protein, 189 aa, Homo sapiens
  Payload ID: 8456
  Gene Symbol: IL23A
  Gene Name: interleukin 23, alpha subunit p19
  Uniprot ID: Q9NPF7
  ENSP ID: ENSP00000228534
MLGSRAVMLLLLLPWTAQGRAVPGGSSPAWTQCQQLSQKLCTLAWSAHPLVGHMDLREEGDEETTNDVPHIQCGDGCDPQGLRDNSQFCLQRIHQGLIFYEKLLGSDIFTGEPSLLPDSPVGQLHASLLGLSQLLQPEGHHWETQQIPSLSPSQPWQRLLLRFKILRSLQAFVAVAARVFAHGAATLSP

SEQ ID NO: 41521 - protein, 206 aa, Homo sapiens
  Payload ID: 8457
  Gene Symbol: IL24
  Gene Name: interleukin 24
  Uniprot ID: Q13007
  ENSP ID: ENSP00000294984
MNFQQRLQSLWTLARPFCPPLLATASQMQMVVLPCLGFTLLLWSQVSGAQGQEFHFGPCQVKGVVPQKLWEAFWAVKDTMQAQDNITSARLLQQEVLQNVSDAESCYLVHTLLEFYLKTVFKNYHNRTVEVRTLKSFSTLANNFVLIVSQLQPSQENEMFSIRDSAHRRFLLFRRAFKQLDVEAALTKALGEVDILLTWMQKFYKL

SEQ ID NO: 41522 - protein, 154 aa, Homo sapiens
  Payload ID: 8457
  Gene Symbol: IL24
  Gene Name: interleukin 24
  Uniprot ID: Q13007
  ENSP ID: ENSP00000356060
MNFQQRLQSLWTLASRPFCPPLLATASQMQMVVLPCLGFTLLLWSQVSGAQGQEFHFGPCQVKGVVPQKLWEAFWAVKDTMQAQDNITSARLLQQEVLQNVSQENEMFSIRDSAHRRFLLFRRAFKQLDVEAALTKALGEVDILLTWMQKFYKL

SEQ ID NO: 41523 - protein, 51 aa, Homo sapiens
  Payload ID: 8457
  Gene Symbol: IL24
  Gene Name: interleukin 24
  ENSP ID: ENSP00000356062
MNFQQRLQSLWTLASKLRITSRVPGCCSRRFCRTSRMLRAVTLSTPCWSST

SEQ ID NO: 41524 - protein, 207 aa, Homo sapiens
  Payload ID: 8457
  Gene Symbol: IL24
  Gene Name: interleukin 24
  Uniprot ID: Q13007
  ENSP ID: ENSP00000375795
MNFQQRLQSLWTLASRPFCPPLLATASQMQMVVLPCLGFTLLLWSQVSGAQGQEFHFGPCQVKGVVPQKLWEAFWAVKDTMQAQDNITSARLLQQEVLQNVSDAESCYLVHTLLEFYLKTVFKNYHNRTVEVRTLKSFSTLANNFVLIVSQLQPSQENEMFSIRDSAHRRFLLFRRAFKQLDVEAALTKALGEVDILLTWMQKFYKL

SEQ ID NO: 41525 - protein, 60 aa, Homo sapiens
  Payload ID: 8457
  Gene Symbol: IL24
  Gene Name: interleukin 24
  ENSP ID: ENSP00000418933
MNFQQRLQSLWTLASKLRITSRVPGCCSRRFCRTSRKKMRCFPSETVHTGGFCYSGEHSN

SEQ ID NO: 41526 - protein, 63 aa, Homo sapiens
  Payload ID: 8457
  Gene Symbol: IL24
  Gene Name: interleukin 24
  Uniprot ID: Q13007
  ENSP ID: ENSP00000484900
MNFQQRLQSLWTLASKLRITSRVPGCCSRRFCRTSRKKMRCFPSETVHTGGFCYSGEHSNSWT

SEQ ID NO: 41527 - protein, 177 aa, Homo sapiens
  Payload ID: 8458
  Gene Symbol: IL25
  Gene Name: interleukin 25
  Uniprot ID: Q9H293
  ENSP ID: ENSP00000328111
MRERPRLGEDSSLISLFLQVVAFLAMVMGTHTYSHWPSCCPSKGQDTSEELLRWSTVPVPPLEPARPNRHPESCRASEDGPLNSRAISPWRYELDRDLNRLPQDLYHARCLCPHCVSLQTGSHMDPRGNSELLYHNQTVFYRRPCHGEKGTHKGYCLERRLYRVSLACVCVRPRVMG

SEQ ID NO: 41528 - protein, 161 aa, Homo sapiens
  Payload ID: 8458
  Gene Symbol: IL25
  Gene Name: interleukin 25
  Uniprot ID: Q9H293
  ENSP ID: ENSP00000380417
MYQVVAFLAMVMGTHTYSHWPSCCPSKGQDTSEELLRWSTVPVPPLEPARPNRHPESCRASEDGPLNSRAISPWRYELDRDLNRLPQDLYHARCLCPHCVSLQTGSHMDPRGNSELLYHNQTVFYRRPCHGEKGTHKGYCLERRLYRVSLACVCVRPRVMG

SEQ ID NO: 41529 - protein, 171 aa, Homo sapiens
  Payload ID: 8459
  Gene Symbol: IL26
  Gene Name: interleukin 26
  Uniprot ID: Q9NPH9
  ENSP ID: ENSP00000229134
MLVNFILRCGLLLVTLSLAIAKHKQSSFTKSCYPRGTLSQAVDALYIKAAWLKATIPEDRIKNIRLLKKKTKKQFMKNCQFQEQLLSFFMEDVFGQLQLQGCKKIRFVEDFHSLRQKLSHCISCASSAREMKSITRMKRIFYRIGNKGIYKAISELDILLSWIKKLLESSQ

SEQ ID NO: 41530 - protein, 243 aa, Homo sapiens
  Payload ID: 8460
  Gene Symbol: IL27
  Gene Name: interleukin 27
  Uniprot ID: Q8NEV9
  ENSP ID: ENSP00000349365
MGQTAGDLGWRLSLLLLPLLLVQAGVWGFPRPPGRPQLSLQELRREFTVSLHLARKLLSEVRGQAHRFAESHLPGVNLYLLPLGEQLPDVSLTFQAWRRLSDPERLCFISTTLQPFHALLGGLGTQGRWTNMERMQLWAMRLDLRDLQRHLRFQVLAAGFNLPEEEEEEEEEEEEERKGLLPGALGSALQGPAQVSWPQLLSTYRLLHSLELVLSRAVRELLLLSKAGHSVWPLGFPTLSPQP

SEQ ID NO: 41531 - protein, 23 aa, Homo sapiens
  Payload ID: 8460
  Gene Symbol: IL27
  Gene Name: interleukin 27
  ENSP ID: ENSP00000455990
MERMQLWAMRLDLRDLQRHLRFQ

SEQ ID NO: 41532 - protein, 636 aa, Homo sapiens
  Payload ID: 8461
  Gene Symbol: IL27RA
  Gene Name: interleukin 27 receptor, alpha
  Uniprot ID: Q6UWB1
  ENSP ID: ENSP00000263379
MRGGRGAPFWLWPLPKLALLPLLWVLFQRTRPQGSAGPLQCYGVGPLGDLNCSWEPLGDLGAPSELHLQSQKYRSNKTQTVAVAAGRSWVAIPREQLTMSDKLLVWGTKAGQPLWPPVFVNLETQMKPNAPRLGPDVDFSEDDPLEATVHWAPPTWPSHKVLICQFHYRRCQEAAWTLLEPELKTIPLTPVEIQDLELATGYKVYGRCRMEKEEDLWGEWSPILSFQTPPSAPKDVWVSGNLCGTPGGEEPLLLWKAPGPCVQVSYKVWFWVGGRELSPEGITCCCSLIPSGAEWARVSAVNATSWEPLTNLSLVCLDSASAPRSVAVSSIAGSTELLVTWQPGPGEPLEHVVDWARDGDPLEKLNWVRLPPGNLSALLPGNFTVGVPYRITVTAVSASGLASASSVWGFREELAPLVGPTLWRLQDAPPGTPAIAWGEVPRHQLRGHLTHYTLCAQSGTSPSVCMNVSGNTQSVTLPDLPWGPCELWVTASTIAGQGPPGPILRLHLPDNTLRWKVLPGILFLWGLFLLGCGLSLATSGRCYHLRHKVLPRWVWEKVPDPANSSSGQPHMEQVPEAQPLGDLPILEVEEMEPPPVMESSQPAQATAPLDSGYEKHFLPTPEELGLLGPPRPQVLA

SEQ ID NO: 41533 - protein, 152 aa, Homo sapiens
  Payload ID: 8462
  Gene Symbol: IL3
  Gene Name: interleukin 3
  Uniprot ID: P08700
  ENSP ID: ENSP00000296870
MSRLPVLLLLQLLVRPGLQAPMTQTTPLKTSWVNCSNMIDEIITHLKQPPLPLLDFNNLNGEDQDILMENNLRRPNLEAFNRAVKSLQNASAIESILKNLLPCLPLATAAPTRHPIHIKDGDWNEFRRKLTFYLKTLENAQAQQTTLSLAIF

SEQ ID NO: 41534 - protein, 378 aa, Homo sapiens
  Payload ID: 8463
  Gene Symbol: IL3RA
  Gene Name: interleukin 3 receptor, alpha (low affinity)
  Uniprot ID: P26951
  ENSP ID: ENSP00000327890
MVLLWLTLLLIALPCLLQTKEDPNPPITNLRMKAKAQQLTWDLNRNVTDIECVKDADYSMPAVNNSYCQFGAISLCEVTNYTVRVANPPFSTWILFPENSGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWRTSLLIALGTLLALVCVFVICRRYLVMQRLFPRIPHMKDPIGDSFQNDKLVVWEAGKAGLEECLVTEVQVVQKT

SEQ ID NO: 41535 - protein, 300 aa, Homo sapiens
  Payload ID: 8463
  Gene Symbol: IL3RA
  Gene Name: interleukin 3 receptor, alpha (low affinity)
  Uniprot ID: P26951
  ENSP ID: ENSP00000370878
MVLLWLTLLLIALPCLLQTKEGGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWRTSLLIALGTLLALVCVFVICRRYLVMQRLFPRIPHMKDPIGDSFQNDKLVVWEAGKAGLEECLVTEVQVVQKT

SEQ ID NO: 41536 - protein, 164 aa, Homo sapiens
  Payload ID: 8463
  Gene Symbol: IL3RA
  Gene Name: interleukin 3 receptor, alpha (low affinity)
  ENSP ID: ENSP00000414867
MVLLWLTLLLIALPCLLQTKEGGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQI

SEQ ID NO: 41537 - protein, 164 aa, Homo sapiens
  Payload ID: 8464
  Gene Symbol: IL31
  Gene Name: interleukin 31
  Uniprot ID: Q6EBC2
  ENSP ID: ENSP00000366234
MASHSGPSTSVLFLFCCLGGWLASHTLPVRLLRPSDDVQKIVEELQSLSKMLLKDVEEEKGVLVSQNYTLPCLSPDAQPPNNIHSPAIRAYLKTIRQLDNKSVIDEIIEHLDKLIFQDAPETNISVPTDTHECKRFILTISQQFSECMDLALKSLTSGAQQATT

SEQ ID NO: 41538 - protein, 745 aa, Homo sapiens
  Payload ID: 8465
  Gene Symbol: IL31RA
  Gene Name: interleukin 31 receptor A
  Uniprot ID: Q8NI17
  ENSP ID: ENSP00000297015
MKLSPQPSCVNLGMMWTWALWMLPSLCKFSLAALPAKPENISCVYYYRKNLTCTWSPGKETSYTQYTVKRTYAFGEKHDNCTTNSSTSENRASCSFFLPRITIPDNYTIEVEAENGDGVIKSHMTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFSKTVNSSILQYGLESLKRKTSYIVQVMASTSAGGTNGTSINFKTLSFSVFEIILITSLIGGGLLILIILTVAYGLKKPNKLTHLCWPTVPNPAESSIATWHGDDFKDKLNLKESDDSVNTEDRILKPCSTPSDKLVIDKLVVNFGNVLQEIFTDEARTGQENNLGGEKNGYVTCPFRPDCPLGKSFEELPVSPEIPPRKSQYLRSRMPEGTRPEAKEQLLFSGQSLVPDHLCEEGAPNPYLKNSVTAREFLVSEKLPEHTKGEV

SEQ ID NO: 41539 - protein, 662 aa, Homo sapiens
  Payload ID: 8465
  Gene Symbol: IL31RA
  Gene Name: interleukin 31 receptor A
  Uniprot ID: Q8NI17
  ENSP ID: ENSP00000347047
MKLSPQPSCVNLGMMWTWALWMLPSLCKFSLAALPAKPENISCVYYYRKNLTCTWSPGKETSYTQYTVKRTYAFGEKHDNCTTNSSTSENRASCSFFLPRITIPDNYTIEVEAENGDGVIKSHMTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFSKTVNSSILQYGLESLKRKTSYIVQVMASTSAGGTNGTSINFKTLSFSVFEIILITSLIGGGLLILIILTVAYGLKKPNKLTHLCWPTVPNPAESSIATWHGDDFKDKLNLKESDDSVNTEDRILKPCSTPSDKLVIDKLVVNFGNVLQEIFTDEARTGQENNLGGEKNGTRILSSCPTSI

SEQ ID NO: 41540 - protein, 681 aa, Homo sapiens
  Payload ID: 8465
  Gene Symbol: IL31RA
  Gene Name: interleukin 31 receptor A
  Uniprot ID: Q8NI17
  ENSP ID: ENSP00000351935
MCIRQLKFFTTACVCECPQNILSPQPSCVNLGMMWTWALWMLPSLCKFSLAALPAKPENISCVYYYRKNLTCTWSPGKETSYTQYTVKRTYAFGEKHDNCTTNSSTSENRASCSFFLPRITIPDNYTIEVEAENGDGVIKSHMTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFSKTVNSSILQYGLESLKRKTSYIVQVMASTSAGGTNGTSINFKTLSFSVFEIILITSLIGGGLLILIILTVAYGLKKPNKLTHLCWPTVPNPAESSIATWHGDDFKDKLNLKESDDSVNTEDRILKPCSTPSDKLVIDKLVVNFGNVLQEIFTDEARTGQENNLGGEKNGTRILSSCPTSI

SEQ ID NO: 41541 - protein, 662 aa, Homo sapiens; identical to SEQ ID NO: 41539
  Payload ID: 8465
  Gene Symbol: IL31RA
  Gene Name: interleukin 31 receptor A
  Uniprot ID: Q8NI17
  ENSP ID: ENSP00000380046

SEQ ID NO: 41542 - protein, 582 aa, Homo sapiens
  Payload ID: 8465
  Gene Symbol: IL31RA
  Gene Name: interleukin 31 receptor A
  Uniprot ID: Q8NI17
  ENSP ID: ENSP00000380048
MCIRQLKFFTTACVCECPQNILSPQPSCVNLGMMWTWALWMLPSLCKFSLAALPAKPENISCVYYYRKNLTCTWSPGKETSYTQYTVKRTYAFGEKHDNCTTNSSTSENRASCSFFLPRITIPDNYTIEVEAENGDGVIKSHMTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFCKHAHSEVEKNPKPQIDAMDRPVVGMAPPSHCDLQPGMNHLASLNLSENGAKSTHLLGFWGLNESEVTVPERRVLRKWKELL

SEQ ID NO: 41543 - protein, 764 aa, Homo sapiens
  Payload ID: 8465
  Gene Symbol: IL31RA
  Gene Name: interleukin 31 receptor A
  Uniprot ID: Q8NI17
  ENSP ID: ENSP00000415900
MCIRQLKFFTTACVCECPQNILSPQPSCVNLGMMWTWALWMLPSLCKFSLAALPAKPENISCVYYYRKNLTCTWSPGKETSYTQYTVKRTYAFGEKHDNCTTNSSTSENRASCSFFLPRITIPDNYTIEVEAENGDGVIKSHMTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFSKTVNSSILQYGLESLKRKTSYIVQVMASTSAGGTNGTSINFKTLSFSVFEIILITSLIGGGLLILIILTVAYGLKKPNKLTHLCWPTVPNPAESSIATWHGDDFKDKLNLKESDDSVNTEDRILKPCSTPSDKLVIDKLVVNFGNVLQEIFTDEARTGQENNLGGEKNGYVTCPFRPDCPLGKSFEELPVSPEIPPRKSQYLRSRMPEGTRPEAKEQLLFSGQSLVPDHLCEEGAPNPYLKNSVTAREFLVSEKLPEHTKGEV

SEQ ID NO: 41544 - protein, 622 aa, Homo sapiens
  Payload ID: 8465
  Gene Symbol: IL31RA
  Gene Name: interleukin 31 receptor A
  Uniprot ID: Q8NI17
  ENSP ID: ENSP00000427533
MTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFSKTVNSSILQYGLESLKRKTSYIVQVMASTSAGGTNGTSINFKTLSFSVFEIILITSLIGGGLLILIILTVAYGLKKPNKLTHLCWPTVPNPAESSIATWHGDDFKDKLNLKESDDSVNTEDRILKPCSTPSDKLVIDKLVVNFGNVLQEIFTDEARTGQENNLGGEKNGYVTCPFRPDCPLGKSFEELPVSPEIPPRKSQYLRSRMPEGTRPEAKEQLLFSGQSLVPDHLCEEGAPNPYLKNSVTAREFLVSEKLPEHTKGEV

SEQ ID NO: 41545 - protein, 324 aa, Homo sapiens
  Payload ID: 8465
  Gene Symbol: IL31RA
  Gene Name: interleukin 31 receptor A
  ENSP ID: ENSP00000479432
MMWTWALWMLPSLCKFSLAALPAKPENISCVYYYRKNLTCTWSPGKETSYTQYTVKRTYAFGEKHDNCTTNSSTSENRASCSFFLPRITIPDNYTIEVEAENGDGVIKSHMTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEK

SEQ ID NO: 41546 - protein, 168 aa, Homo sapiens
  Payload ID: 8466
  Gene Symbol: IL32
  Gene Name: interleukin 32
  Uniprot ID: P24001
  ENSP ID: ENSP00000008180
MCFPKVLSDDMKKLKARMVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 41547 - protein, 188 aa, Homo sapiens
  Payload ID: 8466
  Gene Symbol: IL32
  Gene Name: interleukin 32
  Uniprot ID: P24001
  ENSP ID: ENSP00000324742
MCFPKVLSDDMKKLKARMHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 41548 - protein, 179 aa, Homo sapiens
  Payload ID: 8466
  Gene Symbol: IL32
  Gene Name: interleukin 32
  Uniprot ID: P24001
  ENSP ID: ENSP00000371648
MCFPKVLSDDMKKLKARMHQAIERFYDKMQNAESGRGQDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 41549 - protein, 131 aa, Homo sapiens
  Payload ID: 8466
  Gene Symbol: IL32
  Gene Name: interleukin 32
  Uniprot ID: P24001
  ENSP ID: ENSP00000380096
MCFPKVLSDDMKKLKARMHQAIERFYDKMQNAESGRGQVMSSLAELEDDFKEGYLETVAAYYEEQHPELTPLLEKERDGLRCRGNRSPVPDVEDPATEEPGESFCDKSYGAPRGDKEELTPQKCSEPQSSK

SEQ ID NO: 41550 - protein, 234 aa, Homo sapiens
  Payload ID: 8466
  Gene Symbol: IL32
  Gene Name: interleukin 32
  Uniprot ID: P24001
  ENSP ID: ENSP00000380099
MCFPKVLSDDMKKLKARMVMLLPTSAQGLGAWVSACDTEDTVGHLGPWRDKDPALWCQLCLSSQHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 41551 - protein, 188 aa, Homo sapiens; identical to SEQ ID NO: 41547
  Payload ID: 8466
  Gene Symbol: IL32
  Gene Name: interleukin 32
  Uniprot ID: P24001
  ENSP ID: ENSP00000405063

SEQ ID NO: 41552 - protein, 188 aa, Homo sapiens; identical to SEQ ID NO: 41547
  Payload ID: 8466
  Gene Symbol: IL32
  Gene Name: interleukin 32
  Uniprot ID: P24001
  ENSP ID: ENSP00000411958

SEQ ID NO: 41553 - protein, 131 aa, Homo sapiens
  Payload ID: 8466
  Gene Symbol: IL32
  Gene Name: interleukin 32
  ENSP ID: ENSP00000431740
MCFPKVLSDDMKKLKARMDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFM

SEQ ID NO: 41554 - protein, 234 aa, Homo sapiens; identical to SEQ ID NO: 41550
  Payload ID: 8466
  Gene Symbol: IL32
  Gene Name: interleukin 32
  Uniprot ID: P24001
  ENSP ID: ENSP00000431775

SEQ ID NO: 41555 - protein, 188 aa, Homo sapiens; identical to SEQ ID NO: 41547
  Payload ID: 8466
  Gene Symbol: IL32
  Gene Name: interleukin 32
  Uniprot ID: P24001
  ENSP ID: ENSP00000432218

SEQ ID NO: 41556 - protein, 188 aa, Homo sapiens; identical to SEQ ID NO: 41547
  Payload ID: 8466
  Gene Symbol: IL32
  Gene Name: interleukin 32
  Uniprot ID: P24001
  ENSP ID: ENSP00000432850

SEQ ID NO: 41557 - protein, 188 aa, Homo sapiens; identical to SEQ ID NO: 41547
  Payload ID: 8466
  Gene Symbol: IL32
  Gene Name: interleukin 32
  Uniprot ID: P24001
  ENSP ID: ENSP00000432917

SEQ ID NO: 41558 - protein, 178 aa, Homo sapiens
  Payload ID: 8466
  Gene Symbol: IL32
  Gene Name: interleukin 32
  Uniprot ID: P24001
  ENSP ID: ENSP00000433177
MKKLKARMHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 41559 - protein, 168 aa, Homo sapiens; identical to SEQ ID NO: 41546
  Payload ID: 8466
  Gene Symbol: IL32
  Gene Name: interleukin 32
  Uniprot ID: P24001
  ENSP ID: ENSP00000433747

SEQ ID NO: 41560 - protein, 221 aa, Homo sapiens
  Payload ID: 8466
  Gene Symbol: IL32
  Gene Name: interleukin 32
  ENSP ID: ENSP00000433866
MCFPKVLSDDMKKLKARMVMLLPTSAQGLGAWVSACDTEDTVGHLGPWRDKDPALWCQLCLSSQHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGATRGARRS

SEQ ID NO: 41561 - protein, 188 aa, Homo sapiens; identical to SEQ ID NO: 41547
  Payload ID: 8466
  Gene Symbol: IL32
  Gene Name: interleukin 32
  Uniprot ID: P24001
  ENSP ID: ENSP00000436929

SEQ ID NO: 41562 - protein, 168 aa, Homo sapiens
  Payload ID: 8466
  Gene Symbol: IL32
  Gene Name: interleukin 32
  ENSP ID: ENSP00000436937
MCFPKVLSDDMKKLKARMHQAIERFYDKMQNAESGRGQVMSSLAELEELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 41563 - protein, 188 aa, Homo sapiens; identical to SEQ ID NO: 41547
  Payload ID: 8466
  Gene Symbol: IL32
  Gene Name: interleukin 32
  Uniprot ID: P24001
  ENSP ID: ENSP00000437020

SEQ ID NO: 41564 - protein, 179 aa, Homo sapiens; identical to SEQ ID NO: 41548
  Payload ID: 8466
  Gene Symbol: IL32
  Gene Name: interleukin 32
  Uniprot ID: P24001
  ENSP ID: ENSP00000446624

SEQ ID NO: 41565 - protein, 168 aa, Homo sapiens; identical to SEQ ID NO: 41546
  Payload ID: 8466
  Gene Symbol: IL32
  Gene Name: interleukin 32
  Uniprot ID: P24001
  ENSP ID: ENSP00000446978

SEQ ID NO: 41566 - protein, 212 aa, Homo sapiens
  Payload ID: 8466
  Gene Symbol: IL32
  Gene Name: interleukin 32
  ENSP ID: ENSP00000447033
MCFPKGLGAWVSACDTEDTVGHLGPWRDKDPALWCQLCLSSQHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 41567 - protein, 131 aa, Homo sapiens; identical to SEQ ID NO: 41549
  Payload ID: 8466
  Gene Symbol: IL32
  Gene Name: interleukin 32
  Uniprot ID: P24001
  ENSP ID: ENSP00000447496

SEQ ID NO: 41568 - protein, 131 aa, Homo sapiens; identical to SEQ ID NO: 41549
  Payload ID: 8466
  Gene Symbol: IL32
  Gene Name: interleukin 32
  Uniprot ID: P24001
  ENSP ID: ENSP00000447812

SEQ ID NO: 41569 - protein, 148 aa, Homo sapiens
  Payload ID: 8466
  Gene Symbol: IL32
  Gene Name: interleukin 32
  Uniprot ID: P24001
  ENSP ID: ENSP00000447979
MCFPKVLSDDMKKLKARMVMSSLAELEELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 41570 - protein, 225 aa, Homo sapiens
  Payload ID: 8466
  Gene Symbol: IL32
  Gene Name: interleukin 32
  ENSP ID: ENSP00000448354
MCFPKVLSDDMKKLKARMVMLLPTSAQGLGAWVSACDTEDTVGHLGPWRDKDPALWCQLCLSSQHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQ

SEQ ID NO: 41571 - protein, 188 aa, Homo sapiens; identical to SEQ ID NO: 41547
  Payload ID: 8466
  Gene Symbol: IL32
  Gene Name: interleukin 32
  Uniprot ID: P24001
  ENSP ID: ENSP00000448683

SEQ ID NO: 41572 - protein, 225 aa, Homo sapiens
  Payload ID: 8466
  Gene Symbol: IL32
  Gene Name: interleukin 32
  ENSP ID: ENSP00000449147
MCFPKVLSDDMKKLKARMVMLLPTSAQGLGAWVSACDTEDTVGHLGPWRDKDPALWCQLCLSSQHQAIERFYDKMQNAESGRGQDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 41573 - protein, 234 aa, Homo sapiens; identical to SEQ ID NO: 41550
  Payload ID: 8466
  Gene Symbol: IL32
  Gene Name: interleukin 32
  Uniprot ID: P24001
  ENSP ID: ENSP00000449483

SEQ ID NO: 41574 - protein, 188 aa, Homo sapiens; identical to SEQ ID NO: 41547
  Payload ID: 8466
  Gene Symbol: IL32
  Gene Name: interleukin 32
  Uniprot ID: P24001
  ENSP ID: ENSP00000450364

SEQ ID NO: 41575 - protein, 168 aa, Homo sapiens; identical to SEQ ID NO: 41562
  Payload ID: 8466
  Gene Symbol: IL32
  Gene Name: interleukin 32
  ENSP ID: ENSP00000479701

SEQ ID NO: 41576 - protein, 270 aa, Homo sapiens
  Payload ID: 8467
  Gene Symbol: IL33
  Gene Name: interleukin 33
  Uniprot ID: O95760
  ENSP ID: ENSP00000370842
MKPKMKYSTNKISTAKWKNTASKALCFKLGKSQQKAKEVCPMYFMKLRSGLMIKKEACYFRRETTKRPSLKTGRKHKRHLVLAACQQQSTVECFAFGISGVQKYTRALHDSSITGISPITEYLASLSTYNDQSITFALEDESYEIYVEDLKKDEKKDKVLLSYYESQHPSNESGDGVDGKMLMVTLSPTKDFWLHANNKEHSVELHKCEKPLPDQAFFVLHNMHSNCVSFECKTDPGVFIGVKDNHLALIKVDSSENLCTENILFKLSET

SEQ ID NO: 41577 - protein, 144 aa, Homo sapiens
  Payload ID: 8467
  Gene Symbol: IL33
  Gene Name: interleukin 33
  Uniprot ID: O95760
  ENSP ID: ENSP00000394039
MKPKMKYSTNKISTAKWKNTASKALCFKLGNKVLLSYYESQHPSNESGDGVDGKMLMVTLSPTKDFWLHANNKEHSVELHKCEKPLPDQAFFVLHNMHSNCVSFECKTDPGVFIGVKDNHLALIKVDSSENLCTENILFKLSET

SEQ ID NO: 41578 - protein, 228 aa, Homo sapiens
  Payload ID: 8467
  Gene Symbol: IL33
  Gene Name: interleukin 33
  Uniprot ID: O95760
  ENSP ID: ENSP00000414238
MKPKMKYSTNKISTAKWKNTASKALCFKLGKSQQKAKEVCPMYFMKLRSGLMIKKEACYFRRETTKRPSLKTGRKHKRHLVLAACQQQSTVECFAFGISGVQKYTRALHDSSITDKVLLSYYESQHPSNESGDGVDGKMLMVTLSPTKDFWLHANNKEHSVELHKCEKPLPDQAFFVLHNMHSNCVSFECKTDPGVFIGVKDNHLALIKVDSSENLCTENILFKLSET

SEQ ID NO: 41579 - protein, 228 aa, Homo sapiens
  Payload ID: 8467
  Gene Symbol: IL33
  Gene Name: interleukin 33
  Uniprot ID: O95760
  ENSP ID: ENSP00000478858
MKPKMKYSTNKISTAKWKNTASKALCFKLGKSQQKAKEVCPMYFMKLRSGLMIKKEACYFRRETTKRPSLKTGISPITEYLASLSTYNDQSITFALEDESYEIYVEDLKKDEKKDKVLLSYYESQHPSNESGDGVDGKMLMVTLSPTKDFWLHANNKEHSVELHKCEKPLPDQAFFVLHNMHSNCVSFECKTDPGVFIGVKDNHLALIKVDSSENLCTENILFKLSET

SEQ ID NO: 41580 - protein, 242 aa, Homo sapiens
  Payload ID: 8468
  Gene Symbol: IL34
  Gene Name: interleukin 34
  Uniprot ID: Q6ZMJ4
  ENSP ID: ENSP00000288098
MPRGFTWLRYLGIFLGVALGNEPLEMWPLTQNEECTVTGFLRDKLQYRSRLQYMKHYFPINYKISVPYEGVFRIANVTRLQRAQVSERELRYLWVLVSLSATESVQDVLLEGHPSWKYLQEVETLLLNVQQGLTDVEVSPKVESVLSLLNAPGPNLKLVRPKALLDNCFRVMELLYCSCCKQSSVLNWQDCEVPSPQSCSPEPSLQYAATQLYPPPPWSPSSPPHSTGSVRPVRAQGEGLLP

SEQ ID NO: 41581 - protein, 242 aa, Homo sapiens; identical to SEQ ID NO: 41580
  Payload ID: 8468
  Gene Symbol: IL34
  Gene Name: interleukin 34
  Uniprot ID: Q6ZMJ4
  ENSP ID: ENSP00000397863

SEQ ID NO: 41582 - protein, 54 aa, Homo sapiens
  Payload ID: 8468
  Gene Symbol: IL34
  Gene Name: interleukin 34
  ENSP ID: ENSP00000455240
MPRGFTWLRYLGIFLGVALGNEPLEMWPLTQNEECTVTGFLRDKLQYRSRLQYM

SEQ ID NO: 41583 - protein, 217 aa, Homo sapiens
  Payload ID: 8468
  Gene Symbol: IL34
  Gene Name: interleukin 34
  ENSP ID: ENSP00000463886
MWPLTQNEECTVTGFLRDKLQYRSRLQYMKHYFPINYKISVPYEGVFRIANVTRLQRAQVSERELRYLWVLVSLSATESVQDVLLEGHPSWKYLQEVETLLLNVQQGLTDVEVSPKVESVLSLLNAPGPNLKLVRPKALLDNCFRVMELLYCSCCKQSSVLNWQDCEVPSPQSCSPEPSLQYAATQLYPPPPWSPSSPPHSTGSVRPVRAQGEGLLP

SEQ ID NO: 41584 - protein, 155 aa, Homo sapiens
  Payload ID: 8469
  Gene Symbol: IL36RN
  Gene Name: interleukin 36 receptor antagonist
  Uniprot ID: Q9UBH0
  ENSP ID: ENSP00000259212
MVLSGALCFRMKDSALKVLYLHNNQLLAGGLHAGKVIKGEEISVVPNRWLDASLSPVILGVQGGSQCLSCGVGQEPTLTLEPVNIMELYLGAKESKSFTFYRRDMGLTSSFESAAYPGWFLCTVPEADQPVRLTQLPENGGWNAPITDFYFQQCD

SEQ ID NO: 41585 - protein, 155 aa, Homo sapiens; identical to SEQ ID NO: 41584
  Payload ID: 8469
  Gene Symbol: IL36RN
  Gene Name: interleukin 36 receptor antagonist
  Uniprot ID: Q9UBH0
  ENSP ID: ENSP00000376896

SEQ ID NO: 41586 - protein, 117 aa, Homo sapiens
  Payload ID: 8469
  Gene Symbol: IL36RN
  Gene Name: interleukin 36 receptor antagonist
  ENSP ID: ENSP00000409262
MVLSGALCFRMKDSALKVLYLHNNQLLAGGLHAGKVIKGEEISVVPNRWLDASLSPVILGVQGGSQCLSCGVGQEPTLTLEPVNIMELYLGAKESKSFTFYRRDMGLTSSFESAAYP

SEQ ID NO: 41587 - protein, 52 aa, Homo sapiens
  Payload ID: 8469
  Gene Symbol: IL36RN
  Gene Name: interleukin 36 receptor antagonist
  ENSP ID: ENSP00000475308
  MOD_RES (1)..(1): Any amino acid
XMGLTSSFESAAYPGWFLCTVPEADQPVRLTQLPENGGWNAPITDFYFQQCD

SEQ ID NO: 41588 - protein, 158 aa, Homo sapiens
  Payload ID: 8470
  Gene Symbol: IL36A
  Gene Name: interleukin 36, alpha
  Uniprot ID: Q9UHA7
  ENSP ID: ENSP00000259211
MEKALKIDTPQQGSIQDINHRVWVLQDQTLIAVPRKDRMSPVTIALISCRHVETLEKDRGNPIYLGLNGLNLCLMCAKVGDQPTLQLKEKDIMDLYNQPEPVKSFLFYHSQSGRNSTFESVAFPGWFIAVSSEGGCPLILTQELGKANTTDFGLTMLF

SEQ ID NO: 41589 - protein, 164 aa, Homo sapiens
  Payload ID: 8471
  Gene Symbol: IL36B
  Gene Name: interleukin 36, beta
  Uniprot ID: Q9NZH7
  ENSP ID: ENSP00000259213
MNPQREAAPKSYAIRDSRQMVWVLSGNSLIAAPLSRSIKPVTLHLIACRDTEFSDKEKGNMVYLGIKGKDLCLFCAEIQGKPTLQLKLQGSQDNIGKDTCWKLVGIHTCINLDVRESCFMGTLDQWGIGVGRKKWKSSFQHHHLRKKDKDFSSMRTNIGMPGRM

SEQ ID NO: 41590 - protein, 157 aa, Homo sapiens
  Payload ID: 8471
  Gene Symbol: IL36B
  Gene Name: interleukin 36, beta
  Uniprot ID: Q9NZH7
  ENSP ID: ENSP00000328420
MNPQREAAPKSYAIRDSRQMVWVLSGNSLIAAPLSRSIKPVTLHLIACRDTEFSDKEKGNMVYLGIKGKDLCLFCAEIQGKPTLQLKEKNIMDLYVEKKAQKPFLFFHNKEGSTSVFQSVSYPGWFIATSTTSGQPIFLTKERGITNNTNFYLDSVE

SEQ ID NO: 41591 - protein, 169 aa, Homo sapiens
  Payload ID: 8472
  Gene Symbol: IL36G
  Gene Name: interleukin 36, gamma
  Uniprot ID: Q9NZH8
  ENSP ID: ENSP00000259205
MRGTPGDADGGGRAVYQSMCKPITGTINDLNQQVWTLQGQNLVAVPRSDSVTPVTVAVITCKYPEALEQGRGDPIYLGIQNPEMCLYCEKVGEQPTLQLKEQKIMDLYGQPEPVKPFLFYRAKTGRTSTLESVAFPDWFIASSKRDQPIILTSELGKSYNTAFELNIND

SEQ ID NO: 41592 - protein, 134 aa, Homo sapiens
  Payload ID: 8472
  Gene Symbol: IL36G
  Gene Name: interleukin 36, gamma
  Uniprot ID: Q9NZH8
  ENSP ID: ENSP00000365672
MRGTPGDADGGGRAVYQSITVAVITCKYPEALEQGRGDPIYLGIQNPEMCLYCEKVGEQPTLQLKEQKIMDLYGQPEPVKPFLFYRAKTGRTSTLESVAFPDWFIASSKRDQPIILTSELGKSYNTAFELNIND

SEQ ID NO: 41593 - protein, 38 aa, Homo sapiens
  Payload ID: 8472
  Gene Symbol: IL36G
  Gene Name: interleukin 36, gamma
  ENSP ID: ENSP00000411639
MRGTPGDADGGGRAVYQSMCKPITGTINDLNQQVWTLQ

SEQ ID NO: 41594 - protein, 218 aa, Homo sapiens
  Payload ID: 8473
  Gene Symbol: IL37
  Gene Name: interleukin 37
  Uniprot ID: Q9NZH6
  ENSP ID: ENSP00000263326
MSFVGENSGVKMGSEDWEKDEPQCCLEDPAGSPLEPGPSLPTMNFVHTSPKVKNLNPKKFSIHDQDHKVLVLDSGNLIAVPDKNYIRPEIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 41595 - protein, 197 aa, Homo sapiens
  Payload ID: 8473
  Gene Symbol: IL37
  Gene Name: interleukin 37
  Uniprot ID: Q9NZH6
  ENSP ID: ENSP00000263327
MSFVGENSGVKMGSEDWEKDEPQCCLEGPKVKNLNPKKFSIHDQDHKVLVLDSGNLIAVPDKNYIRPEIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 41596 - protein, 157 aa, Homo sapiens
  Payload ID: 8473
  Gene Symbol: IL37
  Gene Name: interleukin 37
  Uniprot ID: Q9NZH6
  ENSP ID: ENSP00000263328
MSFVGENSGVKMGSEDWEKDEPQCCLEEIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 41597 - protein, 178 aa, Homo sapiens
  Payload ID: 8473
  Gene Symbol: IL37
  Gene Name: interleukin 37
  Uniprot ID: Q9NZH6
  ENSP ID: ENSP00000309208
MSFVGENSGVKMGSEDWEKDEPQCCLEDPAGSPLEPGPSLPTMNFVHTKIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 41598 - protein, 192 aa, Homo sapiens
  Payload ID: 8473
  Gene Symbol: IL37
  Gene Name: interleukin 37
  Uniprot ID: Q9NZH6
  ENSP ID: ENSP00000309883
MSGCDRRETETKGKNSFKKRLRGPKVKNLNPKKFSIHDQDHKVLVLDSGNLIAVPDKNYIRPEIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 41599 - protein, 153 aa, Homo sapiens [sequence omitted]

SEQ ID NO: 41600 - protein, 137 aa, Homo sapiens
  Payload ID: 8474
  Gene Symbol: IL4
  Gene Name: interleukin 4
  Uniprot ID: P05112
  ENSP ID: ENSP00000325190
MGLTSQLLPPLFFLLACAGNFVHGHKCDITLQEIIKTLNSLTEQKNTTEKETFCRAATVLRQFYSHHEKDTRCLGATAQQFHRHKQLIRFLKRLDRNLWGLAGLNSCPVKEANQSTLENFLERLKTIMREKYSKCSS

SEQ ID NO: 41601 - protein, 136 aa, Homo sapiens
  Payload ID: 8474
  Gene Symbol: IL4
  Gene Name: interleukin 4
  ENSP ID: ENSP00000480581
MGLTSQLLPPLFFLLACAGNFVHGHKCDITLQEIIKTLNSLTEQKTLCTELTVTDIFAASKQHACLPTSRHTGTICRPPSARVPSTSTRLQSPERTQLRRKPSAGLRLCSGSSTATMRRTLAAWVRLHSSSTGTSS

SEQ ID NO: 41602 - protein, 589 aa, Homo sapiens
  Payload ID: 8475
  Gene Symbol: IL4I1
  Gene Name: interleukin 4 induced 1
  Uniprot ID: Q96RQ9
  ENSP ID: ENSP00000342557
MPNDDFCPGLTIKAMGAERAPQRQPCTLHLLVLVPILLSLVASQDWKAERSQDPFEKCMQDPDYEQLLKVVTWGLNRTLKPQRVIVVGAGVAGLVAAKVLSDAGHKVTILEADNRIGGRIFTYRDQNTGWIGELGAMRMPSSHRILHKLCQGLGLNLTKFTQYDKNTWTEVHEVKLRNYVVEKVPEKLGYALRPQEKGHSPEDIYQMALNQALKDLKALGCRKAMKKFERHTLLEYLLGEGNLSRPAVQLLGDVMSEDGFFYLSFAEALRAHSCLSDRLQYSRIVGGWDLLPRALLSSLSGLVLLNAPVVAMTQGPHDVHVQIETSPPARNLKVLKADVVLLTASGPAVKRITFSPPLPRHMQEALRRLHYVPATKVFLSFRRPFWREEHIEGGHSNTDRPSRMIFYPPPREGALLLASYTWSDAAAAFAGLSREEALRLALDDVAALHGPVVRQLWDGTGVVKRWAEDQHSQGGFVVQPPALWQTEKDDWTVPYGRIYFAGEHTAYPHGWVETAVKSALRAAIKINSRKGPASDTASPEGHASDMEGQGHVHGVASSPSHDLAKEEGSHPPVQGQLSLQNTTHTRTSH

SEQ ID NO: 41603 - protein, 567 aa, Homo sapiens
  Payload ID: 8475
  Gene Symbol: IL4I1
  Gene Name: interleukin 4 induced 1
  Uniprot ID: Q96RQ9
  ENSP ID: ENSP00000375702
MAPLALHLLVLVPILLSLVASQDWKAERSQDPFEKCMQDPDYEQLLKVVTWGLNRTLKPQRVIVVGAGVAGLVAAKVLSDAGHKVTILEADNRIGGRIFTYRDQNTGWIGELGAMRMPSSHRILHKLCQGLGLNLTKFTQYDKNTWTEVHEVKLRNYVVEKVPEKLGYALRPQEKGHSPEDIYQMALNQALKDLKALGCRKAMKKFERHTLLEYLLGEGNLSRPAVQLLGDVMSEDGFFYLSFAEALRAHSCLSDRLQYSRIVGGWDLLPRALLSSLSGLVLLNAPVVAMTQGPHDVHVQIETSPPARNLKVLKADVVLLTASGPAVKRITFSPPLPRHMQEALRRLHYVPATKVFLSFRRPFWREEHIEGGHSNTDRPSRMIFYPPPREGALLLASYTWSDAAAAFAGLSREEALRLALDDVAALHGPVVRQLWDGTGVVKRWAEDQHSQGGFVVQPPALWQTEKDDWTVPYGRIYFAGEHTAYPHGWVETAVKSALRAAIKINSRKGPASDTASPEGHASDMEGQGHVHGVASSPSHDLAKEEGSHPPVQGQLSLQNTTHTRTSH

SEQ ID NO: 41604 - protein, 82 aa, Homo sapiens
  Payload ID: 8475
  Gene Symbol: IL4I1
  Gene Name: interleukin 4 induced 1
  ENSP ID: ENSP00000469467
MPNDDFCPGLTIKAMGAERAPQRQPCNTISHRESWPHWPCTSSSSSPSSSAWWPPRTGRLNAAKTPSRNACRILTMSSCSRW

SEQ ID NO: 41605 - protein, 71 aa, Homo sapiens
  Payload ID: 8475
  Gene Symbol: IL4I1
  Gene Name: interleukin 4 induced 1
  ENSP ID: ENSP00000469841
MAPLALHLLVLVPILLSLVASQDWKAERSQDPFEKCMQDPDYEQLLKVVTWGLNRTLKPQRVIVVGAGVAG

SEQ ID NO: 41606 - protein, 150 aa, Homo sapiens
  Payload ID: 8475
  Gene Symbol: IL4I1
  Gene Name: interleukin 4 induced 1
  ENSP ID: ENSP00000470120
MAPLALHLLVLVPILLSLVASQDWKAERSQDPFEKCMQDPDYEQLLKVTILEADNRIGGRIFTYRDQNTGWIGELGAMRMPSSHRILHKLCQGLGLNLTKFTQYDKNTWTEVHEVKLRNYVVEKVPEKLGYALRPQEKGHSPEDIYQMAL

SEQ ID NO: 41607 - protein, 106 aa, Homo sapiens
  Payload ID: 8475
  Gene Symbol: IL4I1
  Gene Name: interleukin 4 induced 1
  ENSP ID: ENSP00000471950
MPNDDFCPGLTIKAMGAERAPQRQPCTLHLLVLVPILLSLVASQDWKAERSQDPFEKCMQDPDYEQLLKVVTWGLNRTLKPQRVIVVGAGVAGLVAAKVLSDAGHK

SEQ ID NO: 41608 - protein, 589 aa, Homo sapiens; identical to SEQ ID NO: 41602
  Payload ID: 8475
  Gene Symbol: IL4I1
  Gene Name: interleukin 4 induced 1
  Uniprot ID: Q96RQ9
  ENSP ID: ENSP00000472474

SEQ ID NO: 41609 - protein, 32 aa, Homo sapiens
  Payload ID: 8475
  Gene Symbol: IL4I1
  Gene Name: interleukin 4 induced 1
  ENSP ID: ENSP00000472786
MAPLALHLLVLVPILLSLVASQDWKAERSQDP

SEQ ID NO: 41610 - protein, 810 aa, Homo sapiens
  Payload ID: 8476
  Gene Symbol: IL4R
  Gene Name: interleukin 4 receptor
  Uniprot ID: P24394
  ENSP ID: ENSP00000170630
MQKDARREGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 41611 - protein, 825 aa, Homo sapiens
  Payload ID: 8476
  Gene Symbol: IL4R
  Gene Name: interleukin 4 receptor
  Uniprot ID: P24394
  ENSP ID: ENSP00000379111
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 41612 - protein, 825 aa, Homo sapiens; identical to SEQ ID NO: 41611
  Payload ID: 8476
  Gene Symbol: IL4R
  Gene Name: interleukin 4 receptor
  Uniprot ID: P24394
  ENSP ID: ENSP00000441667

SEQ ID NO: 41613 - protein, 66 aa, Homo sapiens
  Payload ID: 8476
  Gene Symbol: IL4R
  Gene Name: interleukin 4 receptor
  ENSP ID: ENSP00000454684
MGWLCSGLLFPVSCLVLLQVASSGLFRMPCGERKRVEARRSGGRSGVEEMRGSGSLWEVDLRTDWN

SEQ ID NO: 41614 - protein, 10 aa, Homo sapiens
  Payload ID: 8476
  Gene Symbol: IL4R
  Gene Name: interleukin 4 receptor
  ENSP ID: ENSP00000454725
MGWLCSGLLF

SEQ ID NO: 41615 - protein, 120 aa, Homo sapiens
  Payload ID: 8476
  Gene Symbol: IL4R
  Gene Name: interleukin 4 receptor
  ENSP ID: ENSP00000455632
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEH

SEQ ID NO: 41616 - protein, 66 aa, Homo sapiens; identical to SEQ ID NO: 41613
  Payload ID: 8476
  Gene Symbol: IL4R
  Gene Name: interleukin 4 receptor
  ENSP ID: ENSP00000455714

SEQ ID NO: 41617 - protein, 124 aa, Homo sapiens
  Payload ID: 8476
  Gene Symbol: IL4R
  Gene Name: interleukin 4 receptor
  ENSP ID: ENSP00000456248
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVQNL

SEQ ID NO: 41618 - protein, 49 aa, Homo sapiens
  Payload ID: 8476
  Gene Symbol: IL4R
  Gene Name: interleukin 4 receptor
  ENSP ID: ENSP00000456669
  MOD_RES (1)..(1): Any amino acid
XCVCHLLMDDVVSADNYTLDLWAGQQLLWKGSFKPSEHVLPPLKRSWSQ

SEQ ID NO: 41619 - protein, 120 aa, Homo sapiens; identical to SEQ ID NO: 41615
  Payload ID: 8476
  Gene Symbol: IL4R
  Gene Name: interleukin 4 receptor
  ENSP ID: ENSP00000456930

SEQ ID NO: 41620 - protein, 63 aa, Homo sapiens
  Payload ID: 8476
  Gene Symbol: IL4R
  Gene Name: interleukin 4 receptor
  ENSP ID: ENSP00000457131
MGWLCSGLLFPVSCLVLLQVASSGNMKVLQEPTCVSDYMSISTCEWKMNGPTNCSTELRLLYQ

SEQ ID NO: 41621 - protein, 133 aa, Homo sapiens
  Payload ID: 8476
  Gene Symbol: IL4R
  Gene Name: interleukin 4 receptor
  ENSP ID: ENSP00000461268
PSTKWHNSYREPFEQHLLLGVSVSCIVILAVCLLCYVSITKIKKEWWDQIPNPARSRLVAIIIQDAQGSQWEKRSRGPWAPRLVNELLAAPSTASAADCPCCNCPRHVLPTRSWPTWRPTCLCLTELEAEPRN

SEQ ID NO: 41622 - protein, 193 aa, Homo sapiens
  Payload ID: 8476
  Gene Symbol: IL4R
  Gene Name: interleukin 4 receptor
  ENSP ID: ENSP00000461607
  MOD_RES (1)..(1): Any amino acid
XNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPLQGTAGGGVFWKRGLLAKPPEFHWCVRHWKNCLTKLLPCFLEHNMKRDEDPHKAAKEMPFQGSGKSA

SEQ ID NO: 41623 - protein, 66 aa, Homo sapiens; identical to SEQ ID NO: 41613
  Payload ID: 8476
  Gene Symbol: IL4R
  Gene Name: interleukin 4 receptor
  ENSP ID: ENSP00000486645

SEQ ID NO: 41624 - protein, 134 aa, Homo sapiens
  Payload ID: 8477
  Gene Symbol: IL5
  Gene Name: interleukin 5
  Uniprot ID: P05113
  ENSP ID: ENSP00000231454
MRMLLHLSLLALGAAYVYAIPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQEFLGVMNTEWIIES

SEQ ID NO: 41625 - protein, 51 aa, Homo sapiens
  Payload ID: 8477
  Gene Symbol: IL5
  Gene Name: interleukin 5
  ENSP ID: ENSP00000409825
MGVVVGWIGDPGSGTLRIPVPVHKNHQLCTEEIFQGIGTLESQTVQGGTVE

SEQ ID NO: 41626 - protein, 420 aa, Homo sapiens
  Payload ID: 8478
  Gene Symbol: IL5RA
  Gene Name: interleukin 5 receptor, alpha
  Uniprot ID: Q01344
  ENSP ID: ENSP00000256452
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGNDEHKPLREWFVIVIMATICFILLILSLICKICHLWIKLFPPIPAPKSNIKDLFVTTNYEKAGSSETEIEVICYIEKPGVETLEDSVF

SEQ ID NO: 41627 - protein, 335 aa, Homo sapiens
  Payload ID: 8478
  Gene Symbol: IL5RA
  Gene Name: interleukin 5 receptor, alpha
  Uniprot ID: Q01344
  ENSP ID: ENSP00000309196
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGFSR

SEQ ID NO: 41628 - protein, 335 aa, Homo sapiens; identical to SEQ ID NO: 41627
  Payload ID: 8478
  Gene Symbol: IL5RA
  Gene Name: interleukin 5 receptor, alpha
  Uniprot ID: Q01344
  ENSP ID: ENSP00000373358

SEQ ID NO: 41629 - protein, 325 aa, Homo sapiens
  Payload ID: 8478
  Gene Symbol: IL5RA
  Gene Name: interleukin 5 receptor, alpha
  ENSP ID: ENSP00000388858
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIGNDEHKPLREWFVIVIMATICFILLILSLICKICHLWIKLFPPIPAPKSNIKDLFVTTNYEKAGSSETEIEVICYIEKPGVETLEDSVF

SEQ ID NO: 41630 - protein, 378 aa, Homo sapiens
  Payload ID: 8478
  Gene Symbol: IL5RA
  Gene Name: interleukin 5 receptor, alpha
  Uniprot ID: Q01344
  ENSP ID: ENSP00000390753
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGNDEHKPLREWFVIVIMATICFILLILSLICKIKLGPVRRKLKSSVI

SEQ ID NO: 41631 - protein, 109 aa, Homo sapiens
  Payload ID: 8478
  Gene Symbol: IL5RA
  Gene Name: interleukin 5 receptor, alpha
  ENSP ID: ENSP00000391274
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLL

SEQ ID NO: 41632 - protein, 333 aa, Homo sapiens
  Payload ID: 8478
  Gene Symbol: IL5RA
  Gene Name: interleukin 5 receptor, alpha
  Uniprot ID: Q01344
  ENSP ID: ENSP00000392059
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGK

SEQ ID NO: 41633 - protein, 196 aa, Homo sapiens
  Payload ID: 8478
  Gene Symbol: IL5RA
  Gene Name: interleukin 5 receptor, alpha
  ENSP ID: ENSP00000398117
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIAC

SEQ ID NO: 41634 - protein, 333 aa, Homo sapiens; identical to SEQ ID NO: 41632
  Payload ID: 8478
  Gene Symbol: IL5RA
  Gene Name: interleukin 5 receptor, alpha
  Uniprot ID: Q01344
  ENSP ID: ENSP00000400400

SEQ ID NO: 41635 - protein, 420 aa, Homo sapiens; identical to SEQ ID NO: 41626
  Payload ID: 8478
  Gene Symbol: IL5RA
  Gene Name: interleukin 5 receptor, alpha
  Uniprot ID: Q01344
  ENSP ID: ENSP00000412209

SEQ ID NO: 41636 - protein, 212 aa, Homo sapiens
  Payload ID: 8479
  Gene Symbol: IL6
  Gene Name: interleukin 6
  Uniprot ID: P05231
  ENSP ID: ENSP00000258743
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 41637 - protein, 189 aa, Homo sapiens
  Payload ID: 8479
  Gene Symbol: IL6
  Gene Name: interleukin 6
  ENSP ID: ENSP00000384928
MNSFSTIPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 41638 - protein, 136 aa, Homo sapiens
  Payload ID: 8479
  Gene Symbol: IL6
  Gene Name: interleukin 6
  ENSP ID: ENSP00000385043
MCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 41639 - protein, 198 aa, Homo sapiens
  Payload ID: 8479
  Gene Symbol: IL6
  Gene Name: interleukin 6
  ENSP ID: ENSP00000385227
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKVGVSSFPQLGVGEDRLKDSVLDNSGMQCHFQKRRLHVNKRV

SEQ ID NO: 41640 - protein, 212 aa, Homo sapiens; identical to SEQ ID NO: 41636
  Payload ID: 8479
  Gene Symbol: IL6
  Gene Name: interleukin 6
  Uniprot ID: P05231
  ENSP ID: ENSP00000385675

SEQ ID NO: 41641 - protein, 122 aa, Homo sapiens
  Payload ID: 8479
  Gene Symbol: IL6
  Gene Name: interleukin 6
  ENSP ID: ENSP00000385718
MCESSKEALAENNLNLPKMAEKDGCFQSGFNEETCLVKIITGLLEFEVYLEYLQNRFESSEEQARAVQMSTKVLIQFLQKKVGVSSFPQLGVGEDRLKDSVLDNSGMQCHFQKRRLHVNKRV

SEQ ID NO: 41642 - protein, 152 aa, Homo sapiens
  Payload ID: 8479
  Gene Symbol: IL6
  Gene Name: interleukin 6
  ENSP ID: ENSP00000405150
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQ

SEQ ID NO: 41643 - protein, 365 aa, Homo sapiens [sequence omitted]

SEQ ID NO: 41644 - protein, 468 aa, Homo sapiens
  Payload ID: 8480
  Gene Symbol: IL6R
  Gene Name: interleukin 6 receptor
  Uniprot ID: P08887
  ENSP ID: ENSP00000357470
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPMQALTTNKDDDNILFRDSANATSLPVQDSSSVPLPTFLVAGGSLAFGTLLCIAIVLRFKKTWKLRALKEGKTSMHPPYSLGQLVPERPRPTPVLVPLISPPVSPSSLGSDNTSSHNRPDARDPRSPYDISNTDYFFPR

SEQ ID NO: 41645 - protein, 190 aa, Homo sapiens
  Payload ID: 8480
  Gene Symbol: IL6R
  Gene Name: interleukin 6 receptor
  ENSP ID: ENSP00000423036
  MOD_RES (1)..(1): Any amino acid
XGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPMQALTTNKDDDNILFRDSANATSLPVQDSSSVPLPTFLVAGGSLAFGTLLCIAIVLR

SEQ ID NO: 41646 - protein, 170 aa, Homo sapiens
  Payload ID: 8480
  Gene Symbol: IL6R
  Gene Name: interleukin 6 receptor
  ENSP ID: ENSP00000423184
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLSEQSGRRLPGAVPVFPGVPEV

SEQ ID NO: 41647 - protein, 294 aa, Homo sapiens
  Payload ID: 8480
  Gene Symbol: IL6R
  Gene Name: interleukin 6 receptor
  ENSP ID: ENSP00000423668
  MOD_RES (1)..(1): Any amino acid
XRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTGFSPQTIPGGIWDPAGESRSPPAENEVSTPMQALTTNKDDDNILFRDSANATSLP

SEQ ID NO: 41648 - protein, 352 aa, Homo sapiens
  Payload ID: 8480
  Gene Symbol: IL6R
  Gene Name: interleukin 6 receptor
  ENSP ID: ENSP00000477739
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTDRLSPRCPGWSTAVQSQLTATSASWVQAILPPQPPK

SEQ ID NO: 41649 - protein, 918 aa, Homo sapiens
  Payload ID: 8481
  Gene Symbol: IL6ST
  Gene Name: interleukin 6 signal transducer
  Uniprot ID: P40189
  ENSP ID: ENSP00000338799
MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDRPSKAPSFWYKIDPSHTQGYRTVQLVWKTLPPFEANGKILDYEVTLTRWKSHLQNYTVNATKLTVNLTNDRYLATLTVRNLVGKSDAAVLTIPACDFQATHPVMDLKAFPKDNMLWVEWTTPRESVKKYILEWCVLSDKAPCITDWQQEDGTVHRTYLRGNLAESKCYLITVTPVYADGPGSPESIKAYLKQAPPSKGPTVRTKKVGKNEAVLEWDQLPVDVQNGFIRNYTIFYRTIIGNETAVNVDSSHTEYTLSSLTSDTLYMVRMAAYTDEGGKDGPEFTFTTPKFAQGEIEAIVVPVCLAFLLTTLLGVLFCFNKRDLIKKHIWPNVPDPSKSHIAQWSPHTPPRHNFNSKDQMYSDGNFTDVSVVEIEANDKKPFPEDLKSLDLFKKEKINTEGHSSGIGGSSCMSSSRPSISSSDENESSQNTSSTVQYSTVVHSGYRHQVPSVQVFSRSESTQPLLDSEERPEDLQLVDHVDGGDGILPRQQYFKQNCSQHESSPDISHFERSKQVSSVNEEDFVRLKQQISDHISQSCGSGQMKMFQEVSAADAFGPGTEGQVERFETVGMEAATDEGMPKSYLPQTVRQGGYMPQ

SEQ ID NO: 41650 - protein, 66 aa, Homo sapiens
  Payload ID: 8481
  Gene Symbol: IL6ST
  Gene Name: interleukin 6 signal transducer
  ENSP ID: ENSP00000370686
MLTLQTWLVQALFIFLTTESTELKNTSGLMFQILQRVILPSGHLTLLQGTILIQKIKCIQMAISLM

SEQ ID NO: 41651 - protein, 329 aa, Homo sapiens
  Payload ID: 8481
  Gene Symbol: IL6ST
  Gene Name: interleukin 6 signal transducer
  Uniprot ID: P40189
  ENSP ID: ENSP00000370687
MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDNIASF

SEQ ID NO: 41652 - protein, 203 aa, Homo sapiens
  Payload ID: 8481
  Gene Symbol: IL6ST
  Gene Name: interleukin 6 signal transducer
  ENSP ID: ENSP00000370693
MLTLQTWLVQALFIFLTTESTGELLDPCGYISPESPVVQLHSNFTAVCVLKEKLKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDKLKNTSGLMFQILQRVILPSGHLTLLQGTILIQKIKCIQMAISLM

SEQ ID NO: 41653 - protein, 857 aa, Homo sapiens
  Payload ID: 8481
  Gene Symbol: IL6ST
  Gene Name: interleukin 6 signal transducer
  Uniprot ID: P40189
  ENSP ID: ENSP00000370694
MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDRPSKAPSFWYKIDPSHTQGYRTVQLVWKTLPPFEANGKILDYEVTLTRWKSHLQNYTVNATKLTVNLTNDRYLATLTVRNLVGKSDAAVLTIPACDFQGNLAESKCYLITVTPVYADGPGSPESIKAYLKQAPPSKGPTVRTKKVGKNEAVLEWDQLPVDVQNGFIRNYTIFYRTIIGNETAVNVDSSHTEYTLSSLTSDTLYMVRMAAYTDEGGKDGPEFTFTTPKFAQGEIEAIVVPVCLAFLLTTLLGVLFCFNKRDLIKKHIWPNVPDPSKSHIAQWSPHTPPRHNFNSKDQMYSDGNFTDVSVVEIEANDKKPFPEDLKSLDLFKKEKINTEGHSSGIGGSSCMSSSRPSISSSDENESSQNTSSTVQYSTVVHSGYRHQVPSVQVFSRSESTQPLLDSEERPEDLQLVDHVDGGDGILPRQQYFKQNCSQHESSPDISHFERSKQVSSVNEEDFVRLKQQISDHISQSCGSGQMKMFQEVSAADAFGPGTEGQVERFETVGMEAATDEGMPKSYLPQTVRQGGYMPQ

SEQ ID NO: 41654 - protein, 918 aa, Homo sapiens; identical to SEQ ID NO: 41649
  Payload ID: 8481
  Gene Symbol: IL6ST
  Gene Name: interleukin 6 signal transducer
  Uniprot ID: P40189
  ENSP ID: ENSP00000370698

SEQ ID NO: 41655 - protein, 333 aa, Homo sapiens
  Payload ID: 8481
  Gene Symbol: IL6ST
  Gene Name: interleukin 6 signal transducer
  ENSP ID: ENSP00000426224
MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDTLDKPLGSG

SEQ ID NO: 41656 - protein, 329 aa, Homo sapiens; identical to SEQ ID NO: 41651
  Payload ID: 8481
  Gene Symbol: IL6ST
  Gene Name: interleukin 6 signal transducer
  Uniprot ID: P40189
  ENSP ID: ENSP00000435399

SEQ ID NO: 41657 - protein, 918 aa, Homo sapiens; identical to SEQ ID NO: 41649
  Payload ID: 8481
  Gene Symbol: IL6ST
  Gene Name: interleukin 6 signal transducer
  Uniprot ID: P40189
  ENSP ID: ENSP00000462158

SEQ ID NO: 41658 - protein, 55 aa, Homo sapiens
  Payload ID: 8481
  Gene Symbol: IL6ST
  Gene Name: interleukin 6 signal transducer
  ENSP ID: ENSP00000463896
MLTLQTWLVQALFIFLTTESTGQHTSLLIAKQNVTPPPHALLIILLCILSTLKSG

SEQ ID NO: 41659 - protein, 177 aa, Homo sapiens
  Payload ID: 8482
  Gene Symbol: IL7
  Gene Name: interleukin 7
  Uniprot ID: P13232
  ENSP ID: ENSP00000263851
MFHVSFRYIFGLPPLILVLLPVASSDCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEH

SEQ ID NO: 41660 - protein, 115 aa, Homo sapiens
  Payload ID: 8482
  Gene Symbol: IL7
  Gene Name: interleukin 7
  ENSP ID: ENSP00000368408
MFHVSFRYIFGLPPLILVLLPVASSDCDIEGKDGKQYESVLMVSIDQLLDSMKEIGSNCLNNEFNFFKRHICDANKEENKSLKEQKKLNDLCFLKRLLQEIKTCWNKILMGTKEH

SEQ ID NO: 41661 - protein, 133 aa, Homo sapiens
  Payload ID: 8482
  Gene Symbol: IL7
  Gene Name: interleukin 7
  Uniprot ID: P13232
  ENSP ID: ENSP00000427750
MFHVSFRYIFGLPPLILVLLPVASSDCDIEGKDGKQYESVLMVSIDQLLDSMKEIGSNCLNNEFNFFKRHICDANKVKGRKPAALGEAQPTKSLEENKSLKEQKKLNDLCFLKRLLQEIKTCWNKILMGTKEH

SEQ ID NO: 41662 - protein, 37 aa, Homo sapiens
  Payload ID: 8482
  Gene Symbol: IL7
  Gene Name: interleukin 7
  ENSP ID: ENSP00000427800
MFHVSFRYIFGLPPLILVLLPVASSDCDIEGQHERNW

SEQ ID NO: 41663 - protein, 37 aa, Homo sapiens; identical to SEQ ID NO: 41662
  Payload ID: 8482
  Gene Symbol: IL7
  Gene Name: interleukin 7
  ENSP ID: ENSP00000428364

SEQ ID NO: 41664 - protein, 71 aa, Homo sapiens
  Payload ID: 8482
  Gene Symbol: IL7
  Gene Name: interleukin 7
  ENSP ID: ENSP00000430272
MFHVSFRYIFGLPPLILVLLPVASSDCDIEGKDGKQYESVLMVSIDQLLNQPYKKKEKRTERKQQSAMSNN

SEQ ID NO: 41665 - protein, 159 aa, Homo sapiens
  Payload ID: 8482
  Gene Symbol: IL7
  Gene Name: interleukin 7
  ENSP ID: ENSP00000438922
MFHVSFRYIFGLPPLILVLLPVASSDCDIEGKDGKQYESVLMVSIDQLLDSMKEIGSNCLNNEFNFFKRHICDANKEGMFLFRAARKLRQFLKMNSTGDFDLHLLKVSEGTTILLNCTGQEENKSLKEQKKLNDLCFLKRLLQEIKTCWNKILMGTKEH

SEQ ID NO: 41666 - protein, 459 aa, Homo sapiens
  Payload ID: 8483
  Gene Symbol: IL7R
  Gene Name: interleukin 7 receptor
  Uniprot ID: P16871
  ENSP ID: ENSP00000306157
MTILGTTFGMVFSLLQVVSGESGYAQNGDLEDAELDDYSFSCYSQLEVNGSQHSLTCAFEDPDVNITNLEFEICGALVEVKCLNFRKLQEIYFIETKKFLLIGKSNICVKVGEKSLTCKKIDLTTIVKPEAPFDLSVVYREGANDFVVTFNTSHLQKKYVKVLMHDVAYRQEKDENKWTHVNLSSTKLTLLQRKLQPAAMYEIKVRSIPDHYFKGFWSEWSPSYYFRTPEINNSSGEMDPILLTISILSFFSVALLVILACVLWKKRIKPIVWPSLPDHKKTLEHLCKKPRKNLNVSFNPESFLDCQIHRVDDIQARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 41667 - protein, 261 aa, Homo sapiens
  Payload ID: 8483
  Gene Symbol: IL7R
  Gene Name: interleukin 7 receptor
  ENSP ID: ENSP00000421207
MTILGTTFGMVFSLLQVVSGESGYAQNGDLEDAELDDYSFSCYSQLEVNGSQHSLTCAFEDPDVNITNLEFEICGALVEVKCLNFRKLQEIYFIETKKFLLIGKSNICVKVGEKSLTCKKIDLTTIVKPEAPFDLSVVYREGANDFVVTFNTSHLQKKYVKVLMHDVAYRQEKDENKWTHVNLSSTKLTLLQRKLQPAAMYEIKVRSIPDHYFKGFWSEWSPSYYFRTPEINNSSGLSLSYGPVSPIIRRLWNIFVRNQEK

SEQ ID NO: 41668 - protein, 150 aa, Homo sapiens
  Payload ID: 8483
  Gene Symbol: IL7R
  Gene Name: interleukin 7 receptor
  ENSP ID: ENSP00000425309
MTILGTTFGMVFSLLQVVSGESGYAQNGDLEDAELDDYSFSCYSQLEVNGSQHSLTCAFEDPDVNITNLEFEICGALVEVKCLNFRKLQEIYFIETKKFLLIGKSNICVKVGEKSLTCKKIDLTTIGKKLYIKVWLSLLGYLKTLCLDIL

SEQ ID NO: 41669 - protein, 52 aa, Homo sapiens
  Payload ID: 8483
  Gene Symbol: IL7R
  Gene Name: interleukin 7 receptor
  ENSP ID: ENSP00000425538
MTILGTTFGMVFSLLQVVSGESGYAQNGDLEDAELDDYSFSCYSQLEVNGSQ

SEQ ID NO: 41670 - protein, 65 aa, Homo sapiens
  Payload ID: 8483
  Gene Symbol: IL7R
  Gene Name: interleukin 7 receptor
  ENSP ID: ENSP00000426069
AAMYEIKVRSIPDHYFKGFWSEWSPSYYFRTPEINNSSGLSLSYGPVSPIIRRLWNIFVRNQEKI

SEQ ID NO: 41671 - protein, 59 aa, Homo sapiens
  Payload ID: 8483
  Gene Symbol: IL7R
  Gene Name: interleukin 7 receptor
  ENSP ID: ENSP00000426426
MTILGTTFGMVFSLLQVVSGESGYAQNGDLEDAELDDYSFSCYSQLEVNGSQHSLTCAF

SEQ ID NO: 41672 - protein, 180 aa, Homo sapiens
  Payload ID: 8483
  Gene Symbol: IL7R
  Gene Name: interleukin 7 receptor
  ENSP ID: ENSP00000427688
MTILGTTFGMVFSLLQVVSGESGYAQNGDLEDAELDDYSFSCYSQLEVNGSQHSLTCAFEDPDVNITNLEFEICGALVEVKCLNFRKLQEIYFIETKKFLLIGKSNICVKVGEKSLTCKKIDLTTIVKPEAPFDLSVVYREGANDFVVTFNTSHLQKKYVKVLMHDVAYRQEKDENKWTD

SEQ ID NO: 41673 - protein, 144 aa, Homo sapiens
  Payload ID: 8484
  Gene Symbol: IL9
  Gene Name: interleukin 9
  Uniprot ID: P15248
  ENSP ID: ENSP00000274520
MLLAMVLTSALLLCSVAGQGCPTLAGILDINFLINKMQEDPASKCHCSANVTSCLCLGIPSDNCTRPCFSERLSQMTNTTMQTRYPLIFSRVKKSVEVLKNNKCPYFSCEQPCNQTTAGNALTFLKSLLEIFQKEKMRGMRGKI

SEQ ID NO: 41674 - protein, 521 aa, Homo sapiens
  Payload ID: 8485
  Gene Symbol: IL9R
  Gene Name: interleukin 9 receptor
  Uniprot ID: Q01113
  ENSP ID: ENSP00000244174
MGLGRCIWEGWTLESEALRRDMGTWLLACICICTCVCLGVSVTGEGQGPRSRTFTCLTNNILRIDCHWSAPELGQGSSPWLLFTSNQAPGGTHKCILRGSECTVVLPPEAVLVPSDNFTITFHHCMSGREQVSLVDPEYLPRRHVKLDPPSDLQSNISSGHCILTWSISPALEPMTTLLSYELAFKKQEEAWEQAQHRDHIVGVTWLILEAFELDPGFIHEARLRVQMATLEDDVVEEERYTGQWSEWSQPVCFQAPQRQGPLIPPWGWPGNTLVAVSIFLLLTGPTYLLFKLSPRVKRIFYQNVPSPAMFFQPLYSVHNGNFQTWMGAHGAGVLLSQDCAGTPQGALEPCVQEATALLTCGPARPWKSVALEEEQEGPGTRLPGNLSSEDVLPAGCTEWRVQTLAYLPQEDWAPTSLTRPAPPDSEGSRSSSSSSSSNNNNYCALGCYGGWHLSALPGNTQSSGPIPALACGLSCDHQGLETQQGVAWVLAGHCQRPGLHEDLQGMLLPSVLSKARSWTF

SEQ ID NO: 41675 - protein, 342 aa, Homo sapiens
  Payload ID: 8485
  Gene Symbol: IL9R
  Gene Name: interleukin 9 receptor
  Uniprot ID: Q01113
  ENSP ID: ENSP00000358431
MPQTCDGTGQMHLGSNCCKNGQTLLQRTCHGVSCCGWWFQAARSILGKGPSAQSLAGWTLESEALRRDMGTWLLACICICTCVCLGVSVTGEGQGPRSRTFTCLTNNILRIDCHWSAPELGQGSSPWLLFTRLLAAHISASCGAVSAPSCCHLRQCSCHLTISPSLSTTACLGGSRSAWWTRSTCPGDTSNISSGHCILTWSISPALEPMTTLLSYELAFKKQEEAWEQAQHRDHIVGVTWLILEAFELDPGFIHEARLRVQMATLEDDVVEEERYTGQWSEWSQPVCFQAPQRQGPLIPPWGWPGNTLVAVSIFLLLTGPTYLLFKLSPRLGWGPTGPVCC

SEQ ID NO: 41676 - protein, 390 aa, Homo sapiens
  Payload ID: 8486
  Gene Symbol: ILF2
  Gene Name: interleukin enhancer binding factor 2
  Uniprot ID: Q12905
  ENSP ID: ENSP00000355011
MRGDRGRGRGGRFGSRGGPGGGFRPFVPHIPFDFYLCEMAFPRVKPAPDETSFSEALLKRNQDLAPNSAEQASILSLVTKINNVIDNLIVAPGTFEVQIEEVRQVGSYKKGTMTTGHNVADLVVILKILPTLEAVAALGNKVVESLRAQDPSEVLTMLTNETGFEISSSDATVKILITTVPPNLRKLDPELHLDIKVLQSALAAIRHARWFEENASQSTVKVLIRLLKDLRIRFPGFEPLTPWILDLLGHYAVMNNPTRQPLALNVAYRRCLQILAAGLFLPGSVGITDPCESGNFRVHTVMTLEQQDMVCYTAQTLVRILSHGGFRKILGQEGDASYLASEISTWDGVIVTPSEKAYEKPPEKKEGEEEEENTEEPPQGEEEESMETQE

SEQ ID NO: 41677 - protein, 150 aa, Homo sapiens
  Payload ID: 8486
  Gene Symbol: ILF2
  Gene Name: interleukin enhancer binding factor 2
  ENSP ID: ENSP00000357670
MRGDRGRGRGGRFGSRGGPGGGFRPFVPHIPFDFYLCEMAFPRVKPAPDETSFSEALLKRNQDLAPNSAEQASILSLVTKINNVIDNLIVAPGTFEVQIEEVRQVGSYKKGTMTTGHNVADLVVILKILPTCECACFWSWEQNIALGLGV

SEQ ID NO: 41678 - protein, 115 aa, Homo sapiens
  Payload ID: 8486
  Gene Symbol: ILF2
  Gene Name: interleukin enhancer binding factor 2
  ENSP ID: ENSP00000357673
MAFPRVKPAPDETSFSEALLKRNQDLAPNSAEQASILSLVTKINNVIDNLIVAPGTFEVQIEEVRQVGSYKKGTMTTGHNVADLVVILKILPTLEAVAALGNKVVESLRAQDPSE

SEQ ID NO: 41679 - protein, 352 aa, Homo sapiens
  Payload ID: 8486
  Gene Symbol: ILF2
  Gene Name: interleukin enhancer binding factor 2
  ENSP ID: ENSP00000482909
MAFPRVKPAPDETSFSEALLKRNQDLAPNSAEQASILSLVTKINNVIDNLIVAPGTFEVQIEEVRQVGSYKKGTMTTGHNVADLVVILKILPTLEAVAALGNKVVESLRAQDPSEVLTMLTNETGFEISSSDATVKILITTVPPNLRKLDPELHLDIKVLQSALAAIRHARWFEENASQSTVKVLIRLLKDLRIRFPGFEPLTPWILDLLGHYAVMNNPTRQPLALNVAYRRCLQILAAGLFLPGSVGITDPCESGNFRVHTVMTLEQQDMVCYTAQTLVRILSHGGFRKILGQEGDASYLASEISTWDGVIVTPSEKAYEKPPEKKEGEEEEENTEEPPQGEEEESMETQE

SEQ ID NO: 41680 - protein, 690 aa, Homo sapiens
  Payload ID: 8487
  Gene Symbol: ILF3
  Gene Name: interleukin enhancer binding factor 3, 90kDa
  Uniprot ID: Q12906
  ENSP ID: ENSP00000250241
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAEQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYTGFV

SEQ ID NO: 41681 - protein, 706 aa, Homo sapiens
  Payload ID: 8487
  Gene Symbol: ILF3
  Gene Name: interleukin enhancer binding factor 3, 90kDa
  Uniprot ID: Q12906
  ENSP ID: ENSP00000384660
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAENVKQQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYSDFFTDCYGYHDFGSS

SEQ ID NO: 41682 - protein, 898 aa, Homo sapiens
  Payload ID: 8487
  Gene Symbol: ILF3
  Gene Name: interleukin enhancer binding factor 3, 90kDa
  Uniprot ID: Q12906
  ENSP ID: ENSP00000404121
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAENVKQQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYSQFYSNGGHSGNASGGGGGGGGGSSGYGSYYQGDNYNSPVPPKHAGKKQPHGGQQKPSYGSGYQSHQGQQQSYNQSPYSNYGPPQGKQKGYNHGQGSYSYSNSYNSPGGGGGSDYNYESKFNYSGSGGRSGGNSYGSGGASYNPGSHGGYGGGSGGGSSYQGKQGGYSQSNYNSPGSGQNYSGPPSSYQSSQGGYGRNADHSMNYQYR

SEQ ID NO: 41683 - protein, 122 aa, Homo sapiens
  Payload ID: 8487
  Gene Symbol: ILF3
  Gene Name: interleukin enhancer binding factor 3, 90kDa
  ENSP ID: ENSP00000464974
MRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALL

SEQ ID NO: 41684 - protein, 702 aa, Homo sapiens
  Payload ID: 8487
  Gene Symbol: ILF3
  Gene Name: interleukin enhancer binding factor 3, 90kDa
  Uniprot ID: Q12906
  ENSP ID: ENSP00000465219
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAEQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYSDFFTDCYGYHDFGSS

SEQ ID NO: 41685 - protein, 698 aa, Homo sapiens
  Payload ID: 8487
  Gene Symbol: ILF3
  Gene Name: interleukin enhancer binding factor 3, 90kDa
  Uniprot ID: Q12906
  ENSP ID: ENSP00000465515
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAENVKQQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYSKCAFLSV

SEQ ID NO: 41686 - protein, 254 aa, Homo sapiens
  Payload ID: 8487
  Gene Symbol: ILF3
  Gene Name: interleukin enhancer binding factor 3, 90kDa
  ENSP ID: ENSP00000465654
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELL

SEQ ID NO: 41687 - protein, 158 aa, Homo sapiens
  Payload ID: 8487
  Gene Symbol: ILF3
  Gene Name: interleukin enhancer binding factor 3, 90kDa
  ENSP ID: ENSP00000465831
  MOD_RES (1)..(1): Any amino acid
XPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGGQSQRAEVLCHCDPGLEGPVHSRAHLGSPPRLASRAPV

SEQ ID NO: 41688 - protein, 116 aa, Homo sapiens
  Payload ID: 8487
  Gene Symbol: ILF3
  Gene Name: interleukin enhancer binding factor 3, 90kDa
  ENSP ID: ENSP00000466235
GGANHGGYMNAGAGYGSYGYGGNSATAGYNYSGSGGRSGGNSYGSGGASYNPGSHGGYGGGSGGGSSYQGKQGGYSQSNYNSPGSGQNYSGPPSSYQSSQGGYGRNADHSMNYQYR

SEQ ID NO: 41689 - protein, 99 aa, Homo sapiens
  Payload ID: 8487
  Gene Symbol: ILF3
  Gene Name: interleukin enhancer binding factor 3, 90kDa
  ENSP ID: ENSP00000466396
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVA

SEQ ID NO: 41690 - protein, 113 aa, Homo sapiens
  Payload ID: 8487
  Gene Symbol: ILF3
  Gene Name: interleukin enhancer binding factor 3, 90kDa
  ENSP ID: ENSP00000466724
  MOD_RES (1)..(1): Any amino acid
XGGPKFAAKPHNPGFGMGGPMHNEVPPPPNLRGRGRGGSIRGRGRGRGFGGANHGGYMNAGAGYGSYGYGGNSATAGYMMKTISPHLNPEKPAFFLIASMLKRWEHVGNCILR

SEQ ID NO: 41691 - protein, 79 aa, Homo sapiens
  Payload ID: 8487
  Gene Symbol: ILF3
  Gene Name: interleukin enhancer binding factor 3, 90kDa
  ENSP ID: ENSP00000466991
MRPMRIFVNDDRHVMAKHSSVYPTQEELEAVQNMVSHTERALKAVSDWIDEQEKGSSEQAESDNMDVPPEDDSKEGAGL

SEQ ID NO: 41692 - protein, 73 aa, Homo sapiens
  Payload ID: 8487
  Gene Symbol: ILF3
  Gene Name: interleukin enhancer binding factor 3, 90kDa
  ENSP ID: ENSP00000467372
DAAIVIKNTKEPPLSLTIHLTSPVVREEMEKVLAGGQSQRAEVLCHCDPGLEGPVHSRAHLGSPPRLASRAPV

SEQ ID NO: 41693 - protein, 55 aa, Homo sapiens
  Payload ID: 8487
  Gene Symbol: ILF3
  Gene Name: interleukin enhancer binding factor 3, 90kDa
  ENSP ID: ENSP00000467704
PTQEELEAVQNMVSHTERALKAVSDWIDEQEKGRNALLPWRPSDTPSGSRPEPTG

SEQ ID NO: 41694 - protein, 180 aa, Homo sapiens
  Payload ID: 8487
  Gene Symbol: ILF3
  Gene Name: interleukin enhancer binding factor 3, 90kDa
  ENSP ID: ENSP00000467950
  MOD_RES (1)..(1): Any amino acid
XPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPARTAARCLRPAP

SEQ ID NO: 41695 - protein, 79 aa, Homo sapiens; identical to SEQ ID NO: 41691
  Payload ID: 8487
  Gene Symbol: ILF3
  Gene Name: interleukin enhancer binding factor 3, 90kDa
  ENSP ID: ENSP00000468092

SEQ ID NO: 41696 - protein, 161 aa, Homo sapiens
  Payload ID: 8487
  Gene Symbol: ILF3
  Gene Name: interleukin enhancer binding factor 3, 90kDa
  ENSP ID: ENSP00000468134
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTK

SEQ ID NO: 41697 - protein, 894 aa, Homo sapiens
  Payload ID: 8487
  Gene Symbol: ILF3
  Gene Name: interleukin enhancer binding factor 3, 90kDa
  Uniprot ID: Q12906
  ENSP ID: ENSP00000468156
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAEQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYSQFYSNGGHSGNASGGGGGGGGGSSGYGSYYQGDNYNSPVPPKHAGKKQPHGGQQKPSYGSGYQSHQGQQQSYNQSPYSNYGPPQGKQKGYNHGQGSYSYSNSYNSPGGGGGSDYNYESKFNYSGSGGRSGGNSYGSGGASYNPGSHGGYGGGSGGGSSYQGKQGGYSQSNYNSPGSGQNYSGPPSSYQSSQGGYGRNADHSMNYQYR

SEQ ID NO: 41698 - protein, 898 aa, Homo sapiens; identical to SEQ ID NO: 41682
  Payload ID: 8487
  Gene Symbol: ILF3
  Gene Name: interleukin enhancer binding factor 3, 90kDa
  Uniprot ID: Q12906
  ENSP ID: ENSP00000468181

SEQ ID NO: 41699 - protein, 77 aa, Homo sapiens
  Payload ID: 8487
  Gene Symbol: ILF3
  Gene Name: interleukin enhancer binding factor 3, 90kDa
  ENSP ID: ENSP00000468323
MRPMRIFVNDDRHVMAKHSSVYPTQEELEAVQNMVSHTERALKAVSDWIDEQEKGSSEQAESDNMDVPPEDDSKEGA

SEQ ID NO: 41700 - protein, 339 aa, Homo sapiens
  Payload ID: 8488
  Gene Symbol: IRAK1
  Gene Name: interleukin-1 receptor-associated kinase 1
  ENSP ID: ENSP00000358990
MAGGPGPGEPAAPGAQHFLYEVPPWVMCRFYKVMDALEPADWCQFGGWRRAAGGREARGLLAPTPDAPRPAAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPFPFCWPLCEISRGTHNFSEELKIGEGGFGCVYRAVMRNTVYAVKRLKENADLEWTAVKQSFLTEVEQLSRPRPAHLSPGLSDWTSFWVQPGQFSFYIRTAPASSMETSRVPTSFWMRG

SEQ ID NO: 41701 - protein, 633 aa, Homo sapiens
  Payload ID: 8488
  Gene Symbol: IRAK1
  Gene Name: interleukin-1 receptor-associated kinase 1
  Uniprot ID: P51617
  ENSP ID: ENSP00000358991
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPFPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLVYERLEKLQAVVAGVPGHSEAASCIPPSPQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 41702 - protein, 712 aa, Homo sapiens
  Payload ID: 8488
  Gene Symbol: IRAK1
  Gene Name: interleukin-1 receptor-associated kinase 1
  Uniprot ID: P51617
  ENSP ID: ENSP00000358997
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPFPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLKDLVEEEAEEAGVALRSTQSTLQAGLAADAWAAPIAMQIYKKHLDPRPGPCPPELGLGLGQLACCCLHRRAKRRPPMTQVYERLEKLQAVVAGVPGHSEAASCIPPSPQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 41703 - protein, 682 aa, Homo sapiens
  Payload ID: 8488
  Gene Symbol: IRAK1
  Gene Name: interleukin-1 receptor-associated kinase 1
  Uniprot ID: P51617
  ENSP ID: ENSP00000377291
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPFPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLKDLVEEEAEEAGVALRSTQSTLQAGLAADAWAAPIAMQIYKKHLDPRPGPCPPELGLGLGQLACCCLHRRAKRRPPMTQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 41704 - protein, 708 aa, Homo sapiens
  Payload ID: 8488
  Gene Symbol: IRAK1
  Gene Name: interleukin-1 receptor-associated kinase 1
  ENSP ID: ENSP00000392662
MAGGPGPGEPAAPGAQHFLYEVPPWVMCRFYKVMDALEPADWCQFGGWRRAAGGREARGLLAPTPDAPRPAAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPFPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLKDLVEEEAEEAGVALRSTQSTLQAGLAADAWAAPIAMQIYKKHLDPRPGPCPPELGLGLGQLACCCLHRRAKRRPPMTQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 41705 - protein, 234 aa, Homo sapiens
  Payload ID: 8488
  Gene Symbol: IRAK1
  Gene Name: interleukin-1 receptor-associated kinase 1
  ENSP ID: ENSP00000399974
PGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKQDPVSKRKTLGKVKYGCKSHGSVLARSENSEILQKVEQHPPPTSGQCLQALLGTCELA

SEQ ID NO: 41706 - protein, 392 aa, Homo sapiens
  Payload ID: 8488
  Gene Symbol: IRAK1
  Gene Name: interleukin-1 receptor-associated kinase 1
  ENSP ID: ENSP00000403730
  MOD_RES (1)..(1): Any amino acid
XMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVKDLVEEEAEEAGVALRSTQSTLQAGLAADAWAAPIAMQIYKKHLDPRPGPCPPELGLGLGQLACCCLHRRAKRRPPMTQVYERLEKLQAVVAGVPGHSEAASCIPPSPQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVE

SEQ ID NO: 41707 - protein, 276 aa, Homo sapiens
  Payload ID: 8488
  Gene Symbol: IRAK1
  Gene Name: interleukin-1 receptor-associated kinase 1
  ENSP ID: ENSP00000406249
  MOD_RES (1)..(1): Any amino acid
XLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 41708 - protein, 218 aa, Homo sapiens
  Payload ID: 8488
  Gene Symbol: IRAK1
  Gene Name: interleukin-1 receptor-associated kinase 1
  ENSP ID: ENSP00000410953
  MOD_RES (1)..(1): Any amino acid
XGVALRSTQSTLQAGLAADAWAAPIAMQIYKKHLDPRPGPCPPELGLGLGQLACCCLHRRAKRRPPMTQVYERLEKLQAVVAGVPGHSEAASCIPPSPQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLGLEQDRQGPEESDEFQS

SEQ ID NO: 41709 - protein, 212 aa, Homo sapiens
  Payload ID: 8488
  Gene Symbol: IRAK1
  Gene Name: interleukin-1 receptor-associated kinase 1
  ENSP ID: ENSP00000411809
QRAVKTHGARTKYLKDLVEEEAEEAGVALRSTQSTLQAGLAADAWAAPIAMQIYKKHLDPRPGPCPPELGLGLGQLACCCLHRRAKRRPPMTQDWPLAALHHRRQSHRRLSSTLPDRRWSRSWPCTRMGPWTACSCCRPAPSQAWAWNRTGRGPKKVMNFRADVFTWADPPNPEVKVLMVRSSHGARVLSTLPAVGVGAHARGGEKEVALLF

SEQ ID NO: 41710 - protein, 260 aa, Homo sapiens
  Payload ID: 8489
  Gene Symbol: IRAK1BP1
  Gene Name: interleukin-1 receptor-associated kinase 1 binding protein 1
  Uniprot ID: Q5VVH5
  ENSP ID: ENSP00000358956
MSLQKTPPTRVFVELVPWADRSRENNLASGRETLPGLRHPLSSTQAQTATREVQVSGTSEVSAGPDRAQVVVRVSSTKEAAAEAKKSVCRRLDYITQSLQQQGVQAENITVTKDFRRVENAYHMEAEVCITFTEFGKMQNICNFLVEKLDSSVVISPPQFYHTPGSVENLRRQACLVAVENAWRKAQEVCNLVGQTLGKPLLIKEEETKEWEGQIDDHQSSRLSSSLTVQQKIKSATIHAASKVFITFEVKGKEKRKKHL

SEQ ID NO: 41711 - protein, 44 aa, Homo sapiens
  Payload ID: 8489
  Gene Symbol: IRAK1BP1
  Gene Name: interleukin-1 receptor-associated kinase 1 binding protein 1
  ENSP ID: ENSP00000475395
  MOD_RES (1)..(1): Any amino acid
XIDDHQSSRLSSSLTVQQKIKSATIHAASKVFITFEKLLRRGGV

SEQ ID NO: 41712 - protein, 192 aa, Homo sapiens
  Payload ID: 8489
  Gene Symbol: IRAK1BP1
  Gene Name: interleukin-1 receptor-associated kinase 1 binding protein 1
  ENSP ID: ENSP00000475503
MNGKRPQHLHPLGSDNSEAENITVTKDFRRVENAYHMEAEVCITFTEFGKMQNICNFLVEKLDSSVVISPPQFYHTPGSVENLRRQACLVAVENAWRKAQEVCNLVGQTLGKPLLIKEEETKEWEGQIDDHQSSRLSSSLTVQQKIKSATIHAASKVFITFEQLLESFFNIPTNNYSQIAMSPVNYHESHIK

SEQ ID NO: 41713 - protein, 177 aa, Homo sapiens
  Payload ID: 8489
  Gene Symbol: IRAK1BP1
  Gene Name: interleukin-1 receptor-associated kinase 1 binding protein 1
  ENSP ID: ENSP00000475570
VFVELVPWADRSRENNLASGRETLPGLRHPLSSTQAQTATREVQVSGTSEVSAGPDRAQVVVRVSSTKEAAAEAKKSVCRRLDYITQSLQQQGVQAENITVTKDFRRVENAYHMEAEVCITFTEFGKMQNICNFLVEKLDSSVVISPPQFYHTPGSVENLRNSWNPSSTSQPTITPR

SEQ ID NO: 41714 - protein, 625 aa, Homo sapiens
  Payload ID: 8490
  Gene Symbol: IRAK2
  Gene Name: interleukin-1 receptor-associated kinase 2
  Uniprot ID: O43187
  ENSP ID: ENSP00000256458
MACYIYQLPSWVLDDLCRNMDALSEWDWMEFASYVITDLTQLRKIKSMERVQGVSITRELLWWWGMRQATVQQLVDLLCRLELYRAAQIILNWKPAPEIRCPIPAFPDSVKPEKPLAASVRKAEDEQEEGQPVRMATFPGPGSSPARAHQPAFLQPPEEDAPHSLRSDLPTSSDSKDFSTSIPKQEKLLSLAGDSLFWSEADVVQATDDFNQNRKISQGTFADVYRGHRHGKPFVFKKLRETACSSPGSIERFFQAELQICLRCCHPNVLPVLGFCAARQFHSFIYPYMANGSLQDRLQGQGGSDPLPWPQRVSICSGLLCAVEYLHGLEIIHSNVKSSNVLLDQNLTPKLAHPMAHLCPVNKRSKYTMMKTHLLRTSAAYLPEDFIRVGQLTKRVDIFSCGIVLAEVLTGIPAMDNNRSPVYLKDLLLSDIPSSTASLCSRKTGVENVMAKEICQKYLEKGAGRLPEDCAEALATAACLCLRRRNTSLQEVCGSVAAVEERLRGRETLLPWSGLSEGTGSSSNTPEETDDVDNSSLDASSSMSVAPWAGAATPLLPTENGEGRLRVIVGREADSSSEACVGLEPPQDVTETSWQIEINEAKRKLMENILLYKEEKVDSIELFGP

SEQ ID NO: 41715 - protein, 596 aa, Homo sapiens
  Payload ID: 8491
  Gene Symbol: IRAK3
  Gene Name: interleukin-1 receptor-associated kinase 3
  Uniprot ID: Q9Y616
  ENSP ID: ENSP00000261233
MAGNCGARGALSAHTLLFDLPPALLGELCAVLDSCDGALGWRGLAERLSSSWLDVRHIEKYVDQGKSGTRELLWSWAQKNKTIGDLLQVLQEMGHRRAIHLITNYGAVLSPSEKSYQEGGFPNILFKETANVTVDNVLIPEHNEKGILLKSSISFQNIIEGTRNFHKDFLIGEGEIFEVYRVEIQNLTYAVKLFKQEKKMQCKKHWKRFLSELEVLLLFHHPNILELAAYFTETEKFCLIYPYMRNGTLFDRLQCVGDTAPLPWHIRIGILIGISKAIHYLHNVQPCSVICGSISSANILLDDQFQPKLTDFAMAHFRSHLEHQSCTINMTSSSSKHLWYMPEEYIRQGKLSIKTDVYSFGIVIMEVLTGCRVVLDDPKHIQLRDLLRELMEKRGLDSCLSFLDKKVPPCPRNFSAKLFCLAGRCAATRAKLRPSMDEVLNTLESTQASLYFAEDPPTSLKSFRCPSPLFLENVPSIPVEDDESQNNNLLPSDEGLRIDRMTQKTPFECSQSEVMFLSLDKKPESKRNEEACNMPSSSCEESWFPKYIVPSQDLRPYKVNIDPSSEAPGHSCRSRPVESSCSSKFSWDEYEQYKKE

SEQ ID NO: 41716 - protein, 535 aa, Homo sapiens
  Payload ID: 8491
  Gene Symbol: IRAK3
  Gene Name: interleukin-1 receptor-associated kinase 3
  Uniprot ID: Q9Y616
  ENSP ID: ENSP00000409852
MAGNCGARGALSAHTLLFDLPPALLGELCAVLDSCDGALGWRGLGAVLSPSEKSYQEGGFPNILFKETANVTVDNVLIPEHNEKGILLKSSISFQNIIEGTRNFHKDFLIGEGEIFEVYRVEIQNLTYAVKLFKQEKKMQCKKHWKRFLSELEVLLLFHHPNILELAAYFTETEKFCLIYPYMRNGTLFDRLQCVGDTAPLPWHIRIGILIGISKAIHYLHNVQPCSVICGSISSANILLDDQFQPKLTDFAMAHFRSHLEHQSCTINMTSSSSKHLWYMPEEYIRQGKLSIKTDVYSFGIVIMEVLTGCRVVLDDPKHIQLRDLLRELMEKRGLDSCLSFLDKKVPPCPRNFSAKLFCLAGRCAATRAKLRPSMDEVLNTLESTQASLYFAEDPPTSLKSFRCPSPLFLENVPSIPVEDDESQNNNLLPSDEGLRIDRMTQKTPFECSQSEVMFLSLDKKPESKRNEEACNMPSSSCEESWFPKYIVPSQDLRPYKVNIDPSSEAPGHSCRSRPVESSCSSKFSWDEYEQYKKE

SEQ ID NO: 41717 - protein, 93 aa, Homo sapiens
  Payload ID: 8491
  Gene Symbol: IRAK3
  Gene Name: interleukin-1 receptor-associated kinase 3
  ENSP ID: ENSP00000441321
MAGNCGARGALSAHTLLFDLPPALLGELCAVLDSCDGALGWRGLVSKNKLCENGVLILQGFWHVVVCKYKDSKYGCVALFEKTPSETYLHMET

SEQ ID NO: 41718 - protein, 336 aa, Homo sapiens
  Payload ID: 8492
  Gene Symbol: IRAK4
  Gene Name: interleukin-1 receptor-associated kinase 4
  Uniprot ID: Q9NWZ3
  ENSP ID: ENSP00000390327
MPFCDKDRTLMTPVQNLEQSYMPPDSSSPENKSLEVSDTRFHSFSFYELKNVTNNFDERPISVGGNKMGEGGFGVVYKGYVNNTTVAVKKLAAMVDITTEELKQQFDQEIKVMAKCQHENLVELLGFSSDGDDLCLVYVYMPNGSLLDRLSCLDGTPPLSWHMRCKIAQGAANGINFLHENHHIHRDIKSANILLDEAFTAKISDFGLARASEKFAQTVMTSRIVGTTAYMAPEALRGEITPKSDIYSFGVVLLEIITGLPAVDEHREPQLLLDIKEEIEDEEKTIEDYIDKKMNDADSTSVEAMYSVASQCLHEKKNKRPDIKKVQQLLQEMTAS

SEQ ID NO: 41719 - protein, 218 aa, Homo sapiens
  Payload ID: 8492
  Gene Symbol: IRAK4
  Gene Name: interleukin-1 receptor-associated kinase 4
  ENSP ID: ENSP00000390651
MNKPITPSTYVRCLNVGLIRKLSDFIDPQEGWKKLAVAIKKPSGDDRYNQFHIRRFEALLQTGKSPTSELLFDWGTTNCTVGDLVDLLIQNEFFAPASLLLPDAVPKTANTLPSKEAITVQQKQMPFCDKDRTLMTPVQNLEQSYMPPDSSSPENKSLEVSDTRFHSFSFYELKNVTNNFDERPISVGGNKMGEGGFGVVYKGYVNNNCGSEEACSNG

SEQ ID NO: 41720 - protein, 336 aa, Homo sapiens; identical to SEQ ID NO: 41718
  Payload ID: 8492
  Gene Symbol: IRAK4
  Gene Name: interleukin-1 receptor-associated kinase 4
  Uniprot ID: Q9NWZ3
  ENSP ID: ENSP00000408734

SEQ ID NO: 41721 - protein, 460 aa, Homo sapiens
  Payload ID: 8492
  Gene Symbol: IRAK4
  Gene Name: interleukin-1 receptor-associated kinase 4
  Uniprot ID: Q9NWZ3
  ENSP ID: ENSP00000446490
MNKPITPSTYVRCLNVGLIRKLSDFIDPQEGWKKLAVAIKKPSGDDRYNQFHIRRFEALLQTGKSPTSELLFDWGTTNCTVGDLVDLLIQNEFFAPASLLLPDAVPKTANTLPSKEAITVQQKQMPFCDKDRTLMTPVQNLEQSYMPPDSSSPENKSLEVSDTRFHSFSFYELKNVTNNFDERPISVGGNKMGEGGFGVVYKGYVNNTTVAVKKLAAMVDITTEELKQQFDQEIKVMAKCQHENLVELLGFSSDGDDLCLVYVYMPNGSLLDRLSCLDGTPPLSWHMRCKIAQGAANGINFLHENHHIHRDIKSANILLDEAFTAKISDFGLARASEKFAQTVMTSRIVGTTAYMAPEALRGEITPKSDIYSFGVVLLEIITGLPAVDEHREPQLLLDIKEEIEDEEKTIEDYIDKKMNDADSTSVEAMYSVASQCLHEKKNKRPDIKKVQQLLQEMTAS

SEQ ID NO: 41722 - protein, 89 aa, Homo sapiens
  Payload ID: 8492
  Gene Symbol: IRAK4
  Gene Name: interleukin-1 receptor-associated kinase 4
  ENSP ID: ENSP00000446571
MNKPITPSTYVRCLNVGLIRKLSDFIDPQEGWKKLAVAIKKPSGDDRYNQFHIRRFEALLQTGKSPTSELLFDWGTTNCTVGDLVDLLI

SEQ ID NO: 41723 - protein, 60 aa, Homo sapiens
  Payload ID: 8492
  Gene Symbol: IRAK4
  Gene Name: interleukin-1 receptor-associated kinase 4
  ENSP ID: ENSP00000448197
MNKPITPSTYVRCLNVGLIRKLSDFIDPQEGWKKLAVAIKKPSGDDRYNQFHIRCCSQNC

SEQ ID NO: 41724 - protein, 54 aa, Homo sapiens
  Payload ID: 8492
  Gene Symbol: IRAK4
  Gene Name: interleukin-1 receptor-associated kinase 4
  ENSP ID: ENSP00000449317
MNKPITPSTYVRCLNVGLIRKLSDFIDPQEGWKKLAVAIKKPSGDDRYNQFHIR

SEQ ID NO: 41725 - protein, 60 aa, Homo sapiens; identical to SEQ ID NO: 41723
  Payload ID: 8492
  Gene Symbol: IRAK4
  Gene Name: interleukin-1 receptor-associated kinase 4
  ENSP ID: ENSP00000449553

SEQ ID NO: 41726 - protein, 60 aa, Homo sapiens; identical to SEQ ID NO: 41723
  Payload ID: 8492
  Gene Symbol: IRAK4
  Gene Name: interleukin-1 receptor-associated kinase 4
  ENSP ID: ENSP00000449693

SEQ ID NO: 41727 - protein, 54 aa, Homo sapiens; identical to SEQ ID NO: 41724
  Payload ID: 8492
  Gene Symbol: IRAK4
  Gene Name: interleukin-1 receptor-associated kinase 4
  ENSP ID: ENSP00000449848

SEQ ID NO: 41728 - protein, 60 aa, Homo sapiens; identical to SEQ ID NO: 41723
  Payload ID: 8492
  Gene Symbol: IRAK4
  Gene Name: interleukin-1 receptor-associated kinase 4
  ENSP ID: ENSP00000449859

SEQ ID NO: 41729 - protein, 460 aa, Homo sapiens; identical to SEQ ID NO: 41721
  Payload ID: 8492
  Gene Symbol: IRAK4
  Gene Name: interleukin-1 receptor-associated kinase 4
  Uniprot ID: Q9NWZ3
  ENSP ID: ENSP00000479889

SEQ ID NO: 41730 - protein, 562 aa, Homo sapiens
  Payload ID: 8493
  Gene Symbol: IFFO1
  Gene Name: intermediate filament family orphan 1
  Uniprot ID: Q0D2I5
  ENSP ID: ENSP00000337593
MNPLFGPNLFLLQQEQQGLAGPLGDSLGGDHFAGGGDLPPAPLSPAGPAAYSPPGPGPAPPAAMALRNDLGSNINVLKTLNLRFRCFLAKVHELERRNRLLEKQLQQALEEGKQGRRGLGRRDQAVQTGFVSPIRPLGLQLGARPAAVCSPSARVLGSPARSPAGPLAPSAASLSSSSTSTSTTYSSSARFMPGTIWSFSHARRLGPGLEPTLVQGPGLSWVHPDGVGVQIDTITPEIRALYNVLAKVKRERDEYKRRWEEEYTVRIQLQDRVNELQEEAQEADACQEELALKVEQLKAELVVFKGLMSNNLSELDTKIQEKAMKVDMDICRRIDITAKLCDVAQQRNCEDMIQMFQKKLVPSMGGRKRERKAAVEEDTSLSESEGPRQPDGDEEESTALSINEEMQRMLNQLREYDFEDDCDSLTWEETEETLLLWEDFSGYAMAAAEAQGEQEDSLEKVIKDTESLFKTREKEYQETIDQIELELATAKNDMNRHLHEYMEMCSMKRGLDVQMETCRRLITQSGDRKSPAFTAVPLSDPPPPPSEAEDSDRDVSSDSSMR

SEQ ID NO: 41731 - protein, 563 aa, Homo sapiens
  Payload ID: 8493
  Gene Symbol: IFFO1
  Gene Name: intermediate filament family orphan 1
  Uniprot ID: Q0D2I5
  ENSP ID: ENSP00000349364
MNPLFGPNLFLLQQEQQGLAGPLGDSLGGDHFAGGGDLPPAPLSPAGPAAYSPPGPGPAPPAAMALRNDLGSNINVLKTLNLRFRCFLAKVHELERRNRLLEKQLQQALEEGKQGRRGLGRRDQAVQTGFVSPIRPLGLQLGARPAAVCSPSARVLGSPARSPAGPLAPSAASLSSSSTSTSTTYSSSARFMPGTIWSFSHARRLGPGLEPTLVQGPGLSWVHPDGVGVQIDTITPEIRALYNVLAKVKRERDEYKRRWEEEYTVRIQLQDRVNELQEEAQEADACQEELALKVEQLKAELVVFKGLMSNNLSELDTKIQEKAMKVDMDICRRIDITAKLCDVAQQRNCEDMIQMFQKKLVPSMGGRKRERKAAVEEDTSLSESEGPRQPDGDEEESTALSINEEMQRMLNQLREYDFEDDCDSLTWEETEETLLLWEDFSGYAMAAAEAQGEQQEDSLEKVIKDTESLFKTREKEYQETIDQIELELATAKNDMNRHLHEYMEMCSMKRGLDVQMETCRRLITQSGDRKSPAFTAVPLSDPPPPPSEAEDSDRDVSSDSSMR

SEQ ID NO: 41732 - protein, 559 aa, Homo sapiens
  Payload ID: 8493
  Gene Symbol: IFFO1
  Gene Name: intermediate filament family orphan 1
  Uniprot ID: Q0D2I5
  ENSP ID: ENSP00000380052
MNPLFGPNLFLLQQEQQGLAGPLGDSLGGDHFAGGGDLPPAPLSPAGPAAYSPPGPGPAPPAAMALRNDLGSNINVLKTLNLRFRCFLAKVHELERRNRLLEKQLQQALEEGKQGRRGLGRRDQAVQTGFVSPIRPLGLQLGARPAAVCSPSARVLGSPARSPAGPLAPSAASLSSSSTSTSTTYSSSARFMPGTIWSFSHARRLGPGLEPTLVQGPGLSWVHPDGVGVQIDTITPEIRALYNVLAKVKRERDEYKRRWEEEYTVRIQLQDRVNELQEEAQEADACQEELALKVEQLKAELVVFKGLMSNNLSELDTKIQEKAMKVDMDICRRIDITAKLCDVAQQRNCEDMIQMFQVPSMGGRKRERKAAVEEDTSLSESEGPRQPDGDEEESTALSINEEMQRMLNQLREYDFEDDCDSLTWEETEETLLLWEDFSGYAMAAAEAQGEQEDSLEKVIKDTESLFKTREKEYQETIDQIELELATAKNDMNRHLHEYMEMCSMKRGLDVQMETCRRLITQSGDRKSPAFTAVPLSDPPPPPSEAEDSDRDVSSDSSMR

SEQ ID NO: 41733 - protein, 256 aa, Homo sapiens
  Payload ID: 8493
  Gene Symbol: IFFO1
  Gene Name: intermediate filament family orphan 1
  ENSP ID: ENSP00000390721
MSNNLSELDTKIQEKAMKVDMDICRRIDITAKLCDVAQQRNCEDMIQMFQKKLVPSMGGRKRERKAAVEEDTSLSESEGPRQPDGDEEESTALSINEEMQRMLNQLREYDFEDDCDSLTWEETEETLLLWEDFSGYAMAAAEAQGEQQEDSLEKVIKDTESLFKTREKEYQETIDQIELELATAKNDMNRHLHEYMEMCSMKRGLDVQMETCRRLITQSGDRKSPAFTAVPLSDPPPPPSEAEDSDRDVSSDSSMR

SEQ ID NO: 41734 - protein, 264 aa, Homo sapiens
  Payload ID: 8493
  Gene Symbol: IFFO1
  Gene Name: intermediate filament family orphan 1
  Uniprot ID: Q0D2I5
  ENSP ID: ENSP00000432493
MNPLFGPNLFLLQQEQQGLAGPLGDSLGGDHFAGGGDLPPAPLSPAGPAAYSPPGPGPAPPAAMALRNDLGSNINVLKTLNLRFRCFLAKVHELERRNRLLEKQLQQALEEGKQGRRGLGRRDQAVQTGFVSPIRPLGLQLGARPAAVCSPSARVLGSPARSPAGPLAPSAASLSSSSTSTSTTYSSSARFMPGTIWSFSHARRLGPGLEPTLVQGPGLSWVHPDGVGVQIDTITPEIRALYNVLAKVKRERDEYKRRCFYRVK

SEQ ID NO: 41735 - protein, 255 aa, Homo sapiens
  Payload ID: 8493
  Gene Symbol: IFFO1
  Gene Name: intermediate filament family orphan 1
  ENSP ID: ENSP00000436261
MSNNLSELDTKIQEKAMKVDMDICRRIDITAKLCDVAQQRNCEDMIQMFQKKLVPSMGGRKRERKAAVEEDTSLSESEGPRQPDGDEEESTALSINEEMQRMLNQLREYDFEDDCDSLTWEETEETLLLWEDFSGYAMAAAEAQGEQEDSLEKVIKDTESLFKTREKEYQETIDQIELELATAKNDMNRHLHEYMEMCSMKRGLDVQMETCRRLITQSGDRKSPAFTAVPLSDPPPPPSEAEDSDRDVSSDSSMR

SEQ ID NO: 41736 - protein, 571 aa, Homo sapiens
  Payload ID: 8493
  Gene Symbol: IFFO1
  Gene Name: intermediate filament family orphan 1
  ENSP ID: ENSP00000482285
MNPLFGPNLFLLQQEQQGLAGPLGDSLGGDHFAGGGDLPPAPLSPAGPAAYSPPGPGPAPPAAMALRNDLGSNINVLKTLNLRFRCFLAKVHELERRNRLLEKQLQQALEEGKQGRRGLGRRDQAVQTGFVSPIRPLGLQLGARPAAVCSPSARVLGSPARSPAGPLAPSAASLSSSSTSTSTTYSSSARFMPGTIWSFSHARRLGPGLEPTLVQGPGLSWVHPDGVGVQIDTITPEIRALYNVLAKVKRERDEYKRRWEEEYTVRIQLQDRVNELQEEAQEADACQEELALKVEQLKAELVVFKGLMSNNLSELDTKIQEKAMKVDMDICRRIDITAKLCDVAQQRNCEDMIQMFQKKLSLHLSPIKVPSMGGRKRERKAAVEEDTSLSESEGPRQPDGDEEESTALSINEEMQRMLNQLREYDFEDDCDSLTWEETEETLLLWEDFSGYAMAAAEAQGEQQEDSLEKVIKDTESLFKTREKEYQETIDQIELELATAKNDMNRHLHEYMEMCSMKRGLDVQMETCRRLITQSGDRKSPAFTAVPLSDPPPPPSEAEDSDRDVSSDSSMR

SEQ ID NO: 41737 - protein, 256 aa, Homo sapiens; identical to SEQ ID NO: 41733
  Payload ID: 8493
  Gene Symbol: IFFO1
  Gene Name: intermediate filament family orphan 1
  ENSP ID: ENSP00000482340

SEQ ID NO: 41738 - protein, 88 aa, Homo sapiens
  Payload ID: 8494
  Gene Symbol: IFFO2
  Gene Name: intermediate filament family orphan 2
  ENSP ID: ENSP00000347820
CNPTIDLQGELELATAKSDMNRHLHEYMEMCSMKRGLDVQMETCRRLIKGSADRNSPSPSSVASSDSGSTDEIQDEFEREADVEPMVS

SEQ ID NO: 41739 - protein, 517 aa, Homo sapiens
  Payload ID: 8494
  Gene Symbol: IFFO2
  Gene Name: intermediate filament family orphan 2
  Uniprot ID: Q5TF58
  ENSP ID: ENSP00000387941
MVNSLLFGEMALAFGCPPGGGGGGCPGGGGGGGGAGPGPSPVTAALRDDLGSNIHLLKGLNVRFRCFLAKVHELERRNRLLEKQLEQQQSERERRLRYKTFSREQAVQTGPELLRPPAPGGGHGLSSGAAAGANANAVALGGLPPGGGSHPQHYGRLPGTIWSYTQVRRTGGGGVETVQGPGVSWVHPDGVGVQIDTITPEIRALYNVLAKVKRERDEYKRRWEEELAKRMNLQTMVDTLQEAAQEADAIQEEMNEKIERLKAELVVFKGLMSDPMTDLDTKIQEKAMKVDMDICRRIDITAKLCDVAQQRNSEDVSKIFQVVPKKKERKVASDDDISEQDGEVNRFSDDEVGSMNITDEMKRMFNQLRETFDFDDDCDSLTWEENEDTLLLWEDFTNCNPTIDLQGEQEENLGNLIHETESFFKTRDKEYQETIGQIELELATAKSDMNRHLHEYMEMCSMKRGLDVQMETCRRLIKGSADRNSPSPSSVASSDSGSTDEIQDEFEREADVEPMVS

SEQ ID NO: 41740 - protein, 259 aa, Homo sapiens
  Payload ID: 8494
  Gene Symbol: IFFO2
  Gene Name: intermediate filament family orphan 2
  ENSP ID: ENSP00000394655
  MOD_RES (1)..(1): Any amino acid
XKRERDEYKRRWEEELAKRMNLQTMVDTLQEAAQEADAIQEEMNEKIERLKAELVVFKGLMSDVVPKKKERKVASDDDISEQDGEVNRFSDDEVGSMNITDEMKRMFNQLRETFDFDDDCDSLTWEENEDTLLLWEDFTNCNPTIDLQGEQEENLGNLIHETESFFKTRDKEYQETIGQIELELATAKSDMNRHLHEYMEMCSMKRGLDVQMETCRRLIKGSADRNSPSPSSVASSDSGSTDEIQDEFEREADVEPMVS

SEQ ID NO: 41741 - protein, 499 aa, Homo sapiens
  Payload ID: 8495
  Gene Symbol: INA
  Gene Name: internexin neuronal intermediate filament protein, alpha
  Uniprot ID: Q16352
  ENSP ID: ENSP00000358865
MSFGSEHYLCSSSSYRKVFGDGSRLSARLSGAGGAGGFRSQSLSRSNVASSAACSSASSLGLGLAYRRPPASDGLDLSQAAARTNEYKIIRTNEKEQLQGLNDRFAVFIEKVHQLETQNRALEAELAALRQRHAEPSRVGELFQRELRDLRAQLEEASSARSQALLERDGLAEEVQRLRARCEEESRGREGAERALKAQQRDVDGATLARLDLEKKVESLLDELAFVRQVHDEEVAELLATLQASSQAAAEVDVTVAKPDLTSALREIRAQYESLAAKNLQSAEEWYKSKFANLNEQAARSTEAIRASREEIHEYRRQLQARTIEIEGLRGANESLERQILELEERHSAEVAGYQDSIGQLENDLRNTKSEMARHLREYQDLLNVKMALDIEIAAYRKLLEGEETRFSTSGLSISGLNPLPNPSYLLPPRILSATTSKVSSTGLSLKKEEEEEEASKVASKKTSQIGESFEEILEETVISTKKTEKSNIEETTISSQKI

SEQ ID NO: 41742 - protein, 496 aa, Homo sapiens
  Payload ID: 8495
  Gene Symbol: INA
  Gene Name: internexin neuronal intermediate filament protein, alpha
  ENSP ID: ENSP00000481793
MSFGSEHYLCSSSSYRKVFGDGSRLSARLSGAGGAGASAQSLSRSNVASSAACSSASSLGLGLAYRRPPASDGLDLSQAAARTNEYKIIRTNEKEQLQGLNDRFAVFIEKVHQLETQNRALEAELARCDSHAEPSRVGELFQRELRDLRAQLEEASSARSQALLERDGLAEEVQRLRARCEEESRGRERRARLKAQQRDVDGATLARLDLEKKVESLLDELAFVRQVHDEEVAELLATLQASSQAAAEVDVTVAKPDLTSALREIRAQYESLAAKNLQSAEEWYKSKFANLNEQAARSTEAIRASREEIHEYRRQLQARTIEIEGLRGANESLERQILELEERHSAEVAGYQDSIGQLENDLRNTKSEMARHLREYQDLLNVKMALDIEIAAYRKLLEGEETRFSTSGLSISGLNPLPNPSYLLPPRILSATTSKVSSTGLSLKKEEEEEEASKVASKKTSQIGESFEEILEETVISTKKTEKSNIEETTISSQKI

SEQ ID NO: 41743 - protein, 797 aa, Homo sapiens
  Payload ID: 8496
  Gene Symbol: IMPG1
  Gene Name: interphotoreceptor matrix proteoglycan 1
  Uniprot ID: Q17R60
  ENSP ID: ENSP00000358966
MYLETRRAIFVFWIFLQVQGTKDISINIYHSETKDIDNPPRNETTESTEKMYKMSTMRRIFDLAKHRTKRSAFFPTGVKVCPQESMKQILDSLQAYYRLRVCQEAVWEAYRIFLDRIPDTGEYQDWVSICQQETFCLFDIGKNFSNSQEHLDLLQQRIKQRSFPDRKDEISAEKTLGEPGETIVISTDVANVSLGPFPLTPDDTLLNEILDNTLNDTKMPTTERETEFAVLEEQRVELSVSLVNQKFKAELADSQSPYYQELAGKSQLQMQKIFKKLPGFKKIHVLGFRPKKEKDGSSSTEMQLTAIFKRHSAEAKSPASDLLSFDSNKIESEEVYHGTMEEDKQPEIYLTATDLKRLISKALEEEQSLDVGTIQFTDEIAGSLPAFGPDTQSELPTSFAVITEDATLSPELPPVEPQLETVDGAEHGLPDTSWSPPAMASTSLSEAPPFFMASSIFSLTDQGTTDTMATDQTMLVPGLTIPTSDYSAISQLALGISHPPASSDDSRSSAGGEDMVRHLDEMDLSDTPAPSEVPELSEYVSVPDHFLEDTTPVSALQYITTSSMTIAPKGRELVVFFSLRVANMAFSNDLFNKSSLEYRALEQQFTQLLVPYLRSNLTGFKQLEILNFRNGSVIVNSKMKFAKSVPYNLTKAVHGVLEDFRSAAAQQLHLEIDSYSLNIEPADQADPCKFLACGEFAQCVKNERTEEAECRCKPGYDSQGSLDGLEPGLCGPGTKECEVLQGKGAPCRLPDHSENQAYKTSVKKFQNQQNNKVISKRNSELLTVEYEEFNHQDWEGN

SEQ ID NO: 41744 - protein, 158 aa, Homo sapiens
  Payload ID: 8496
  Gene Symbol: IMPG1
  Gene Name: interphotoreceptor matrix proteoglycan 1
  ENSP ID: ENSP00000358968
ERPNGTSAQPAQVKPEFYRQAELKPCPWTGSNQRRCITFCPTPDQADPCKFLACGEFAQCVKNERTEEAECRCKPGYDSQGSLDGLEPGLCGPGTKECEVLQGKGAPCRLPDHSENQAYKTSVKKFQNQQNNKVISKRNSELLTVEYEEFNHQDWEGN

SEQ ID NO: 41745 - protein, 140 aa, Homo sapiens
  Payload ID: 8496
  Gene Symbol: IMPG1
  Gene Name: interphotoreceptor matrix proteoglycan 1
  ENSP ID: ENSP00000358980
MKQILDSLQAYYRLRVCQEAVWEAYRIFLDRIPDTGEYQDWVSICQQETFCLFDIGKNFSNSQEHLDLLQQRIKQRSFPDRKDEISAEKTLGEPGETIVISTEKNKGKTKPFNILQFGNNHHEHLLPIFCLLSSIIYTYY

SEQ ID NO: 41746 - protein, 719 aa, Homo sapiens
  Payload ID: 8496
  Gene Symbol: IMPG1
  Gene Name: interphotoreceptor matrix proteoglycan 1
  ENSP ID: ENSP00000481913
MYLETRRAIFVFWIFLQVQGTKVCQEAVWEAYRIFLDRIPDTGEYQDWVSICQQETFCLFDIGKNFSNSQEHLDLLQQRIKQRSFPDRKDEISAEKTLGEPGETIVISTDVANVSLGPFPLTPDDTLLNEILDNTLNDTKMPTTERETEFAVLEEQRVELSVSLVNQKFKAELADSQSPYYQELAGKSQLQMQKIFKKLPGFKKIHVLGFRPKKEKDGSSSTEMQLTAIFKRHSAEAKSPASDLLSFDSNKIESEEVYHGTMEEDKQPEIYLTATDLKRLISKALEEEQSLDVGTIQFTDEIAGSLPAFGPDTQSELPTSFAVITEDATLSPELPPVEPQLETVDGAEHGLPDTSWSPPAMASTSLSEAPPFFMASSIFSLTDQGTTDTMATDQTMLVPGLTIPTSDYSAISQLALGISHPPASSDDSRSSAGGEDMVRHLDEMDLSDTPAPSEVPELSEYVSVPDHFLEDTTPVSALQYITTSSMTIAPKGRELVVFFSLRVANMAFSNDLFNKSSLEYRALEQQFTQLLVPYLRSNLTGFKQLEILNFRNGSVIVNSKMKFAKSVPYNLTKAVHGVLEDFRSAAAQQLHLEIDSYSLNIEPADQADPCKFLACGEFAQCVKNERTEEAECRCKPGYDSQGSLDGLEPGLCGPGTKECEVLQGKGAPCRLPDHSENQAYKTSVKKFQNQQNNKVISKRNSELLTVEYEEFNHQDWEGN

SEQ ID NO: 41747 - protein, 1241 aa, Homo sapiens
  Payload ID: 8497
  Gene Symbol: IMPG2
  Gene Name: interphotoreceptor matrix proteoglycan 2
  Uniprot ID: Q9BZV3
  ENSP ID: ENSP00000193391
MIMFPLFGKISLGILIFVLIEGDFPSLTAQTYLSIEEIQEPKSAVSFLLPEESTDLSLATKKKQPLDRRETERQWLIRRRRSILFPNGVKICPDESVAEAVANHVKYFKVRVCQEAVWEAFRTFWDRLPGREEYHYWMNLCEDGVTSIFEMGTNFSESVEHRSLIMKKLTYAKETVSSSELSSPVPVGDTSTLGDTTLSVPHPEVDAYEGASESSLERPEESISNEIENVIEEATKPAGEQIAEFSIHLLGKQYREELQDSSSFHHQHLEEEFISEVENAFTGLPGYKEIRVLEFRSPKENDSGVDVYYAVTFNGEAISNTTWDLISLHSNKVENHGLVELDDKPTVVYTISNFRDYIAETLQQNFLLGNSSLNPDPDSLQLINVRGVLRHQTEDLVWNTQSSSLQATPSSILDNTFQAAWPSADESITSSIPPLDFSSGPPSATGRELWSESPLGDLVSTHKLAFPSKMGLSSSPEVLEVSSLTLHSVTPAVLQTGLPVASEERTSGSHLVEDGLANVEESEDFLSIDSLPSSSFTQPVPKETIPSMEDSDVSLTSSPYLTSSIPFGLDSLTSKVKDQLKVSPFLPDASMEKELIFDGGLGSGSGQKVDLITWPWSETSSEKSAEPLSKPWLEDDDSLLPAEIEDKKLVLVDKMDSTDQISKHSKYEHDDRSTHFPEEEPLSGPAVPIFADTAAESASLTLPKHISEVPGVDDYSVTKAPLILTSVAISASTDKSDQADAILREDMEQITESSNYEWFDSEVSMVKPDMQTLWTILPESERVWTRTSSLEKLSRDILASTPQSADRLWLSVTQSTKLPPTTISTLLEDEVIMGVQDISLELDRIGTDYYQPEQVQEQNGKVGSYVEMSTSVHSTEMVSVAWPTEGGDDLSYTQTSGALVVFFSLRVTNMMFSEDLFNKNSLEYKALEQRFLELLVPYLQSNLTGFQNLEILNFRNGSIVVNSRMKFANSVPPNVNNAVYMILEDFCTTAYNTMNLAIDKYSLDVESGDEANPCKFQACNEFSECLVNPWSGEAKCRCFPGYLSVEERPCQSLCDLQPDFCLNDGKCDIMPGHGAICRCRVGENWWYRGKHCEEFVSEPVIIGITIASVVGLLVIFSAIIYFFIRTLQAHHDRSERESPFSGSSRQPDSLSSIENAVKYNPVYESHRAGCEKYEGPYPQHPFYSSASGDVIGGLSREEIRQMYESSELSREEIQERMRVLELYANDPEFAAFVREQQVEEV

SEQ ID NO: 41748 - protein, 237 aa, Homo sapiens
  Payload ID: 8498
  Gene Symbol: ITSN1
  Gene Name: intersectin 1 (SH3 domain protein)
  ENSP ID: ENSP00000369294
MGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVAVFLV

SEQ ID NO: 41749 - protein, 361 aa, Homo sapiens
  Payload ID: 8498
  Gene Symbol: ITSN1
  Gene Name: intersectin 1 (SH3 domain protein)
  ENSP ID: ENSP00000370683
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELER

SEQ ID NO: 41750 - protein, 317 aa, Homo sapiens
  Payload ID: 8498
  Gene Symbol: ITSN1
  Gene Name: intersectin 1 (SH3 domain protein)
  ENSP ID: ENSP00000370684
  MOD_RES (1)..(1): Any amino acid
XPLMESELLTEKEVAMIFVNWKELIMCNIKLLKALRVRKKMSGEKMPVKMIGDILSAQLPHMQPYIRFCSRQLNGAALIQQKTDEAPDFKEFVKRLAMDPRCKGMPLSSFILKPMQRVTRYPLIIKNQLVFNSVTNCLGPRKFLHSGKLYKAKSNKELYGFLFNDFLLLTQITKPLGSSGTDKVFSPKSNLQYKMYKTPIFLNEVLVKLPTDPSGDEPIFHISHIDRVYTLRAESINERTAWVQKIKAASELYIETEKKKREKAYLVRSQRATGIGRLMVNVVEGIELKPCRSHGKSNPYCEVTMGSQCHITKTIQD

SEQ ID NO: 41751 - protein, 877 aa, Homo sapiens
  Payload ID: 8498
  Gene Symbol: ITSN1
  Gene Name: intersectin 1 (SH3 domain protein)
  ENSP ID: ENSP00000370685
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQHGFWFFRESC

SEQ ID NO: 41752 - protein, 1220 aa, Homo sapiens
  Payload ID: 8498
  Gene Symbol: ITSN1
  Gene Name: intersectin 1 (SH3 domain protein)
  Uniprot ID: Q15811
  ENSP ID: ENSP00000370691
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVKGEWVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEFIAMYTYESSEQGDLTFQQGDVILVTKKDGDWWTGTVGDKAGVFPSNYVRLKDSEGSGTAGKTGSLGKKPEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQ

SEQ ID NO: 41753 - protein, 1721 aa, Homo sapiens
  Payload ID: 8498
  Gene Symbol: ITSN1
  Gene Name: intersectin 1 (SH3 domain protein)
  Uniprot ID: Q15811
  ENSP ID: ENSP00000370719
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVKGEWVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEFIAMYTYESSEQGDLTFQQGDVILVTKKDGDWWTGTVGDKAGVFPSNYVRLKDSEGSGTAGKTGSLGKKPEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQWCSDLHLLDMLTPTERKRQGYIHELIVTEENYVNDLQLVTEIFQKPLMESELLTEKEVAMIFVNWKELIMCNIKLLKALRVRKKMSGEKMPVKMIGDILSAQLPHMQPYIRFCSRQLNGAALIQQKTDEAPDFKEFVKRLAMDPRCKGMPLSSFILKPMQRVTRYPLIIKNILENTPENHPDHSHLKHALEKAEELCSQVNEGVREKENSDRLEWIQAHVQCEGLSEQLVFNSVTNCLGPRKFLHSGKLYKAKSNKELYGFLFNDFLLLTQITKPLGSSGTDKVFSPKSNLQYKMYKTPIFLNEVLVKLPTDPSGDEPIFHISHIDRVYTLRAESINERTAWVQKIKAASELYIETEKKKREKAYLVRSQRATGIGRLMVNVVEGIELKPCRSHGKSNPYCEVTMGSQCHITKTIQDTLNPKWNSNCQFFIRDLEQEVLCITVFERDQFSPDDFLGRTEIRVADIKKDQGSKGPVTKCLLLHEVPTGEIVVRLDLQLFDEP

SEQ ID NO: 41754 - protein, 1020 aa, Homo sapiens
  Payload ID: 8498
  Gene Symbol: ITSN1
  Gene Name: intersectin 1 (SH3 domain protein)
  Uniprot ID: Q15811
  ENSP ID: ENSP00000382275
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQPDFLLHPSMRLGHMQPRIVLLFPDPLQCSTSRLLPMLRPRPGVPFLRSPSCQSPSHPSRPISDAAPSVKFTLMPPGRIHPCFLFIPAVNSRNSFLVYFILPGGTLGCFYLCLPHYL

SEQ ID NO: 41755 - protein, 1144 aa, Homo sapiens
  Payload ID: 8498
  Gene Symbol: ITSN1
  Gene Name: intersectin 1 (SH3 domain protein)
  Uniprot ID: Q15811
  ENSP ID: ENSP00000382286
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQ

SEQ ID NO: 41756 - protein, 1215 aa, Homo sapiens
  Payload ID: 8498
  Gene Symbol: ITSN1
  Gene Name: intersectin 1 (SH3 domain protein)
  Uniprot ID: Q15811
  ENSP ID: ENSP00000382289
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEFIAMYTYESSEQGDLTFQQGDVILVTKKDGDWWTGTVGDKAGVFPSNYVRLKDSEGSGTAGKTGSLGKKPEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQ

SEQ ID NO: 41757 - protein, 1178 aa, Homo sapiens
  Payload ID: 8498
  Gene Symbol: ITSN1
  Gene Name: intersectin 1 (SH3 domain protein)
  Uniprot ID: Q15811
  ENSP ID: ENSP00000382290
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEFIAMYTYESSEQGDLTFQQGDVILVTKKDGDWWTGTVGDKAGVFPSNYVRLKDSEGSGTAGKTGSLGKKPEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQ

SEQ ID NO: 41758 - protein, 1149 aa, Homo sapiens
  Payload ID: 8498
  Gene Symbol: ITSN1
  Gene Name: intersectin 1 (SH3 domain protein)
  ENSP ID: ENSP00000382292
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVKGEWVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQ

SEQ ID NO: 41759 - protein, 1716 aa, Homo sapiens
  Payload ID: 8498
  Gene Symbol: ITSN1
  Gene Name: intersectin 1 (SH3 domain protein)
  Uniprot ID: Q15811
  ENSP ID: ENSP00000382301
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEFIAMYTYESSEQGDLTFQQGDVILVTKKDGDWWTGTVGDKAGVFPSNYVRLKDSEGSGTAGKTGSLGKKPEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQWCSDLHLLDMLTPTERKRQGYIHELIVTEENYVNDLQLVTEIFQKPLMESELLTEKEVAMIFVNWKELIMCNIKLLKALRVRKKMSGEKMPVKMIGDILSAQLPHMQPYIRFCSRQLNGAALIQQKTDEAPDFKEFVKRLAMDPRCKGMPLSSFILKPMQRVTRYPLIIKNILENTPENHPDHSHLKHALEKAEELCSQVNEGVREKENSDRLEWIQAHVQCEGLSEQLVFNSVTNCLGPRKFLHSGKLYKAKSNKELYGFLFNDFLLLTQITKPLGSSGTDKVFSPKSNLQYKMYKTPIFLNEVLVKLPTDPSGDEPIFHISHIDRVYTLRAESINERTAWVQKIKAASELYIETEKKKREKAYLVRSQRATGIGRLMVNVVEGIELKPCRSHGKSNPYCEVTMGSQCHITKTIQDTLNPKWNSNCQFFIRDLEQEVLCITVFERDQFSPDDFLGRTEIRVADIKKDQGSKGPVTKCLLLHEVPTGEIVVRLDLQLFDEP

SEQ ID NO: 41760 - protein, 237 aa, Homo sapiens; identical to SEQ ID NO: 41748
  Payload ID: 8498
  Gene Symbol: ITSN1
  Gene Name: intersectin 1 (SH3 domain protein)
  ENSP ID: ENSP00000387377

SEQ ID NO: 41761 - protein, 260 aa, Homo sapiens
  Payload ID: 8498
  Gene Symbol: ITSN1
  Gene Name: intersectin 1 (SH3 domain protein)
  ENSP ID: ENSP00000396054
  MOD_RES (1)..(1): Any amino acid
XVMVKGEWVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQPDFLLHPSMRLGHMQPRIVLLFPDPLQCSTSRLLPMLRPRPGVPFLRSPSCQSPSHPSRPISDAAPSVKFTLMPPGRIHPCFLFIPAVNSRNSFLVYFILPGGTLGCFYLCLPHYL

SEQ ID NO: 41762 - protein, 115 aa, Homo sapiens
  Payload ID: 8498
  Gene Symbol: ITSN1
  Gene Name: intersectin 1 (SH3 domain protein)
  ENSP ID: ENSP00000400079
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAF

SEQ ID NO: 41763 - protein, 78 aa, Homo sapiens
  Payload ID: 8498
  Gene Symbol: ITSN1
  Gene Name: intersectin 1 (SH3 domain protein)
  ENSP ID: ENSP00000407132
MAQFPTPFGGSLDIWAITVEERAKHDQQFHSLKPISGFITGDQARNFFFQSGLPQPVLAQIWALADMNNDGRMDQVEF

SEQ ID NO: 41764 - protein, 66 aa, Homo sapiens
  Payload ID: 8498
  Gene Symbol: ITSN1
  Gene Name: intersectin 1 (SH3 domain protein)
  ENSP ID: ENSP00000408319
  MOD_RES (1)..(1): Any amino acid
XENTPENHPDHSHLKHALEKAEELCSQVNEGVREKENSDRLEWIQAHVQCEGLSEDCLGAENQSCF

SEQ ID NO: 41765 - protein, 173 aa, Homo sapiens
  Payload ID: 8498
  Gene Symbol: ITSN1
  Gene Name: intersectin 1 (SH3 domain protein)
  ENSP ID: ENSP00000409800
ENTPENHPDHSHLKHALEKAEELCSQVNEGVREKENSDRLEWIQAHVQCEGLSEPIFLNEVLVKLPTDPSGDEPIFHISHIDRVYTLRAESINERTAWVQKIKAASELYIETEKKKREKAYLVRSQRATGIGRLMVNVVEGIELKPCRSHGKSNPYCEVTMGSQCHITKTIQD

SEQ ID NO: 41766 - protein, 60 aa, Homo sapiens
  Payload ID: 8498
  Gene Symbol: ITSN1
  Gene Name: intersectin 1 (SH3 domain protein)
  ENSP ID: ENSP00000411464
  MOD_RES (1)..(1): Any amino acid
XRALADMNNDGRMDQVEFSIAMKLIKLKLQGYQLPSALPPVMKQQPVAISSAPAFGGNSV

SEQ ID NO: 41767 - protein, 77 aa, Homo sapiens
  Payload ID: 8498
  Gene Symbol: ITSN1
  Gene Name: intersectin 1 (SH3 domain protein)
  ENSP ID: ENSP00000413290
  MOD_RES (1)..(1): Any amino acid
XWWFGEVQGQKGWFPKSYVKLISGPIRKSTSMDSGSSESPASLKRVASPAAKPVVSGEGLWNCWENREFRKKTWSLL

SEQ ID NO: 41768 - protein, 77 aa, Homo sapiens
  Payload ID: 8498
  Gene Symbol: ITSN1
  Gene Name: intersectin 1 (SH3 domain protein)
  ENSP ID: ENSP00000415302
HQHQEPAKPAVQAPWSTAEKGPLTISAQENVKVVYYRALYPFESRSHDEITIQPGDIVMGNGWMKAKLENPAGLEEN

SEQ ID NO: 41769 - protein, 1697 aa, Homo sapiens
  Payload ID: 8499
  Gene Symbol: ITSN2
  Gene Name: intersectin 2
  Uniprot ID: Q9NZM3
  ENSP ID: ENSP00000347244
MMAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLEKEELCQRLKEQLDALEKETASKLSEMDSFNNQLKCGNMDDSVLQCLLSLLSCLNNLFLLLKELRETYNTQQLALEQLYKIKRDKLKEIERKRLELMQKKKLEDEAARKAKQGKENLWKENLRKEEEEKQKRLQEEKTQEKIQEEERKAEEKQRKDKDTLKAEEKKRETASVLVNYRALYPFEARNHDEMSFNSGDIIQVDEKTVGEPGWLYGSFQGNFGWFPCNYVEKMPSSENEKAVSPKKALLPPTVSLSATSTSSEPLSSNQPASVTDYQNVSFSNLTVNTSWQKKSAFTRTVSPGSVSPIHGQGQVVENLKAQALCSWTAKKDNHLNFSKHDIITVLEQQENWWFGEVHGGRGWFPKSYVKIIPGSEVKREEPEALYAAVNKKPTSAAYSVGEEYIALYPYSSVEPGDLTFTEGEEILVTQKDGEWWTGSIGDRSGIFPSNYVKPKDQESFGSASKSGASNKKPEIAQVTSAYVASGSEQLSLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQWCADLQTLDTMQPIERKRQGYIHELIQTEERYMADLQLVVEVFQKRMAESGFLTEGEMALIFVNWKELIMSNTKLLKALRVRKKTGGEKMPVQMIGDILAAELSHMQAYIRFCSCQLNGAALLQQKTDEDTDFKEFLKKLASDPRCKGMPLSSFLLKPMQRITRYPLLIRSILENTPESHADHSSLKLALERAEELCSQVNEGVREKENSDRLEWIQAHVQCEGLAEQLIFNSLTNCLGPRKLLHSGKLYKTKSNKELHGFLFNDFLLLTYMVKQFAVSSGSEKLFSSKSNAQFKMYKTPIFLNEVLVKLPTDPSSDEPVFHISHIDRVYTLRTDNINERTAWVQKIKAASEQYIDTEKKKREKAYQARSQKTSGIGRLMVHVIEATELKACKPNGKSNPYCEISMGSQSYTTRTIQDTLNPKWNFNCQFFIKDLYQDVLCLTLFDRDQFSPDDFLGRTEIPVAKIRTEQESKGPMTRRLLLHEVPTGEVWVRFDLQLFEQKTLL

SEQ ID NO: 41770 - protein, 1670 aa, Homo sapiens
  Payload ID: 8499
  Gene Symbol: ITSN2
  Gene Name: intersectin 2
  Uniprot ID: Q9NZM3
  ENSP ID: ENSP00000354561
MMAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLEKEELCQRLKEQLDALEKETASKLSEMDSFNNQLKELRETYNTQQLALEQLYKIKRDKLKEIERKRLELMQKKKLEDEAARKAKQGKENLWKENLRKEEEEKQKRLQEEKTQEKIQEEERKAEEKQRKDKDTLKAEEKKRETASVLVNYRALYPFEARNHDEMSFNSGDIIQVDEKTVGEPGWLYGSFQGNFGWFPCNYVEKMPSSENEKAVSPKKALLPPTVSLSATSTSSEPLSSNQPASVTDYQNVSFSNLTVNTSWQKKSAFTRTVSPGSVSPIHGQGQVVENLKAQALCSWTAKKDNHLNFSKHDIITVLEQQENWWFGEVHGGRGWFPKSYVKIIPGSEVKREEPEALYAAVNKKPTSAAYSVGEEYIALYPYSSVEPGDLTFTEGEEILVTQKDGEWWTGSIGDRSGIFPSNYVKPKDQESFGSASKSGASNKKPEIAQVTSAYVASGSEQLSLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQWCADLQTLDTMQPIERKRQGYIHELIQTEERYMADLQLVVEVFQKRMAESGFLTEGEMALIFVNWKELIMSNTKLLKALRVRKKTGGEKMPVQMIGDILAAELSHMQAYIRFCSCQLNGAALLQQKTDEDTDFKEFLKKLASDPRCKGMPLSSFLLKPMQRITRYPLLIRSILENTPESHADHSSLKLALERAEELCSQVNEGVREKENSDRLEWIQAHVQCEGLAEQLIFNSLTNCLGPRKLLHSGKLYKTKSNKELHGFLFNDFLLLTYMVKQFAVSSGSEKLFSSKSNAQFKMYKTPIFLNEVLVKLPTDPSSDEPVFHISHIDRVYTLRTDNINERTAWVQKIKAASEQYIDTEKKKREKAYQARSQKTSGIGRLMVHVIEATELKACKPNGKSNPYCEISMGSQSYTTRTIQDTLNPKWNFNCQFFIKDLYQDVLCLTLFDRDQFSPDDFLGRTEIPVAKIRTEQESKGPMTRRLLLHEVPTGEVWVRFDLQLFEQKTLL

SEQ ID NO: 41771 - protein, 1249 aa, Homo sapiens
  Payload ID: 8499
  Gene Symbol: ITSN2
  Gene Name: intersectin 2
  Uniprot ID: Q9NZM3
  ENSP ID: ENSP00000384499
MMAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLEKEELCQRLKEQLDALEKETASKLSEMDSFNNQLKCGNMDDSVLQCLLSLLSCLNNLFLLLKELRETYNTQQLALEQLYKIKRDKLKEIERKRLELMQKKKLEDEAARKAKQGKENLWKENLRKEEEEKQKRLQEEKTQEKIQEEERKAEEKQRKDKDTLKAEEKKRETASVLVNYRALYPFEARNHDEMSFNSGDIIQVDEKTVGEPGWLYGSFQGNFGWFPCNYVEKMPSSENEKAVSPKKALLPPTVSLSATSTSSEPLSSNQPASVTDYQNVSFSNLTVNTSWQKKSAFTRTVSPGSVSPIHGQGQVVENLKAQALCSWTAKKDNHLNFSKHDIITVLEQQENWWFGEVHGGRGWFPKSYVKIIPGSEVKREEPEALYAAVNKKPTSAAYSVGEEYIALYPYSSVEPGDLTFTEGEEILVTQKDGEWWTGSIGDRSGIFPSNYVKPKDQESFGSASKSGASNKKPEIAQVTSAYVASGSEQLSLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQWCADLQTLDTMQPIERKRQGYIHELIQTEERYMADLQLVVEVRRLLLASSRGICCLS

SEQ ID NO: 41772 - protein, 120 aa, Homo sapiens
  Payload ID: 8499
  Gene Symbol: ITSN2
  Gene Name: intersectin 2
  ENSP ID: ENSP00000389013
  MOD_RES (1)..(1): Any amino acid
XLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQ

SEQ ID NO: 41773 - protein, 609 aa, Homo sapiens
  Payload ID: 8499
  Gene Symbol: ITSN2
  Gene Name: intersectin 2
  ENSP ID: ENSP00000391224
MMAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSRSWSSGSSAHSPATHRAPLSSPVPNSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKK

SEQ ID NO: 41774 - protein, 183 aa, Homo sapiens
  Payload ID: 8499
  Gene Symbol: ITSN2
  Gene Name: intersectin 2
  ENSP ID: ENSP00000391715
MWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMM

SEQ ID NO: 41775 - protein, 55 aa, Homo sapiens
  Payload ID: 8499
  Gene Symbol: ITSN2
  Gene Name: intersectin 2
  ENSP ID: ENSP00000395682
  MOD_RES (1)..(1): Any amino acid
XELHGFLFNDFLLLTYMVKQFAVSSGSEKLFSSKSNAQFKMYKTDRLGAEDQGGV

SEQ ID NO: 41776 - protein, 36 aa, Homo sapiens
  Payload ID: 8499
  Gene Symbol: ITSN2
  Gene Name: intersectin 2
  ENSP ID: ENSP00000411319
  MOD_RES (1)..(1): Any amino acid
XAWVQKIKAASEQYIDTEKKKREKAYQGFPHFVIYS

SEQ ID NO: 41777 - protein, 1680 aa, Homo sapiens
  Payload ID: 8499
  Gene Symbol: ITSN2
  Gene Name: intersectin 2
  ENSP ID: ENSP00000479408
MAESQGKLRTMMAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLEKEELCQRLKEQLDALEKETASKLSEMDSFNNQLKELRETYNTQQLALEQLYKIKRDKLKEIERKRLELMQKKKLEDEAARKAKQGKENLWKENLRKEEEEKQKRLQEEKTQEKIQEEERKAEEKQRKDKDTLKAEEKKRETASVLVNYRALYPFEARNHDEMSFNSGDIIQVDEKTVGEPGWLYGSFQGNFGWFPCNYVEKMPSSENEKAVSPKKALLPPTVSLSATSTSSEPLSSNQPASVTDYQNVSFSNLTVNTSWQKKSAFTRTVSPGSVSPIHGQGQVVENLKAQALCSWTAKKDNHLNFSKHDIITVLEQQENWWFGEVHGGRGWFPKSYVKIIPGSEVKREEPEALYAAVNKKPTSAAYSVGEEYIALYPYSSVEPGDLTFTEGEEILVTQKDGEWWTGSIGDRSGIFPSNYVKPKDQESFGSASKSGASNKKPEIAQVTSAYVASGSEQLSLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQWCADLQTLDTMQPIERKRQGYIHELIQTEERYMADLQLVVEVFQKRMAESGFLTEGEMALIFVNWKELIMSNTKLLKALRVRKKTGGEKMPVQMIGDILAAELSHMQAYIRFCSCQLNGAALLQQKTDEDTDFKEFLKKLASDPRCKGMPLSSFLLKPMQRITRYPLLIRSILENTPESHADHSSLKLALERAEELCSQVNEGVREKENSDRLEWIQAHVQCEGLAEQLIFNSLTNCLGPRKLLHSGKLYKTKSNKELHGFLFNDFLLLTYMVKQFAVSSGSEKLFSSKSNAQFKMYKTPIFLNEVLVKLPTDPSSDEPVFHISHIDRVYTLRTDNINERTAWVQKIKAASEQYIDTEKKKREKAYQARSQKTSGIGRLMVHVIEATELKACKPNGKSNPYCEISMGSQSYTTRTIQDTLNPKWNFNCQFFIKDLYQDVLCLTLFDRDQFSPDDFLGRTEIPVAKIRTEQESKGPMTRRLLLHEVPTGEVWVRFDLQLFEQKTLL

SEQ ID NO: 41778 - protein, 632 aa, Homo sapiens
  Payload ID: 8500
  Gene Symbol: ICK
  Gene Name: intestinal cell (MAK-like) kinase
  Uniprot ID: Q9UPZ9
  ENSP ID: ENSP00000263043
MNRYTTIRQLGDGTYGSVLLGRSIESGELIAIKKMKRKFYSWEECMNLREVKSLKKLNHANVVKLKEVIRENDHLYFIFEYMKENLYQLIKERNKLFPESAIRNIMYQILQGLAFIHKHGFFHRDLKPENLLCMGPELVKIADFGLAREIRSKPPYTDYVSTRWYRAPEVLLRSTNYSSPIDVWAVGCIMAEVYTLRPLFPGASEIDTIFKICQVLGTPKKTDWPEGYQLSSAMNFRWPQCVPNNLKTLIPNASSEAVQLLRDMLQWDPKKRPTASQALRYPYFQVGHPLGSTTQNLQDSEKPQKGILEKAGPPPYIKPVPPAQPPAKPHTRISSRQHQASQPPLHLTYPYKAEVSRTDHPSHLQEDKPSPLLFPSLHNKHPQSKITAGLEHKNGEIKPKSRRRWGLISRSTKDSDDWADLDDLDFSPSLSRIDLKNKKRQSDDTLCRFESVLDLKPSEPVGTGNSAPTQTSYQRRDTPTLRSAAKQHYLKHSRYLPGISIRNGILSNPGKEFIPPNPWSSSGLSGKSSGTMSVISKVNSVGSSSTSSSGLTGNYVPSFLKKEIGSAMQRVHLAPIPDPSPGYSSLKAMRPHPGRPFFHTQPRSTPGLIPRPPAAQPVHGRTDWASKYASRR

SEQ ID NO: 41779 - protein, 632 aa, Homo sapiens; identical to SEQ ID NO: 41778
  Payload ID: 8500
  Gene Symbol: ICK
  Gene Name: intestinal cell (MAK-like) kinase
  Uniprot ID: Q9UPZ9
  ENSP ID: ENSP00000349458

SEQ ID NO: 41780 - protein, 245 aa, Homo sapiens
  Payload ID: 8501
  Gene Symbol: ISX
  Gene Name: intestine-specific homeobox
  Uniprot ID: Q2M1V0
  ENSP ID: ENSP00000311492
MCAEVGPALCRGMERNSLGCCEAPKKLSLSFSIEAILKRPARRSDMDRPEGPGEEGPGEAAASGSGLEKPPKDQPQEGRKSKRRVRTTFTTEQLHELEKIFHFTHYPDVHIRSQLAARINLPEARVQIWFQNQRAKWRKQEKIGNLGAPQQLSEASVALPTNLDVAGPTWTSTALRRLAPPTSCCPSAQDQLASAWFPAWITLLPAHPWETQPVPGLPIHQTCIPVLCILPPPHPKWGSICATST

SEQ ID NO: 41781 - protein, 245 aa, Homo sapiens; identical to SEQ ID NO: 41780
  Payload ID: 8501
  Gene Symbol: ISX
  Gene Name: intestine-specific homeobox
  Uniprot ID: Q2M1V0
  ENSP ID: ENSP00000386037

SEQ ID NO: 41782 - protein, 582 aa, Homo sapiens
  Payload ID: 8502
  Gene Symbol: IPP
  Gene Name: intracisternal A particle-promoted polypeptide
  Uniprot ID: Q9Y573
  ENSP ID: ENSP00000353024
MANEDCPKAADSPFSSDKHAQLILAQINKMRNGQHFCDVQLQVGQESFKAHRLVLAASSPYFAALFTGGMKESSKDVVPILGIEAGIFQILLDFIYTGIVNIGVNNVQELIIAADMLQLTEVVHLCCEFLKGQIDPLNCIGIFQFSEQIACHDLLEFSENYIHVHFLEVHSGEEFLALTKDQLIKILRSEELSIEDEYQVFLAAMQWILKDLGKRRKHVVEVLDPIRFPLLPPQRLLKYIEGVSDFNLRVALQTLLKEYCEVCKSPKENKFCSFLQTSKVRPRKKARKYLYAVGGYTRLQGGRWSDSRALSCVERFDTFSQYWTTVSSLHQARSGLGVTVLGGMVYAIGGEKDSMIFDCTECYDPVTKQWTTVASMNHPRCGLGVCVCYGAIYALGGWVGAEIGNTIERFDPDENKWEVVGNMAVSRYYFGCCEMQGLIYVIGGISNEGIELRSFEVYDPLSKRWSPLPPMGTRRAYLGVAALNDCIYSVGGWNETQDALHTVEKYSFEEEKWVEVASMKVPRAGMCVVAVNGLLYVSGGRSSSHDFLAPDTHRYEVFRLKWENMCILFNDHKTLTKGIFNL

SEQ ID NO: 41783 - protein, 584 aa, Homo sapiens
  Payload ID: 8502
  Gene Symbol: IPP
  Gene Name: intracisternal A particle-promoted polypeptide
  Uniprot ID: Q9Y573
  ENSP ID: ENSP00000379739
MANEDCPKAADSPFSSDKHAQLILAQINKMRNGQHFCDVQLQVGQESFKAHRLVLAASSPYFAALFTGGMKESSKDVVPILGIEAGIFQILLDFIYTGIVNIGVNNVQELIIAADMLQLTEVVHLCCEFLKGQIDPLNCIGIFQFSEQIACHDLLEFSENYIHVHFLEVHSGEEFLALTKDQLIKILRSEELSIEDEYQVFLAAMQWILKDLGKRRKHVVEVLDPIRFPLLPPQRLLKYIEGVSDFNLRVALQTLLKEYCEVCKSPKENKFCSFLQTSKVRPRKKARKYLYAVGGYTRLQGGRWSDSRALSCVERFDTFSQYWTTVSSLHQARSGLGVTVLGGMVYAIGGEKDSMIFDCTECYDPVTKQWTTVASMNHPRCGLGVCVCYGAIYALGGWVGAEIGNTIERFDPDENKWEVVGNMAVSRYYFGCCEMQGLIYVIGGISNEGIELRSFEVYDPLSKRWSPLPPMGTRRAYLGVAALNDCIYSVGGWNETQDALHTVEKYSFEEEKWVEVASMKVPRAGMCVVAVNGLLYVSGGRSSSHDFLAPGTLDSVEVYNPHSDTWTEIGNMITSRCEGGVAVL

SEQ ID NO: 41784 - protein, 1292 aa, Homo sapiens
  Payload ID: 8503
  Gene Symbol: IFT122
  Gene Name: intraflagellar transport 122
  Uniprot ID: Q9HBG6
  ENSP ID: ENSP00000296266
MRAVLTWRDKAEHCINDIAFKPDGTQLILAAGSRLLVYDTSDGTLLQPLKGHKDTVYCVAYAKDGKRFASGSADKSVIIWTSKLEGILKYTSWSVMSSLHLHLPFLGLHKTVRVTATDKAPKGQGGRIDCLRPSVQNQPGQKHNDAIQCVSYNPITHQLASCSSSDFGLWSPEQKSVSKHKSSSKIICCSWTNDGQYLALGMFNGIISIRNKNGEEKVKIERPGGSLSPIWSICWNPSSRWESFWMNRENEDAEDVIVNRYIQEIPSTLKSAVYSSQGSEAEEEEPEEEDDSPRDDNLEERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQDPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 41785 - protein, 1182 aa, Homo sapiens
  Payload ID: 8503
  Gene Symbol: IFT122
  Gene Name: intraflagellar transport 122
  Uniprot ID: Q9HBG6
  ENSP ID: ENSP00000323973
MRAVLTWRDKAEHCINDIAFKPDGTQLILAAGSRLLVYDTSDGTLLQPLKGHKDTVYCVAYAKDGKRFASGSADKSVIIWTSKLEGILKYTHNDAIQCVSYNPITHQLASCSSSDFGLWSPEQKSVSKHKSSSKIICCSWTNDGQYLALGMFNGIISIRNKNGEEKVKIERPGGSLSPIWSICWNPSREERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQDPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 41786 - protein, 1241 aa, Homo sapiens
  Payload ID: 8503
  Gene Symbol: IFT122
  Gene Name: intraflagellar transport 122
  Uniprot ID: Q9HBG6
  ENSP ID: ENSP00000324005
MRAVLTWRDKAEHCINDIAFKPDGTQLILAAGSRLLVYDTSDGTLLQPLKGHKDTVYCVAYAKDGKRFASGSADKSVIIWTSKLEGILKYTHNDAIQCVSYNPITHQLASCSSSDFGLWSPEQKSVSKHKSSSKIICCSWTNDGQYLALGMFNGIISIRNKNGEEKVKIERPGGSLSPIWSICWNPSSRWESFWMNRENEDAEDVIVNRYIQEIPSTLKSAVYSSQGSEAEEEEPEEEDDSPRDDNLEERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQDPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 41787 - protein, 1131 aa, Homo sapiens
  Payload ID: 8503
  Gene Symbol: IFT122
  Gene Name: intraflagellar transport 122
  Uniprot ID: Q9HBG6
  ENSP ID: ENSP00000324165
MRAVLTWRDKAEHCINDIAFKPDGTQLILAAGSRLLVYDTSDGTLLQPLKGHKDTVYCVAYAKDGLWSPEQKSVSKHKSSSKIICCSWTNDGQYLALGMFNGIISIRNKNGEEKVKIERPGGSLSPIWSICWNPSREERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQADPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 41788 - protein, 1032 aa, Homo sapiens
  Payload ID: 8503
  Gene Symbol: IFT122
  Gene Name: intraflagellar transport 122
  Uniprot ID: Q9HBG6
  ENSP ID: ENSP00000401569
MFNGIISIRNKNGEEKVKIERPGGSLSPIWSICWNPSREERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQDPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 41789 - protein, 1091 aa, Homo sapiens
  Payload ID: 8503
  Gene Symbol: IFT122
  Gene Name: intraflagellar transport 122
  Uniprot ID: Q9HBG6
  ENSP ID: ENSP00000410946
MFNGIISIRNKNGEEKVKIERPGGSLSPIWSICWNPSSRWESFWMNRENEDAEDVIVNRYIQEIPSTLKSAVYSSQGSEAEEEEPEEEDDSPRDDNLEERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQDPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 41790 - protein, 110 aa, Homo sapiens
  Payload ID: 8503
  Gene Symbol: IFT122
  Gene Name: intraflagellar transport 122
  ENSP ID: ENSP00000421140
  MOD_RES (1)..(1): Any amino acid
XINDIAFKPDGTQLILAAGSRLLVYDTSDGTLLQPLKGHKDTVHNDAIQCVSYNPITHQLASCSSSDFGLWSPEQKSVSKHKSSSKIICCSWTNDGQYLALGMFNGIISI

SEQ ID NO: 41791 - protein, 80 aa, Homo sapiens
  Payload ID: 8503
  Gene Symbol: IFT122
  Gene Name: intraflagellar transport 122
  ENSP ID: ENSP00000421953
MRAVLTWRDKAEHCINDIAFKPDGTQLILAAGSRLLVYDTSDGTLLQPLKGHKDTVYCVAYAKDGNESSSVACLGHAAGQ

SEQ ID NO: 41792 - protein, 1118 aa, Homo sapiens
  Payload ID: 8503
  Gene Symbol: IFT122
  Gene Name: intraflagellar transport 122
  Uniprot ID: Q9HBG6
  ENSP ID: ENSP00000422179
MRAVLTWRDKAEHCINDIAFKPDGTQLILAAGSRLLVYDTSDGTLLQPLKGHKDTVYCVAYAKDVLCIEGLWSPEQKSVSKHKSSSKIICCSWTNDGQYLALGMFNGIISIRNKNGEEKVKIERPGGSLSPIWSICWNPSREERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQADPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 41793 - protein, 96 aa, Homo sapiens
  Payload ID: 8503
  Gene Symbol: IFT122
  Gene Name: intraflagellar transport 122
  ENSP ID: ENSP00000422237
MFNGIISIRNKNGEEKVKIERPGGSLSPIWSICWNPSREERNDILAVADWGQKVSFYQLSGKQIGKDRALNFDPCCISYFTKGEYILLGGSDKQVS

SEQ ID NO: 41794 - protein, 321 aa, Homo sapiens
  Payload ID: 8503
  Gene Symbol: IFT122
  Gene Name: intraflagellar transport 122
  ENSP ID: ENSP00000423288
  MOD_RES (1)..(1): Any amino acid
XINDIAFKPDGTQLILAAGSRLLVYDTSDGTLLQPLKGHKDTVYCVAYAKDGLWSPEQKSVSKHKSSSKIICCREERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKN

SEQ ID NO: 41795 - protein, 112 aa, Homo sapiens
  Payload ID: 8503
  Gene Symbol: IFT122
  Gene Name: intraflagellar transport 122
  ENSP ID: ENSP00000423902
  MOD_RES (1)..(1): Any amino acid
XINDIAFKPDGTQLILAAGSRLLVYDTSDGTLLQPLKGHKDTVYCVAYAKDGKRFASGSADKSVIIWTSKLEGILKYTVLLCCPGWSAVARSRLTASSTSQVHAILLPQPPE

SEQ ID NO: 41796 - protein, 99 aa, Homo sapiens
  Payload ID: 8503
  Gene Symbol: IFT122
  Gene Name: intraflagellar transport 122
  ENSP ID: ENSP00000423921
  MOD_RES (1)..(1): Any amino acid
XINDIAFKPDGTQLILAAGSRLLVYDTSDGTLLQPLKGHKDTVYCVAYAKDGTMMLYNVSPTILLLINWHLVPPVTLGCGLLNRSLSPNTNQAARSSAA

SEQ ID NO: 41797 - protein, 245 aa, Homo sapiens
  Payload ID: 8503
  Gene Symbol: IFT122
  Gene Name: intraflagellar transport 122
  ENSP ID: ENSP00000424206
  MOD_RES (1)..(1): Any amino acid
XINDIAFKPDGTQLILAAGSRLLVYDTSDGTLLQPLKGHKDTVYCVAYAKDGKRFASGSADKSVIIWTSKLEGILKYTHNDAIQCVSYNPITHQLASCSSSDFGLWSPEQKSVSKHKSSSKIICCREERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYR

SEQ ID NO: 41798 - protein, 380 aa, Homo sapiens
  Payload ID: 8503
  Gene Symbol: IFT122
  Gene Name: intraflagellar transport 122
  ENSP ID: ENSP00000424727
EGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQK

SEQ ID NO: 41799 - protein, 1234 aa, Homo sapiens
  Payload ID: 8503
  Gene Symbol: IFT122
  Gene Name: intraflagellar transport 122
  Uniprot ID: Q9HBG6
  ENSP ID: ENSP00000425536
MRAVLTWRDKAEHCINDIAFKPDGTQLILAAGSRLLVYDTSDGTLLQPLKGHKDTVYCVAYAKDGKRFASGSADKSVIIWTSKLEGILKYTSWSVMSSLHLHLPFLGLHKTVRVTATDKAPKGQGGRIDCLRPSVQNQPGQKHNDAIQCVSYNPITHQLASCSSSDFGLWSPEQKSVSKHKSSSKIICCSWTNDGQYLALGMFNGIISIRNKNGEEKVKIERPGGSLSPIWSICWNPSREERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQADPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 41800 - protein, 46 aa, Homo sapiens
  Payload ID: 8503
  Gene Symbol: IFT122
  Gene Name: intraflagellar transport 122
  ENSP ID: ENSP00000425540
  MOD_RES (1)..(1): Any amino acid
XINDIAFKPDGTQLILAAGSRLLASALLLDQLTKALLSGHQNWKAF

SEQ ID NO: 41801 - protein, 69 aa, Homo sapiens
  Payload ID: 8503
  Gene Symbol: IFT122
  Gene Name: intraflagellar transport 122
  ENSP ID: ENSP00000427027
  MOD_RES (1)..(1): Any amino acid
XINDIAFKPDGTQLILAAGSRLLVYDTSDGTLLQPLKGHKDTVYCVAYAKDVETGFHRVGQDGLDLLTS

SEQ ID NO: 41802 - protein, 67 aa, Homo sapiens
  Payload ID: 8503
  Gene Symbol: IFT122
  Gene Name: intraflagellar transport 122
  ENSP ID: ENSP00000427061
  MOD_RES (1)..(1): Any amino acid
XINDIAFKPDGTQLILAAGSRLLVYDTSDGTLLQPLKGHKDTVYCVAYAKDGNESSSVACLGHAAGQ

SEQ ID NO: 41803 - protein, 171 aa, Homo sapiens
  Payload ID: 8503
  Gene Symbol: IFT122
  Gene Name: intraflagellar transport 122
  ENSP ID: ENSP00000427515
MYQYLDRKLFKEAYQIACLGVTDTDWRELAMEALEGLDFETAKKERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLL

SEQ ID NO: 41804 - protein, 656 aa, Homo sapiens
  Payload ID: 8504
  Gene Symbol: IFT140
  Gene Name: intraflagellar transport 140
  Uniprot ID: Q96RY7
  ENSP ID: ENSP00000354895
MARMCVKTQRLDVAKVCLGNMGHARGARALREAEQEPELEARVAVLATQLGMLEDAEQLYRKCKRHDLLNKFYQAAGRWQEALQVAEHHDRVHLRSTYHRYAGHLEASADCSRALSYYEKSDTHRFEVPRMLSEDLPSLELYVNKMKDKTLWRWWAQYLESQGEMDAALHYYELARDHFSLVRIHCFQGNVQKAAQIANETGNLAASYHLARQYESQEEVGQAVHFYTRAQAFKNAIRLCKENGLDDQLMNLALLSSPEDMIEAARYYEEKGVQMDRAVMLYHKAGHFSKALELAFATQQFVALQLIAEDLDETSDPALLARCSDFFIEHSQYERAVELLLAARKYQEALQLCLGQNMSITEEMAEKMTVAKDSSDLPEESRRELLEQIADCCMRQGSYHLATKKYTQAGNKLKAMRALLKSGDTEKITFFASVSRQKEIYIMAANYLQSLDWRKEPEIMKNIIGFYTKGRALDLLAGFYDACAQVEIDEYQNYDKAHGALTEAYKCLAKAKAKSPLDQETRLAQLQSRMALVKRFIQARRTYTEDPKESIKQCELLLEEPDLDSTIRIGDVYGFLVEHYVRKEEYQTAYRFLEEMRRRLPLANMSYYVSPQAVDAVHRGLGLPLPRTVPEQVRHNSMEDARELDEEVVEEADDDP

SEQ ID NO: 41805 - protein, 206 aa, Homo sapiens
  Payload ID: 8504
  Gene Symbol: IFT140
  Gene Name: intraflagellar transport 140
  ENSP ID: ENSP00000380562
MALYYDHQIEAPDAAGSPSFISWHPVHPFLAVAYISTTSTGSVDIYLEQGECVPDTHVERPFRVASLCWHPTRLVLAVGWETGEVTVFNKQDKEQHTMPLTHTADITVLLGFQEEPAGSEQRHLRGHPQRAGHVVTLPPASGRHAGLPESAECVLPVHGGRTQPAHRHAHQWSVCHQGCCRSLERKAGGDLRAFWSRDTECRDLLV

SEQ ID NO: 41806 - protein, 1462 aa, Homo sapiens
  Payload ID: 8504
  Gene Symbol: IFT140
  Gene Name: intraflagellar transport 140
  Uniprot ID: Q96RY7
  ENSP ID: ENSP00000406012
MALYYDHQIEAPDAAGSPSFISWHPVHPFLAVAYISTTSTGSVDIYLEQGECVPDTHVERPFRVASLCWHPTRLVLAVGWETGEVTVFNKQDKEQHTMPLTHTADITVLRWSPSGNCLLSGDRLGVLLLWRLDQRGRVQGTPLLKHEYGKHLTHCIFRLPPPGEDLVQLAKAAVSGDEKALDMFNWKKSSSGSLLKMGSHEGLLFFVSLMDGTVHYVDEKGKTTQVVSADSTIQMLFYMEKREALVVVTENLRLSLYTVPPEGKAEEVMKVKLSGKTGRRADIALIEGSLLVMAVGEAALRFWDIERGENYILSPDEKFGFEKGENMNCVCYCKVKGLLAAGTDRGRVAMWRKVPDFLGSPGAEGKDRWALQTPTELQGNITQIQWGSRKNLLAVNSVISVAILSERAMSSHFHQQVAAMQVSPSLLNVCFLSTGVAHSLRTDMHISGVFATKDAVAVWNGRQVAIFELSGAAIRSAGTFLCETPVLAMHEENVYTVESNRVQVRTWQGTVKQLLLFSETEGNPCFLDICGNFLVVGTDLAHFKSFDLSRREAKAHCSCRSLAELVPGVGGIASLRCSSSGSTISILPSKADNSPDSKICFYDVEMDTVTVFDFKTGQIDRRETLSFNEQETNKSHLFVDEGLKNYVPVNHFWDQSEPRLFVCEAVQETPRSQPQSANGQPQDGRAGPAADVLILSFFISEEHGFLLHESFPRPATSHSLLGMEVPYYYFTRKPEEADREDEVEPGCHHIPQMVSRRPLRDFVGLEDCDKATRDAMLHFSFFVTIGDMDEAFKSIKLIKSEAVWENMARMCVKTQRLDVAKVCLGNMGHARGARALREAEQEPELEARVAVLATQLGMLEDAEQLYRKCKRHDLLNKFYQAAGRWQEALQVAEHHDRVHLRSTYHRYAGHLEASADCSRALSYYEKSDTHRFEVPRMLSEDLPSLELYVNKMKDKTLWRWWAQYLESQGEMDAALHYYELARDHFSLVRIHCFQGNVQKAAQIANETGNLAASYHLARQYESQEEVGQAVHFYTRAQAFKNAIRLCKENGLDDQLMNLALLSSPEDMIEAARYYEEKGVQMDRAVMLYHKAGHFSKALELAFATQQFVALQLIAEDLDETSDPALLARCSDFFIEHSQYERAVELLLAARKYQEALQLCLGQNMSITEEMAEKMTVAKDSSDLPEESRRELLEQIADCCMRQGSYHLATKKYTQAGNKLKAMRALLKSGDTEKITFFASVSRQKEIYIMAANYLQSLDWRKEPEIMKNIIGFYTKGRALDLLAGFYDACAQVEIDEYQNYDKAHGALTEAYKCLAKAKAKSPLDQETRLAQLQSRMALVKRFIQARRTYTEDPKESIKQCELLLEEPDLDSTIRIGDVYGFLVEHYVRKEEYQTAYRFLEEMRRRLPLANMSYYVSPQAVDAVHRGLGLPLPRTVPEQVRHNSMEDARELDEEVVEEADDDP

SEQ ID NO: 41807 - protein, 120 aa, Homo sapiens
  Payload ID: 8504
  Gene Symbol: IFT140
  Gene Name: intraflagellar transport 140
  ENSP ID: ENSP00000454781
MALYYDHQIEAPDAAGSPSFISWHPVHPFLAVAYISTTSTGSVDIYLEQGECVPDTHVERPFRVASLCWHPTRLVLAVGWETGEVTVFNKQDKEQHTMPLTHTADITVLRWSPSGNCLLS

SEQ ID NO: 41808 - protein, 113 aa, Homo sapiens
  Payload ID: 8504
  Gene Symbol: IFT140
  Gene Name: intraflagellar transport 140
  ENSP ID: ENSP00000457092
MALYYDHQIEAPDAAGSPSFISWHPVHPFLAVAYISTTSTGSVDIYLEQGECVPDTHVERPFRVASLCWHPTRLVLAVGWETGEVTVFNKQDKEQHTMPLTHTADITVLRWSP

SEQ ID NO: 41809 - protein, 125 aa, Homo sapiens
  Payload ID: 8504
  Gene Symbol: IFT140
  Gene Name: intraflagellar transport 140
  ENSP ID: ENSP00000458439
DEYQNYDKAHGALTEAYKCLAKAKAKSPLDQETRLAQLQSRMALVKRFIQARRTYTEDPKESIKQCELLLEEPDLDSTIRIGDVYGFLVEHYVRKEEYQTVRPECCSLAASRHTRLLKRRLNGSN

SEQ ID NO: 41810 - protein, 1749 aa, Homo sapiens
  Payload ID: 8505
  Gene Symbol: IFT172
  Gene Name: intraflagellar transport 172
  Uniprot ID: Q9UG01
  ENSP ID: ENSP00000260570
MHLKHLRTLLSPQDGAAKVTCMAWSQNNAKFAVCTVDRVVLLYDEHGERRDKFSTKPADMKYGRKSYMVKGMAFSPDSTKIAIGQTDNIIYVYKIGEDWGDKKVICNKFIQTSAVTCLQWPAEYIIVFGLAEGKVRLANTKTNKSSTIYGTESYVVSLTTNCSGKGILSGHADGTIVRYFFDDEGSGESQGKLVNHPCPPYALAWATNSIVAAGCDRKIVAYGKEGHMLQTFDYSRDPQEREFTTAVSSPGGQSVVLGSYDRLRVFNWIPRRSIWEEAKPKEITNLYTITALAWKRDGSRLCVGTLCGGVEQFDCCLRRSIYKNKFELTYVGPSQVIVKNLSSGTRVVLKSHYGYEVEEVKILGKERYLVAHTSETLLLGDLNTNRLSEIAWQGSGGNEKYFFENENVCMIFNAGELTLVEYGNNDTLGSVRTEFMNPHLISVRINERCQRGTEDNKKLAYLIDIKTIAIVDLIGGYNIGTVSHESRVDWLELNETGHKLLFRDRKLRLHLYDIESCSKTMILNFCSYMQWVPGSDVLVAQNRNSLCVWYNIEAPERVTMFTIRGDVIGLERGGGKTEVMVMEGVTTVAYTLDEGLIEFGTAIDDGNYIRATAFLETLEMTPETEAMWKTLSKLALEARQLHIAERCFSALGQVAKARFLHETNEIADQVSREYGGEGTDFYQVRARLAMLEKNYKLAEMIFLEQNAVEEAMGMYQELHRWDECIAVAEAKGHPALEKLRRSYYQWLMDTQQEERAGELQESQGDGLAAISLYLKAGLPAKAARLVLTREELLANTELVEHITAALIKGELYERAGDLFEKIHNPQKALECYRKGNAFMKAVELARLAFPVEVVKLEEAWGDHLVQQKQLDAAINHYIEARCSIKAIEAALGARQWKKAIYILDLQDRNTASKYYPLVAQHYASLQEYEIAEELYTKGDRTKDAIDMYTQAGRWEQAHKLAMKCMRPEDVSVLYITQAQEMEKQGKYREAERLYVTVQEPDLAITMYKKHKLYDDMIRLVGKHHPDLLSDTHLHLGKELEAEGRLQEAEYHYLEAQEWKATVNMYRASGLWEEAYRVARTQGGANAHKHVAYLWAKSLGGEAAVRLLNKLGLLEAAVDHAADNCSFEFAFELSRLALKHKTPEVHLKYAMFLEDEGKFEEAEAEFIRAGKPKEAVLMFVHNQDWEAAQRVAEAHDPDSVAEVLVGQARGALEEKDFQKAEGLLLRAQRPGLALNYYKEAGLWSDALRICKDYVPSQLEALQEEYEREATKKGARGVEGFVEQARHWEQAGEYSRAVDCYLKVRDSGNSGLAEKCWMKAAELSIKFLPPQRNMEVVLAVGPQLIGIGKHSAAAELYLNLDLVKEAIDAFIEGEEWNKAKRVAKELDPRYEDYVDQHYKEFLKNQGKVDSLVGVDVIAALDLYVEQGQWDKCIETATKQNYKILHKYVALYATHLIREGSSAQALALYVQHGAPANPQNFNIYKRIFTDMVSSPGTNCAEAYHSWADLRDVLFNLCENLVKSSEANSPAHEEFKTMLLIAHYYATRSAAQSVKQLETVAARLSVSLLRHTQLLPVDKAFYEAGIAAKAVGWDNMAFIFLNRFLDLTDAIEEGTLDGLDHSDFQDTDIPFEVPLPAKQHVPEAEREEVRDWVLTVSMDQRLEQVLPRDERGAYEASLVAASTGVRALPCLITGYPILRNKIEFKRPGKAANKDNWNKFLMAIKTSHSPVCQDVLKFISQWCGGLPSTSFSFQ

SEQ ID NO: 41811 - protein, 532 aa, Homo sapiens
  Payload ID: 8505
  Gene Symbol: IFT172
  Gene Name: intraflagellar transport 172
  Uniprot ID: Q9UG01
  ENSP ID: ENSP00000352443
MHLKHLRTLLSPQDGAAKVTCMAWSQNNAKFAVCTVDRVVLLYDEHGERRDKFSTKPADMKYGRKSYMVKGMAFSPDSTKIAIGQTDNIIYVYKIGEDWGDKKVICNKFIQTSAVTCLQWPAEYIIVFGLAEGKVRLANTKTNKSSTIYGTESYVVSLTTNCSGKGILSGHADGTIVRYFFDDEGSGESQGKLVNHPCPPYALAWATNSIVAAGCDRKIVAYGKEGHMLQTFDYSRDPQEREFTTAVSSPGGQSVVLGSYDRLRVFNWIPRRSIWEEAKPKEITNLYTITALAWKRDGSRLCVGTLCGGVEQFDCCLRRSIYKNKFELTYVGPSQVIVKNLSSGTRVVLKSHYGYEVEEVKILGKERYLVAHTSETLLLGDLNTNRLSEIAWQGSGGNEKYFFENENVCMIFNAGELTLVEYGNNDTLGSVRTEFMNPHLISVRINERCQRGTEDNKKLAYLIDIKTIAIVDLIGGYNIGTVSHESRVDWLELNETGHKLLFRDRKLRVRRATKALGIGWPTEGVRQAATRD

SEQ ID NO: 41812 - protein, 162 aa, Homo sapiens
  Payload ID: 8505
  Gene Symbol: IFT172
  Gene Name: intraflagellar transport 172
  ENSP ID: ENSP00000398633
NFNIYKRIFTDMVSSPGTNCAEAYHSWADLRDVLFNLCENLVKSSEANSPAHEEFKTMLLIAHYYATRSAAQSVKQLETVAARLSVSLLRHTQLLPVDKAFYEAGIAAKAVGWDNMAFIFLNRFLDLTDAIEEGTLDGLDHSDFQDTDIPFEVPLPAKQHVP

SEQ ID NO: 41813 - protein, 96 aa, Homo sapiens
  Payload ID: 8505
  Gene Symbol: IFT172
  Gene Name: intraflagellar transport 172
  ENSP ID: ENSP00000399017
AQRVAEAHDPDSVAEVLVGQARGALEEKDFQKAEGLLLRAQRPGLALNYYKGCGGICGTSSTLGAGWRVQPCRGLLPQSARLWKQRPGGEVLDEGS

SEQ ID NO: 41814 - protein, 196 aa, Homo sapiens
  Payload ID: 8505
  Gene Symbol: IFT172
  Gene Name: intraflagellar transport 172
  ENSP ID: ENSP00000404082
  MOD_RES (1)..(1): Any amino acid
XSRLALKHKTPEVHLKYAMFLEDEGKFEEAEAEFIRAGKPKEAVLMFVHNQDWEAAQRVAEAHDPDSVAEVLVGQARGALEEKDFQKAEGLLLRAQRPGLALNYYKEAGLWSDALRICKDYVPSQLEALQEEYEREATKKGARGVEGFVEQARHWEQAGEYSRAVDCYLKVRDSGNSGLAEKCWMKVAGIYGVPAG

SEQ ID NO: 41815 - protein, 511 aa, Homo sapiens
  Payload ID: 8505
  Gene Symbol: IFT172
  Gene Name: intraflagellar transport 172
  ENSP ID: ENSP00000407408
MAWSQNNAKFAVCTVDRVVLLYDEHGERRDKFSTKPADMKYGRKSYMVKGMAFSPDSTKIAIGQTDNIIYVYKIGEDWGDKKVICNKFIQTSAVTCLQWPAEYIIVFGLAEGKVRLANTKTNKSSTIYGTESYVVSLTTNCSGKGILSGHADGTIVRYFFDDEGSGESQGKLVNHPCPPYALAWATNSIVAAGCDRKIVAYGKEGHMLQTFDYSRDPQEREFTTAVSSPGGQSVVLGSYDRLRVFNWIPRRSIWEEAKPKEITNLYTITALAWKRDGSRLCVGTLCGGVEQFDCCLRRSIYKNKFELTYVGPSQVIVKNLSSGTRVVLKSHYGYEVEEVKILGKERYLVAHTSETLLLGDLNTNRLSEIAWQGSGGNEKYFFENENVCMIFNAGELTLVEYGNNDTLGSVRTEFMNPHLISVRINERCQRGTEDNKKLAYLIDIKTIAIVDLIGGYNIGTVSHESRVDWLELNETGHKLLFRDRKLRVRRATKALGIGWPTEGVRQAATRD

SEQ ID NO: 41816 - protein, 324 aa, Homo sapiens
  Payload ID: 8505
  Gene Symbol: IFT172
  Gene Name: intraflagellar transport 172
  ENSP ID: ENSP00000427255
  MOD_RES (1)..(1): Any amino acid
XLVGQARGALEEKDFQKAEGLLLRAQRPGLALNYYKEAGLWSDALRICKDYVPSQLEALQEEYEREATKKGARGVEGFVEQARHWEQAGEYSRAVDCYLKVRDSGNSGLAEKCWMKAAELSIKFLPPQRNMEVVLAVGPQLIGIGKHSAAAELYLNLDLVKEAIDAFIEGEEWNKAKRVAKELDPRYEDYVDQHYKEFLKNQGKVDSLVGVDVIAALDLYVEQGQWDKCIETATKQNYKILHKYVALYATHLIREGSSAQALALYVQHGAPANPQNFNIYKRIFTDMVSSPGTNCAEAYHSWADLRDVLFNLAVLSPSSSVKTW

SEQ ID NO: 41817 - protein, 148 aa, Homo sapiens
  Payload ID: 8506
  Gene Symbol: IFT20
  Gene Name: intraflagellar transport 20
  Uniprot ID: Q8IY31
  ENSP ID: ENSP00000350570
MAKDILGEAGLHFDELNKLRVLDPEVTQQTIELKEECKDFVDKIGQFQKIVGGLIELVDQLAKEAENEKMKSLAVSPRLECTGAISAHCKLCLSDSSDSPTSPSRVGGTTGHRCSELAQIYSKAERSSTAATSSPNSRKENAARKVSG

SEQ ID NO: 41818 - protein, 132 aa, Homo sapiens
  Payload ID: 8506
  Gene Symbol: IFT20
  Gene Name: intraflagellar transport 20
  Uniprot ID: Q8IY31
  ENSP ID: ENSP00000378809
MAKDILGEAGLHFDELNKLRVLDPEVTQQTIELKEECKDFVDKIGQFQKIVGGLIELVDQLAKEAENEKMKAIGARNLLKSIAKQREAQQQQLQALIAEKKMQLERYRVEYEALCKVEAEQNEFIDQFIFQK

SEQ ID NO: 41819 - protein, 85 aa, Homo sapiens
  Payload ID: 8506
  Gene Symbol: IFT20
  Gene Name: intraflagellar transport 20
  ENSP ID: ENSP00000462163
MTHLLLTATVTPSEQNSSREPGWETAMAKDILGEAGLHFDELNKLRVLDPEVTQQTIELKEECKDFVDKIGQFQKIVGGLIELVD

SEQ ID NO: 41820 - protein, 132 aa, Homo sapiens; identical to SEQ ID NO: 41818
  Payload ID: 8506
  Gene Symbol: IFT20
  Gene Name: intraflagellar transport 20
  Uniprot ID: Q8IY31
  ENSP ID: ENSP00000463138

SEQ ID NO: 41821 - protein, 114 aa, Homo sapiens
  Payload ID: 8506
  Gene Symbol: IFT20
  Gene Name: intraflagellar transport 20
  Uniprot ID: Q8IY31
  ENSP ID: ENSP00000463322
MAKDILGEAGLHFDELNKLRVLDPEVTQQTIELKEECKDFVDKIGQFQKIVGGLIELVDQLAKEAENEKMKAIGARNLLKSIAKQREAQQQQLQALIAEKKMQLERNELKISLL

SEQ ID NO: 41822 - protein, 132 aa, Homo sapiens
  Payload ID: 8506
  Gene Symbol: IFT20
  Gene Name: intraflagellar transport 20
  ENSP ID: ENSP00000464033
MTHLLLTATVTPSEQNSSREPGWETAMAKDILGEAGLHFDELNKLRVLDPEVTQQTIELKEECKDFVDKIGQFQKIVGGLIELVDQLAKEAENEKMKAIGARNLLKSIAKQREAQQQQLQALIAEKKMQLER

SEQ ID NO: 41823 - protein, 141 aa, Homo sapiens
  Payload ID: 8506
  Gene Symbol: IFT20
  Gene Name: intraflagellar transport 20
  ENSP ID: ENSP00000464147
MTHLLLTATVTPSEQNSSREPGWETAMAKDILGEAGLHFDELNKLRVLDPEVTQQTIELKEECKDFVDKIGQFQKIVGGLIELVDQLAKEAENEKMKAIGARNLLKSIAKQREAQQQQLQALIAEKKMQLERNSISLVILI

SEQ ID NO: 41824 - protein, 71 aa, Homo sapiens
  Payload ID: 8506
  Gene Symbol: IFT20
  Gene Name: intraflagellar transport 20
  ENSP ID: ENSP00000464210
DILGEAGLHFDELNKLRVLDPEVTQQTIELKEECKDFVDKIGQFQKIVGGLIELVDQLAKEAENEKMKVSG

SEQ ID NO: 41825 - protein, 158 aa, Homo sapiens
  Payload ID: 8506
  Gene Symbol: IFT20
  Gene Name: intraflagellar transport 20
  Uniprot ID: Q8IY31
  ENSP ID: ENSP00000464443
MTHLLLTATVTPSEQNSSREPGWETAMAKDILGEAGLHFDELNKLRVLDPEVTQQTIELKEECKDFVDKIGQFQKIVGGLIELVDQLAKEAENEKMKAIGARNLLKSIAKQREAQQQQLQALIAEKKMQLERYRVEYEALCKVEAEQNEFIDQFIFQK

SEQ ID NO: 41826 - protein, 74 aa, Homo sapiens
  Payload ID: 8506
  Gene Symbol: IFT20
  Gene Name: intraflagellar transport 20
  ENSP ID: ENSP00000484842
MAKDILGEAGLHFDELNKLRVLDPEVTQQTIELKEECKDFVDKIGQFQKIVGGLIELVDQLAKEAENEKMKVSG

SEQ ID NO: 41827 - protein, 185 aa, Homo sapiens
  Payload ID: 8507
  Gene Symbol: IFT22
  Gene Name: intraflagellar transport 22
  Uniprot ID: Q9H7X7
  ENSP ID: ENSP00000320359
MLKAKILFVGPCESGKTVLANFLTESSDITEYSPTQGVRILEFENPHVTSNNKGTGCEFELWDCGGDAKFESCWPALMKDAHGVVIVFNADIPSHRKEMEMWYSCFVQQPSLQDTQCMLIAHHKPGSGDDKGSLSLSPPLNKLKLVHSNLEDDPEEIRMEFIKYLKSIINSMSESRDREEMSIMT

SEQ ID NO: 41828 - protein, 37 aa, Homo sapiens
  Payload ID: 8507
  Gene Symbol: IFT22
  Gene Name: intraflagellar transport 22
  ENSP ID: ENSP00000389170
MLKAKILFVGPCEQRPLFALIFTEWKNCFGQLSDRIF

SEQ ID NO: 41829 - protein, 155 aa, Homo sapiens
  Payload ID: 8507
  Gene Symbol: IFT22
  Gene Name: intraflagellar transport 22
  Uniprot ID: Q9H7X7
  ENSP ID: ENSP00000390770
MLKAKILFVGPCESGKTVLANFLTESSDITEYSPTQGVRFESCWPALMKDAHGVVIVFNADIPSHRKEMEMWYSCFVQQPSLQDTQCMLIAHHKPGSGDDKGSLSLSPPLNKLKLVHSNLEDDPEEIRMEFIKYLKSIINSMSESRDREEMSIMT

SEQ ID NO: 41830 - protein, 185 aa, Homo sapiens; identical to SEQ ID NO: 41827
  Payload ID: 8507
  Gene Symbol: IFT22
  Gene Name: intraflagellar transport 22
  Uniprot ID: Q9H7X7
  ENSP ID: ENSP00000392087

SEQ ID NO: 41831 - protein, 108 aa, Homo sapiens
  Payload ID: 8507
  Gene Symbol: IFT22
  Gene Name: intraflagellar transport 22
  Uniprot ID: Q9H7X7
  ENSP ID: ENSP00000429202
MKDAHGVVIVFNADIPSHRKEMEMWYSCFVQQPSLQDTQCMLIAHHKPGSGDDKGSLSLSPPLNKLKLVHSNLEDDPEEIRMEFIKYLKSIINSMSESRDREEMSIMT

SEQ ID NO: 41832 - protein, 108 aa, Homo sapiens; identical to SEQ ID NO: 41831
  Payload ID: 8507
  Gene Symbol: IFT22
  Gene Name: intraflagellar transport 22
  Uniprot ID: Q9H7X7
  ENSP ID: ENSP00000429648

SEQ ID NO: 41833 - protein, 108 aa, Homo sapiens; identical to SEQ ID NO: 41831
  Payload ID: 8507
  Gene Symbol: IFT22
  Gene Name: intraflagellar transport 22
  Uniprot ID: Q9H7X7
  ENSP ID: ENSP00000478948

SEQ ID NO: 41834 - protein, 185 aa, Homo sapiens
  Payload ID: 8508
  Gene Symbol: IFT27
  Gene Name: intraflagellar transport 27
  Uniprot ID: Q9BW83
  ENSP ID: ENSP00000343593
MVKLAAKCILADPAVGKTALAQIFRSDGAHFQKSYTLTTGMDLVVKTVPVPDTGDSVELFIFDSAGKELFSEMLDKLWESPNVLCLVYDVTNEESFNNCSKWLEKARSQAPGISLPGVLVGNKTDLAGRRAVDSAEARAWALGQGLECFETSVKEMENFEAPFHCLAKQFHQLYREKVEVFRALA

SEQ ID NO: 41835 - protein, 116 aa, Homo sapiens
  Payload ID: 8508
  Gene Symbol: IFT27
  Gene Name: intraflagellar transport 27
  ENSP ID: ENSP00000390016
MVKLAAKCILADPAVGKTALAQIFRSDGAHFQKSYTLTTGMDLVVKTVPVPDTGDSVELFIFDSAGKELFSEMLDKLWESPNVLCLVYDVTNEESFNNCSKWLEKARSQAPGISLP

SEQ ID NO: 41836 - protein, 183 aa, Homo sapiens
  Payload ID: 8508
  Gene Symbol: IFT27
  Gene Name: intraflagellar transport 27
  ENSP ID: ENSP00000392016
MVKLAAKCILAVPVDKRLSRAEVCSGCCEVCRSVSWTCALPAASEQVPVRGDPAVGKTALAQIFRSDGAHFQKSYTLTTGMDLVVKTVPVPDTGDSVELFIFDSAGKELFSEMLDKLWESPNVLCLVYDVTNEESFNNCSKWLEKARSQAPGISLPGVLVGNKTDLAGRRAVDSAEARAWALG

SEQ ID NO: 41837 - protein, 186 aa, Homo sapiens
  Payload ID: 8508
  Gene Symbol: IFT27
  Gene Name: intraflagellar transport 27
  Uniprot ID: Q9BW83
  ENSP ID: ENSP00000393541
MVKLAAKCILAGDPAVGKTALAQIFRSDGAHFQKSYTLTTGMDLVVKTVPVPDTGDSVELFIFDSAGKELFSEMLDKLWESPNVLCLVYDVTNEESFNNCSKWLEKARSQAPGISLPGVLVGNKTDLAGRRAVDSAEARAWALGQGLECFETSVKEMENFEAPFHCLAKQFHQLYREKVEVFRALA

SEQ ID NO: 41838 - protein, 50 aa, Homo sapiens
  Payload ID: 8508
  Gene Symbol: IFT27
  Gene Name: intraflagellar transport 27
  ENSP ID: ENSP00000399606
MDLVVKTVPVPDTGDSVELFIFDSAGKELFSEMLDKLWESPNVLCLVYDV

SEQ ID NO: 41839 - protein, 129 aa, Homo sapiens
  Payload ID: 8508
  Gene Symbol: IFT27
  Gene Name: intraflagellar transport 27
  ENSP ID: ENSP00000404556
  MOD_RES (1)..(1): Any amino acid
XSDGAHFQKSYTLTTGMDLVVKTVPVPDTGDSVELFIFDSAGKELFSEMLDKLWESPNVLCLVYDVTNEESFNNCSKWLEKARSQAPGISLPGVLVGNKTDLAGRRAVDSAEARAWALGQGLECFETSV

SEQ ID NO: 41840 - protein, 213 aa, Homo sapiens
  Payload ID: 8509
  Gene Symbol: IFT43
  Gene Name: intraflagellar transport 43
  Uniprot ID: Q96FT9
  ENSP ID: ENSP00000238628
MEDLLDLDEELRYSLATSRAKMGRRAQQESAQAENHLNGKNSSLTLTGETSSAKLPRCRQGGWAGDSVKASNGTQTGKQQLDLNACYHKTHHRDLGLASLEEADIPIIPDLEEVQEEDFVLQVAAPPSIQIKRVMTYRDLDNDLMKYSAIQTLDGEIDLKLLTKVLAPEHEVREDDVGWDWDHLFTEVSSEVLTEWDPLQTEKEDPAGQARHT

SEQ ID NO: 41841 - protein, 208 aa, Homo sapiens
  Payload ID: 8509
  Gene Symbol: IFT43
  Gene Name: intraflagellar transport 43
  Uniprot ID: Q96FT9
  ENSP ID: ENSP00000324177
MEDLLDLDEELRYSLATSRAKMGRRAQQESAQAENHLNGKNSSLTLTGETSSAKLPRCRQGGWAGDSVKASKFRRKASEEIEDFRLRPQSLNGSDYGGDIPIIPDLEEVQEEDFVLQVAAPPSIQIKRVMTYRDLDNDLMKYSAIQTLDGEIDLKLLTKVLAPEHEVREDDVGWDWDHLFTEVSSEVLTEWDPLQTEKEDPAGQARHT

SEQ ID NO: 41842 - protein, 208 aa, Homo sapiens; identical to SEQ ID NO: 41841
  Payload ID: 8509
  Gene Symbol: IFT43
  Gene Name: intraflagellar transport 43
  Uniprot ID: Q96FT9
  ENSP ID: ENSP00000440064

SEQ ID NO: 41843 - protein, 113 aa, Homo sapiens
  Payload ID: 8509
  Gene Symbol: IFT43
  Gene Name: intraflagellar transport 43
  Uniprot ID: Q96FT9
  ENSP ID: ENSP00000451096
MEDLLDLDEELRYSLATSRAKMGRRAQQESAQAENHLNGKNSSLTLTGETSSAKLPRCRQGGWAGDSVKASKFRRKASEEIEEYVSSILILMVSYVDLGQQCSLGGHDLFHLC

SEQ ID NO: 41844 - protein, 32 aa, Homo sapiens
  Payload ID: 8509
  Gene Symbol: IFT43
  Gene Name: intraflagellar transport 43
  ENSP ID: ENSP00000452051
MEDLLDLDEELRYSLATSSPECELPQNRSITG

SEQ ID NO: 41845 - protein, 355 aa, Homo sapiens
  Payload ID: 8510
  Gene Symbol: IFT46
  Gene Name: intraflagellar transport 46
  Uniprot ID: Q9NQC8
  ENSP ID: ENSP00000264020
MADNSSDECEEENNKVLREGMPQAPGHRGKDMDPVPPAPASLKCHQTPSHVLERVGWYRESQKHRKEKKKTSQLTPQRGFSENEDDDDDDDDSSETDSDSDDDDEEHGAPLEGAYDPADYEHLPVSAEIKELFQYISRYTPQLIDLDHKLKPFIPDFIPAVGDIDAFLKVPRPDGKPDNLGLLVLDEPSTKQSDPTVLSLWLTENSKQHNITQHMKVKSLEDAEKNPKAIDTWIESISELHRSKPPATVHYTRPMPDIDTLMQEWSPEFEELLGKVSLPTAEIDCSLAEYIDMICAILDIPVYKSRIQSLHLLFSLYSEFKNSQHFKALAEGKKAFTPSSNSTSQAGDMETLTFS

SEQ ID NO: 41846 - protein, 304 aa, Homo sapiens
  Payload ID: 8510
  Gene Symbol: IFT46
  Gene Name: intraflagellar transport 46
  Uniprot ID: Q9NQC8
  ENSP ID: ENSP00000264021
MADNSSDECEEENNKEKKKTSQLTPQRGFSENEDDDDDDDDSSETDSDSDDDDEEHGAPLEGAYDPADYEHLPVSAEIKELFQYISRYTPQLIDLDHKLKPFIPDFIPAVGDIDAFLKVPRPDGKPDNLGLLVLDEPSTKQSDPTVLSLWLTENSKQHNITQHMKVKSLEDAEKNPKAIDTWIESISELHRSKPPATVHYTRPMPDIDTLMQEWSPEFEELLGKVSLPTAEIDCSLAEYIDMICAILDIPVYKSRIQSLHLLFSLYSEFKNSQHFKALAEGKKAFTPSSNSTSQAGDMETLTFS

SEQ ID NO: 41847 - protein, 297 aa, Homo sapiens
  Payload ID: 8510
  Gene Symbol: IFT46
  Gene Name: intraflagellar transport 46
  ENSP ID: ENSP00000432384
MADNSSDECEEENNKVLREGMPQAPGHRGKDMDPVPPAPASLKCHQTPSHVLERVGWYRESQKHRKEKKKTSQLTPQRGFSENEDDDDDDDDSSETDSDSDDDDEEHGAPLEGAYDPADYEHLPVSAEIKELFQYISRYTPQLIDLDHKLKPFIPDFIPAVGDIDAFLKVPRPDGKPDNLGLLVLDEPSTKQSDPTVLSLWLTENSKQHNITQHMKVKSLEDAEKNPKAIDTWIESISELHRSKPPATVHYTRPMPDIDTLMQEWSPEFEELLGKVSLPTAEIDCSLAEYIDMICAF

SEQ ID NO: 41848 - protein, 159 aa, Homo sapiens
  Payload ID: 8510
  Gene Symbol: IFT46
  Gene Name: intraflagellar transport 46
  ENSP ID: ENSP00000432982
MADNSSDECEEENNKVLREGMPQAPGHRGKDMDPVPPAPASLKCHQTPSHVLERVGWYRESQKHRKEKKKTSQLTPQRGFSENEDDDDDDDDSSETDSDSDDDDEEHGAPLEGAYDPADYEHLPVSAEIKELFQYISRYTPQLIDLDHKLKPFIPDFIP

SEQ ID NO: 41849 - protein, 194 aa, Homo sapiens
  Payload ID: 8510
  Gene Symbol: IFT46
  Gene Name: intraflagellar transport 46
  ENSP ID: ENSP00000434175
MADNSSDECEEENNKEKKKTSQLTPQRGFSENEDDDDDDDDSSETDSDSDDDDEEHGAPLEGAYDPADYEHLPVSAEIKELFQYISRYTPQLIDLDHKLKPFIPDFIPAVGDIDAFLKVPRPDGKPDNLGLLVLDEPSTKQSDPTVLSLWLTENSKQHNITQHMKVKSLEDAEKNPKAIDTWIESISELHRSKP

SEQ ID NO: 41850 - protein, 107 aa, Homo sapiens
  Payload ID: 8510
  Gene Symbol: IFT46
  Gene Name: intraflagellar transport 46
  ENSP ID: ENSP00000435278
MADNSSDECEEENNKEKKKTSQLTPQRGFSENEDDDDDDDDSSETDSDSDDDDEEHGAPLEGAYDPADYEHLPVSAEIKELFQYISRYTPQLIDLDHKLKPFIPDFI

SEQ ID NO: 41851 - protein, 61 aa, Homo sapiens
  Payload ID: 8510
  Gene Symbol: IFT46
  Gene Name: intraflagellar transport 46
  ENSP ID: ENSP00000435750
MADNSSDECEEENNKEKKKTSQLTPQRGFSENEDDDDDDDDSSETDSDSDDDDEEHGAPLE

SEQ ID NO: 41852 - protein, 196 aa, Homo sapiens
  Payload ID: 8510
  Gene Symbol: IFT46
  Gene Name: intraflagellar transport 46
  ENSP ID: ENSP00000435826
MADNSSDECEEENNKEKKKTSQLTPQRGFSENEDDDDDDDDSSETDSDSDDDDEEHGAPLEGAYDPADYEHLPVSAEIKELFQYISRYTPQLIDLDHKLKPFIPDFIPAVGDIDAFLKVPRPDGKPDNLGLLVLDEPSTKQSDPTVLSLWLTENSKQHNITQHMKVKSLEDAEKNPKAIDTWIESISELHRSKPPA

SEQ ID NO: 41853 - protein, 437 aa, Homo sapiens
  Payload ID: 8511
  Gene Symbol: IFT52
  Gene Name: intraflagellar transport 52
  Uniprot ID: Q9Y366
  ENSP ID: ENSP00000362121
MEKELRSTILFNAYKKEIFTTNNGYKSMQKKLRSNWKIQSLKDEITSEKLNGVKLWITAGPREKFTAAEFEILKKYLDTGGDVFVMLGEGGESRFDTNINFLLEEYGIMVNNDAVVRNVYHKYFHPKEALVSSGVLNREISRAAGKAVPGIIDEESSGNNAQALTFVYPFGATLSVMKPAVAVLSTGSVCFPLNRPILAFYHSKNQGGKLAVLGSCHMFSDQYLDKEENSKIMDVVFQWLTTGDIHLNQIDAEDPEISDYMMLPYTATLSKRNRECLQESDEIPRDFTTLFDLSIFQLDTTSFHSVIEAHEQLNVKHEPLQLIQPQFETPLPTLQPAVFPPSFRELPPPPLELFDLDETFSSEKARLAQITNKCTEEDLEFYVRKCGDILGVTSKLPKDQQDAKHILEHVFFQVVEFKKLNQEHDIDTSETAFQNNF

SEQ ID NO: 41854 - protein, 437 aa, Homo sapiens; identical to SEQ ID NO: 41853
  Payload ID: 8511
  Gene Symbol: IFT52
  Gene Name: intraflagellar transport 52
  Uniprot ID: Q9Y366
  ENSP ID: ENSP00000362130

SEQ ID NO: 41855 - protein, 429 aa, Homo sapiens
  Payload ID: 8512
  Gene Symbol: IFT57
  Gene Name: intraflagellar transport 57
  Uniprot ID: Q9NWB7
  ENSP ID: ENSP00000264538
MTAALAVVTTSGLEDGVPRSRGEGTGEVVLERGPGAAYHMFVVMEDLVEKLKLLRYEEEFLRKSNLKAPSRHYFALPTNPGEQFYMFCTLAAWLINKAGRPFEQPQEYDDPNATISNILSELRSFGRTADFPPSKLKSGYGEHVCYVLDCFAEEALKYIGFTWKRPIYPVEELEEESVAEDDAELTLNKVDEEFVEEETDNEENFIDLNVLKAQTYHLDMNETAKQEDILESTTDAAEWSLEVERVLPQLKVTIRTDNKDWRIHVDQMHQHRSGIESALKETKGFLDKLHNEITRTLEKISSREKYINNQLENLVQEYRAAQAQLSEAKERYQQGNGGVTERTRLLSEVMEELEKVKQEMEEKGSSMTDGAPLVKIKQSLTKLKQETVEMDIRIGIVEHTLLQSKLKEKSNMTRNMHATVIPEPATGFY

SEQ ID NO: 41856 - protein, 157 aa, Homo sapiens
  Payload ID: 8512
  Gene Symbol: IFT57
  Gene Name: intraflagellar transport 57
  ENSP ID: ENSP00000417439
MTAALAVVTTSGLEDGVPRSRGEGTGEVVLERGPGAAYHMFVVMEDLVEKLKLLRYEEEFLRKSNLKAPSRWVPASPSARVPASPQGDALLGPAGNQFRESGHYFALPTNPGEQFYMFCTLAAWLINKAGRPFEQPQEYDDPNATISNILSELRSFV

SEQ ID NO: 41857 - protein, 81 aa, Homo sapiens
  Payload ID: 8512
  Gene Symbol: IFT57
  Gene Name: intraflagellar transport 57
  ENSP ID: ENSP00000417768
MTAALAVVTTSGLEDGVPRSRGEGTGEVVLERGPGAAYHMFVVMEDLVEKLKLLRYEEEFLRKSNLKAPSREELQIFLLQN

SEQ ID NO: 41858 - protein, 600 aa, Homo sapiens
  Payload ID: 8513
  Gene Symbol: IFT74
  Gene Name: intraflagellar transport 74
  Uniprot ID: Q96LB3
  ENSP ID: ENSP00000369402
MASNHKSSAARPVSRGGVGLTGRPPSGIRPLSGNIRVATAMPPGTARPGSRGCPIGTGGVLSSQIKVAHRPVTQQGLTGMKTGTKGPQRQILDKSYYLGLLRSKISELTTEVNKLQKGIEMYNQENSVYLSYEKRAETLAVEIKELQGQLADYNMLVDKLNTNTEMEEVMNDYNMLKAQNDRETQSLDVIFTERQAKEKQIRSVEEEIEQEKQATDDIIKNMSFENQVKYLEMKTTNEKLLQELDTLQQQLDSQNMKKESLEAEIAHSQVKQEAVLLHEKLYELESHRDQMIAEDKSIGSPMEEREKLLKQIKDDNQEIASMERQLTDTKEKINQFIEEIRQLDMDLEEHQGEMNQKYKELKKREEHMDTFIETFEETKNQELKRKAQIEANIVALLEHCSRNINRIEQISSITNQELKMMQDDLNFKSTEVQKSQSTAQNLTSDIQRLQLDLQKMELLESKMTEEQHSLKSKIKQMTTDLEIYNDLPALKSSGEEKIKKLHQERMILSTHRNAFKKIMEKQNIEYEALKTQLQENETHSQLTNLERKWQHLEQNNFAMKEFIATKSQESDYQPIKKNVTKQIAEYNKTIVDALHSTSGN

SEQ ID NO: 41859 - protein, 600 aa, Homo sapiens; identical to SEQ ID NO: 41858
  Payload ID: 8513
  Gene Symbol: IFT74
  Gene Name: intraflagellar transport 74
  Uniprot ID: Q96LB3
  ENSP ID: ENSP00000389224

SEQ ID NO: 41860 - protein, 372 aa, Homo sapiens
  Payload ID: 8513
  Gene Symbol: IFT74
  Gene Name: intraflagellar transport 74
  Uniprot ID: Q96LB3
  ENSP ID: ENSP00000393907
MASNHKSSAARPVSRGGVGLTGRPPSGIRPLSGNIRVATAMPPGTARPGSRGCPIGTGGVLSSQIKVAHRPVTQQGLTGMKTGTKGPQRQILDKSYYLGLLRSKISELTTEVNKLQKGIEMYNQENSVYLSYEKRAETLAVEIKELQGQLADYNMLVDKLNTNTEMEEVMNDYNMLKAQNDRETQSLDVIFTERQAKEKQIRSVEEEIEQEKQATDDIIKNMSFENQVKYLEMKTTNEKLLQELDTLQQQLDSQNMKKESLEAEIAHSQVKQEAVLLHEKLYELESHRDQMIAEDKSIGSPMEEREKLLKQIKDDNQEIASMERQLTDTKEKINQFIEEIRQLDMDLEEHQDPTNYGWKILEKNTGSFKKQV

SEQ ID NO: 41861 - protein, 600 aa, Homo sapiens; identical to SEQ ID NO: 41858
  Payload ID: 8513
  Gene Symbol: IFT74
  Gene Name: intraflagellar transport 74
  Uniprot ID: Q96LB3
  ENSP ID: ENSP00000404122

SEQ ID NO: 41862 - protein, 175 aa, Homo sapiens
  Payload ID: 8513
  Gene Symbol: IFT74
  Gene Name: intraflagellar transport 74
  ENSP ID: ENSP00000430004
MASNHKSSAARPVSRGGVGLTGRPPSGIRPLSGNIRVATAMPPGTARPGSRGCPIGTGGVLSSQIKVAHRPVTQQGLTGMKTGTKGPQRQILDKSYYLGLLRSKISELTTEVNKLQKGIEMYNQENSVYLSYEKRAETLAVEIKELQGQLADYNMLVDKLNTNTEMEEVMNDYNM

SEQ ID NO: 41863 - protein, 126 aa, Homo sapiens
  Payload ID: 8513
  Gene Symbol: IFT74
  Gene Name: intraflagellar transport 74
  ENSP ID: ENSP00000430096
MASNHKSSAARPVSRGGVGLTGRPPSGIRPLSGNIRVATAMPPGTARPGSRGCPIGTGGVLSSQIKVAHRPVTQQGLTGMKTGTKGPQRQILDKSYYLGLLRSKISELTTEVNKLQKGIEMYNQEN

SEQ ID NO: 41864 - protein, 146 aa, Homo sapiens
  Payload ID: 8513
  Gene Symbol: IFT74
  Gene Name: intraflagellar transport 74
  ENSP ID: ENSP00000430526
MASNHKSSAARPVSRGGVGLTGRPPSGIRPLSGNIRVATAMPPGTARPGSRGCPIGTGGVLSSQIKVAHRPVTQQGLTGMKTGTKGPQRQILDKSYYLGLLRRSFACHPSWSAMMGSHVTATSTAWIQVILLPQPRACNLSKISEL

SEQ ID NO: 41865 - protein, 147 aa, Homo sapiens
  Payload ID: 8513
  Gene Symbol: IFT74
  Gene Name: intraflagellar transport 74
  ENSP ID: ENSP00000430742
MPMPPGTARPGSRGCPIGTGGVLSSQIKVAHRPVTQQGLTGMKTGTKGPQRQILDKSYYLGLLRSKISELTTEVNKLQKGIEMYNQENSVYLSYEKRAETLAVEIKELQGQLADYNMLVDKLNTNTEMEEVMNDYNMLKAQNDRETQ

SEQ ID NO: 41866 - protein, 777 aa, Homo sapiens
  Payload ID: 8514
  Gene Symbol: IFT80
  Gene Name: intraflagellar transport 80
  Uniprot ID: Q9P2H3
  ENSP ID: ENSP00000312778
MRLKISLLKEPKHQELVSCVGWTTAEELYSCSDDHQIVKWNLLTSETTQIVKLPDDIYPIDFHWFPKSLGVKKQTQAESFVLTSSDGKFHLISKLGRVEKSVEAHCGAVLAGRWNYEGTALVTVGEDGQIKIWSKTGMLRSTLAQQGTPVYSVAWGPDSEKVLYTAGKQLIIKPLQPNAKVLQWKAHDGIILKVDWNSVNDLILSAGEDCKYKVWDSYGRPLYNSQPHEHPITSVAWAPDGELFAVGSFHTLRLCDKTGWSYALEKPNTGSIFNIAWSIDGTQIAGACGNGHVVFAHVVEQHWEWKNFQVTLTKRRAMQVRNVLNDAVDLLEFRDRVIKASLNYAHLVVSTSLQCYVFSTKNWNTPIIFDLKEGTVSLILQAERHFLLVDGSSIYLYSYEGRFISSPKFPGMRTDILNAQTVSLSNDTIAIRDKADEKIIFLFEASTGKPLGDGKFLSHKNEILEIALDQKGLTNDRKIAFIDKNRDLCITSVKRFGKEEQIIKLGTMVHTLAWNDTCNILCGLQDTRFIVWYYPNTVYVDRDILPKTLYERDASEFSKNPHIVSFVGNQVTIRRADGSLVHISITPYPAILHEYVSSSKWEDAVRLCRFVKEQTMWACLAAMAVANRDMTTAEIAYAAIGEIDKVQYINSIKNLPSKESKMAHILLFSGNIQEAEIVLLQAGLVYQAIQININLYNWERALELAVKYKTHVDTVLAYRQKFLETFGKQETNKRYLHYAEGLQIDWEKIKAKIEMEITKEREQSSSSQSSKSIGLKP

SEQ ID NO: 41867 - protein, 42 aa, Homo sapiens
  Payload ID: 8514
  Gene Symbol: IFT80
  Gene Name: intraflagellar transport 80
  ENSP ID: ENSP00000417057
MLRSTLAQQGTPVYSVAWGPDSEKVLYTAGKQLIIKPLQPNA

SEQ ID NO: 41868 - protein, 122 aa, Homo sapiens
  Payload ID: 8514
  Gene Symbol: IFT80
  Gene Name: intraflagellar transport 80
  ENSP ID: ENSP00000417552
VRNVLNDAVDLLEFRDRVIKASLNYAHLVVSTSLQCYVFSTKNWNTPIIFDLKEGTVSLILQAERHFLLVDGSSIYLYSYEGRFISSPKFPGMRTDILNAQTVSLSNDTIAIRDKADEKSLL

SEQ ID NO: 41869 - protein, 32 aa, Homo sapiens
  Payload ID: 8514
  Gene Symbol: IFT80
  Gene Name: intraflagellar transport 80
  ENSP ID: ENSP00000417861
MLRSTLAQQGTPVYSVAWGPDSEKVLYTAGKQ

SEQ ID NO: 41870 - protein, 640 aa, Homo sapiens
  Payload ID: 8514
  Gene Symbol: IFT80
  Gene Name: intraflagellar transport 80
  Uniprot ID: Q9P2H3
  ENSP ID: ENSP00000418196
MLRSTLAQQGTPVYSVAWGPDSEKVLYTAGKQLIIKPLQPNAKVLQWKAHDGIILKVDWNSVNDLILSAGEDCKYKVWDSYGRPLYNSQPHEHPITSVAWAPDGELFAVGSFHTLRLCDKTGWSYALEKPNTGSIFNIAWSIDGTQIAGACGNGHVVFAHVVEQHWEWKNFQVTLTKRRAMQVRNVLNDAVDLLEFRDRVIKASLNYAHLVVSTSLQCYVFSTKNWNTPIIFDLKEGTVSLILQAERHFLLVDGSSIYLYSYEGRFISSPKFPGMRTDILNAQTVSLSNDTIAIRDKADEKIIFLFEASTGKPLGDGKFLSHKNEILEIALDQKGLTNDRKIAFIDKNRDLCITSVKRFGKEEQIIKLGTMVHTLAWNDTCNILCGLQDTRFIVWYYPNTVYVDRDILPKTLYERDASEFSKNPHIVSFVGNQVTIRRADGSLVHISITPYPAILHEYVSSSKWEDAVRLCRFVKEQTMWACLAAMAVANRDMTTAEIAYAAIGEIDKVQYINSIKNLPSKESKMAHILLFSGNIQEAEIVLLQAGLVYQAIQININLYNWERALELAVKYKTHVDTVLAYRQKFLETFGKQETNKRYLHYAEGLQIDWEKIKAKIEMEITKEREQSSSSQSSKSIGLKP

SEQ ID NO: 41871 - protein, 121 aa, Homo sapiens
  Payload ID: 8514
  Gene Symbol: IFT80
  Gene Name: intraflagellar transport 80
  ENSP ID: ENSP00000418455
MRLKISLLKEPKHQELVSCVGWTTAEELYSCSDDHQIVKWNLLTSETTQIVKLPDDIYPIDFHWFPKSLGVKKQTQAESFVLTSSDGKFHLISKLGRVEKSVEAHCGAVLAGRWNYEGTAL

SEQ ID NO: 41872 - protein, 95 aa, Homo sapiens
  Payload ID: 8514
  Gene Symbol: IFT80
  Gene Name: intraflagellar transport 80
  ENSP ID: ENSP00000418497
MRLKISLLKEPKHQELVSCVGWTTAEELYSCSDDHQIVKWNLLTSETTQIVKLPDDIYPIDFHWFPKSLGVKKQTQAESFVLTSSDDFSNVISFR

SEQ ID NO: 41873 - protein, 122 aa, Homo sapiens
  Payload ID: 8514
  Gene Symbol: IFT80
  Gene Name: intraflagellar transport 80
  ENSP ID: ENSP00000418602
MLRSTLAQQGTPVYSVAWGPDSEKVLYTAGKQLIIKPLQPNAKVLQWKAHDGIILKVDWNSVNDLILSAGEDCKYKVWDSYGRPLYNSQPHEHPITSVAWAPDGELFAVGSFHTLRLCDKTG

SEQ ID NO: 41874 - protein, 77 aa, Homo sapiens
  Payload ID: 8514
  Gene Symbol: IFT80
  Gene Name: intraflagellar transport 80
  ENSP ID: ENSP00000419458
MLRSTLAQQGTPVYSVAWGPDSEKVLYTAGKQLIIKPLQPNAKVLQWKAHDGIILKVDWNSVNDLILSAGEDCKYKV

SEQ ID NO: 41875 - protein, 64 aa, Homo sapiens
  Payload ID: 8514
  Gene Symbol: IFT80
  Gene Name: intraflagellar transport 80
  ENSP ID: ENSP00000419468
MRLKISLLKEPKHQELVSCVGWTTAEELYSCSDDHQIVKWNLLTSETTQIVKLPDDIYPIDFHW

SEQ ID NO: 41876 - protein, 179 aa, Homo sapiens
  Payload ID: 8514
  Gene Symbol: IFT80
  Gene Name: intraflagellar transport 80
  ENSP ID: ENSP00000420001
MRLKISLLKEPKHQELVSCVGWTTAEELYSCSDDHQIVKWNLLTSETTQIVKLPDDIYPIDFHWFPKSLGVKKQTQAESFVLTSSDGKFHLISKLGRVEKSVEAHCGAVLAGRWNYEGTALVTVGEDGQIKIWSKTGMLRSTLAQQGTPVYSVAWGPDSEKVLYTAGKQLIIKPLQPNA

SEQ ID NO: 41877 - protein, 55 aa, Homo sapiens
  Payload ID: 8514
  Gene Symbol: IFT80
  Gene Name: intraflagellar transport 80
  ENSP ID: ENSP00000420260
YEGTALVTVGEDGQIKIWSKTGMLRSTLAQQGTPVYSVAWGPDSEKVLYTAVESS

SEQ ID NO: 41878 - protein, 69 aa, Homo sapiens
  Payload ID: 8514
  Gene Symbol: IFT80
  Gene Name: intraflagellar transport 80
  ENSP ID: ENSP00000420401
  MOD_RES (1)..(1): Any amino acid
XKYKVWDSYGRPLYNSQPHEHPITSVAWAPDGELFAVGSFHTLRLCDKTGFLFHQMKDYKQAKVTYFKW

SEQ ID NO: 41879 - protein, 640 aa, Homo sapiens; identical to SEQ ID NO: 41870
  Payload ID: 8514
  Gene Symbol: IFT80
  Gene Name: intraflagellar transport 80
  Uniprot ID: Q9P2H3
  ENSP ID: ENSP00000420646

SEQ ID NO: 41880 - protein, 32 aa, Homo sapiens; identical to SEQ ID NO: 41869
  Payload ID: 8514
  Gene Symbol: IFT80
  Gene Name: intraflagellar transport 80
  ENSP ID: ENSP00000420758

SEQ ID NO: 41881 - protein, 676 aa, Homo sapiens
  Payload ID: 8515
  Gene Symbol: IFT81
  Gene Name: intraflagellar transport 81
  Uniprot ID: Q8WYA0
  ENSP ID: ENSP00000242591
MSDQIKFIMDSLNKEPFRKNYNLITFDSLEPMQLLQVLSDVLAEIDPKQLVDIREEMPEQTAKRMLSLLGILKYKPSGNATDMSTFRQGLVIGSKPVIYPVLHWLLQRTNELKKRAYLARFLIKLEVPSEFLQDETVADTNKQYEELMEAFKTLHKEYEQLKISGFSTAEIRKDISAMEEEKDQLIKRVEHLKKRVETAQNHQWMLKIARQLRVEKEREEYLAQQKQEQKNQLFHAVQRLQRVQNQLKSMRQAAADAKPESLMKRLEEEIKFNLYMVTEKFPKELENKKKELHFLQKVVSEPAMGHSDLLELESKINEINTEINQLIEKKMMRNEPIEGKLSLYRQQASIISRKKEAKAEELQEAKEKLASLEREASVKRNQTREFDGTEVLKGDEFKRYVNKLRSKSTVFKKKHQIIAELKAEFGLLQRTEELLKQRHENIQQQLQTMEEKKGISGYSYTQEELERVSALKSEVDEMKGRTLDDMSEMVKKLYSLVSEKKSALASVIKELRQLRQKYQELTQECDEKKSQYDSCAAGLESNRSKLEQEVRRLREECLQEESRYHYTNCMIKNLEVQLRRATDEMKAYISSDQQEKRKAIREQYTKNTAEQENLGKKLREKQKVIRESHGPNMKQAKMWRDLEQLMECKKQCFLKQQSQTSIGQVIQEGGEDRLIL

SEQ ID NO: 41882 - protein, 431 aa, Homo sapiens
  Payload ID: 8515
  Gene Symbol: IFT81
  Gene Name: intraflagellar transport 81
  Uniprot ID: Q8WYA0
  ENSP ID: ENSP00000355372
MSDQIKFIMDSLNKEPFRKNYNLITFDSLEPMQLLQVLSDVLAEIDPKQLVDIREEMPEQTAKRMLSLLGILKYKPSGNATDMSTFRQGLVIGSKPVIYPVLHWLLQRTNELKKRAYLARFLIKLEVPSEFLQDETVADTNKQYEELMEAFKTLHKEYEQLKISGFSTAEIRKDISAMEEEKDQLIKRVEHLKKRVETAQNHQWMLKIARQLRVEKEREEYLAQQKQEQKNQLFHAVQRLQRVQNQLKSMRQAAADAKPESLMKRLEEEIKFNLYMVTEKFPKELENKKKELHFLQKVVSEPAMGHSDLLELESKINEINTEINQLIEKKMMRNEPIEGKLSLYRQQASIISRKKEAKAEELQEAKEKLASLEREASVKRNQTREFDGTEVLKGDERQDLTLSPRLECGGVIMAYCSLKLLGSSDPPTSAS

SEQ ID NO: 41883 - protein, 624 aa, Homo sapiens
  Payload ID: 8515
  Gene Symbol: IFT81
  Gene Name: intraflagellar transport 81
  ENSP ID: ENSP00000446895
  MOD_RES (1)..(1): Any amino acid
XMQLLQVLSDVLAEIDPKQLVDIREEMPEQTAKRMLSLLGILKYKPSGNATDMSTFRQGLVIGSKPVIYPVLHWLLQRTNELKKRAYLARFLIKLEVPSEFLQDETVADTNKQYEELMEAFKTLHKEYEQLKISGFSTAEIRKDISAMEEEKDQLIKRVEHLKKRVETAQNHQWMLKIARQLRVEKEREEYLAQQKQEQKNQLFHAVQRLQRVQNQLKSMRQAAADAKPESLMKRLEEEIKFNLYMVTEKFPKELENKKKELHFLQKVVSEPAMGHSDLLELESKINEINTEINQLIEKKMMRNEPIEGKLSLYRQQASIISRKKEAKAEELQEAKEKLASLEREASVKRNQTREFDGTEVLKGDEFKRYVNKLRSKSTVFKKKHQIIAELKAEFGLLQRTEELLKQRHENIQQQLQTMEEKKGISGYSYTQEELERVSALKSEVDEMKGRTLDDMSEMVKKLYSLVSEKKSALASVIKELRQLRQKYQELTQECDEKKSQYDSCAAGLESNRSKLEQEVRRLREECLQEESRYHYTNCMIKNLEVQLRRATDEMKAYISSDQQEKRKAIREQYTKNTAEQENLGKRRNLTLLPRLECSGTILAHSAFQYRWDFTMLARLVSNS

SEQ ID NO: 41884 - protein, 366 aa, Homo sapiens
  Payload ID: 8515
  Gene Symbol: IFT81
  Gene Name: intraflagellar transport 81
  ENSP ID: ENSP00000446950
MSDQIKFIMDSLNKEPFRKNYNLITFDSLEPMQLLQVLSDVLAEIDPKQLVDIREEMPEQTAKRMLSLLGILKYKPSGNATDMSTFRQGLVIGSKPVIYPVLHWLLQRTNELKKRAYLARFLIKLEVPSEFLQDETVADTNKQDISAMEEEKDQLIKRVEHLKKRVETAQNHQWMLKIARQLRVEKEREEYLAQQKQEQKNQLFHAVQRLQRVQNQLKSMRQAAADAKPESLMKRLEEEIKFNLYMVTEKFPKELENKKKELHFLQKVVSEPAMGHSDLLELESKINEINTEINQLIEKKMMRNEPIEGKLSLYRQQASIISRKKEAKAEELQEAKEKLASLEREASVKRNQTREFDGTEVLKGDE

SEQ ID NO: 41885 - protein, 676 aa, Homo sapiens; identical to SEQ ID NO: 41881
  Payload ID: 8515
  Gene Symbol: IFT81
  Gene Name: intraflagellar transport 81
  Uniprot ID: Q8WYA0
  ENSP ID: ENSP00000449718

SEQ ID NO: 41886 - protein, 104 aa, Homo sapiens
  Payload ID: 8515
  Gene Symbol: IFT81
  Gene Name: intraflagellar transport 81
  ENSP ID: ENSP00000449964
  MOD_RES (1)..(1): Any amino acid
XQLKISGFSTAEIRKDISAMEEEKDQLIKRVEHLKKRVETAQNHQWMLKIARQLRVEKEREEYLAQQKQEQKNQLFHAVQRLQRVQNQLKSMRQAAADAKPENK

SEQ ID NO: 41887 - protein, 824 aa, Homo sapiens
  Payload ID: 8516
  Gene Symbol: IFT88
  Gene Name: intraflagellar transport 88
  Uniprot ID: Q13099
  ENSP ID: ENSP00000261632
MMQNVHLAPETDEDDLYSGYNDYNPIYDIEELENDAAFQQAVRTSHGRRPPITAKISSTAVTRPIATGYGSKTSLASSIGRPMTGAIQDGVTRPMTAVRAAGFTKAALRGSAFDPLSQSRGPASPLEAKKKDSPEEKIKQLEKEVNELVEESCIANSCGDLKLALEKAKDAGRKERVLVRQREQVTTPENINLDLTYSVLFNLASQYSVNEMYAEALNTYQVIVKNKMFSNAGILKMNMGNIYLKQRNYSKAIKFYRMALDQVPSVNKQMRIKIMQNIGVTFIQAGQYSDAINSYEHIMSMAPNLKAGYNLTICYFAIGDREKMKKAFQKLITVPLEIDEDKYISPSDDPHTNLVTEAIKNDHLRQMERERKAMAEKYIMTSAKLIAPVIETSFAAGYDWCVEVVKASQYVELANDLEINKAVTYLRQKDYNQAVEILKVLEKKDSRVKSAAATNLSALYYMGKDFAQASSYADIAVNSDRYNPAALTNKGNTVFANGDYEKAAEFYKEALRNDSSCTEALYNIGLTYEKLNRLDEALDCFLKLHAILRNSAEVLYQIANIYELMENPSQAIEWLMQVVSVIPTDPQVLSKLGELYDREGDKSQAFQYYYESYRYFPCNIEVIEWLGAYYIDTQFWEKAIQYFERASLIQPTQVKWQLMVASCFRRSGNYQKALDTYKDTHRKFPENVECLRFLVRLCTDLGLKDAQEYARKLKRLEKMKEIREQRIKSGRDGSGGSRGKREGSASGDSGQNYSASSKGERLSARLRALPGTNEPYESSSNKEIDASYVDPLGPQIERPKTAAKKRIDEDDFADEELGDDLLPE

SEQ ID NO: 41888 - protein, 833 aa, Homo sapiens
  Payload ID: 8516
  Gene Symbol: IFT88
  Gene Name: intraflagellar transport 88
  Uniprot ID: Q13099
  ENSP ID: ENSP00000323580
MKFTNTKVQMMQNVHLAPETDEDDLYSGYNDYNPIYDIEELENDAAFQQAVRTSHGRRPPITAKISSTAVTRPIATGYGSKTSLASSIGRPMTGAIQDGVTRPMTAVRAAGFTKAALRGSAFDPLSQSRGPASPLEAKKKDSPEEKIKQLEKEVNELVEESCIANSCGDLKLALEKAKDAGRKERVLVRQREQVTTPENINLDLTYSVLFNLASQYSVNEMYAEALNTYQVIVKNKMFSNAGILKMNMGNIYLKQRNYSKAIKFYRMALDQVPSVNKQMRIKIMQNIGVTFIQAGQYSDAINSYEHIMSMAPNLKAGYNLTICYFAIGDREKMKKAFQKLITVPLEIDEDKYISPSDDPHTNLVTEAIKNDHLRQMERERKAMAEKYIMTSAKLIAPVIETSFAAGYDWCVEVVKASQYVELANDLEINKAVTYLRQKDYNQAVEILKVLEKKDSRVKSAAATNLSALYYMGKDFAQASSYADIAVNSDRYNPAALTNKGNTVFANGDYEKAAEFYKEALRNDSSCTEALYNIGLTYEKLNRLDEALDCFLKLHAILRNSAEVLYQIANIYELMENPSQAIEWLMQVVSVIPTDPQVLSKLGELYDREGDKSQAFQYYYESYRYFPCNIEVIEWLGAYYIDTQFWEKAIQYFERASLIQPTQVKWQLMVASCFRRSGNYQKALDTYKDTHRKFPENVECLRFLVRLCTDLGLKDAQEYARKLKRLEKMKEIREQRIKSGRDGSGGSRGKREGSASGDSGQNYSASSKGERLSARLRALPGTNEPYESSSNKEIDASYVDPLGPQIERPKTAAKKRIDEDDFADEELGDDLLPE

SEQ ID NO: 41889 - protein, 50 aa, Homo sapiens
  Payload ID: 8516
  Gene Symbol: IFT88
  Gene Name: intraflagellar transport 88
  ENSP ID: ENSP00000374024
MMQNVHLAPETDEDDLYSGYNDYNPIYDIEELENDAAFQQAVRTSHGRRP

SEQ ID NO: 41890 - protein, 368 aa, Homo sapiens
  Payload ID: 8516
  Gene Symbol: IFT88
  Gene Name: intraflagellar transport 88
  ENSP ID: ENSP00000437719
  MOD_RES (1)..(1): Any amino acid
XALEKAKDAGRKERVLVRQREQVTTPENINLDLTYSVLFNLASQYSVNEMYAEALNTYQVIVKNKMFSNAGILKMNMGNIYLKQRNYSKAIKFYRMALDQVPSVNKQMRIKIMQNIGVTFIQADREKMKKAFQKLITVPLEIDEDKYISPSDDPHTNLVTEAIKNDHLRQMERERKAMAEKYIMTSAKLIAPVIETSFAAGYDWCVEVVKASQYVELANDLEINKAVTYLRQKDYNQAVEILKVLEKKDSRVKSAAATNLSALYYMGKDFAQASSYADIAVNSDRYNPAALTNKGNTVFANGDYEKAAEFYKEALRNDSSCTEALYNIGLTYEKLNRLDEALDCFLKLHAILRNSAEVLYQIANMYLI

SEQ ID NO: 41891 - protein, 55 aa, Homo sapiens
  Payload ID: 8517
  Gene Symbol: INIP
  Gene Name: INTS3 and NABP interacting protein
  ENSP ID: ENSP00000363351
MQNQSSTNHPGASMLMHIHLDTSSLKTLHLGTLFFLFYLALTQNEENICDGKVTL

SEQ ID NO: 41892 - protein, 74 aa, Homo sapiens
  Payload ID: 8517
  Gene Symbol: INIP
  Gene Name: INTS3 and NABP interacting protein
  ENSP ID: ENSP00000363353
MQNQSSTNHPGASIALSRPSLNKDFRDHAEQQHIAAQQKAALQHAHAHSSGYFITQDSAFGNLILPVLPRLDPE

SEQ ID NO: 41893 - protein, 104 aa, Homo sapiens
  Payload ID: 8517
  Gene Symbol: INIP
  Gene Name: INTS3 and NABP interacting protein
  Uniprot ID: Q9NRY2
  ENSP ID: ENSP00000363360
MAANSSGQGFQNKNRVAILAELDKEKRKLLMQNQSSTNHPGASIALSRPSLNKDFRDHAEQQHIAAQQKAALQHAHAHSSGYFITQDSAFGNLILPVLPRLDPE

SEQ ID NO: 41894 - protein, 942 aa, Homo sapiens
  Payload ID: 8518
  Gene Symbol: INTU
  Gene Name: inturned planar cell polarity protein
  Uniprot ID: Q9ULD6
  ENSP ID: ENSP00000334003
MASVASCDSRPSSDELPGDPSSQEEDEDYDFEDRVSDSGSYSSASSDYDDLEPEWLDSVQKNGELFYLELSEDEEESLLPETPTVNHVRFSENEIIIEDDYKERKKYEPKLKQFTKILRRKRLLPKRCNKKNSNDNGPVSILKHQSNQKTGVIVQQRYKDVNVYVNPKKLTVIKAKEQLKLLEVLVGIIHQTKWSWRRTGKQGDGERLVVHGLLPGGSAMKSGQVLIGDVLVAVNDVDVTTENIERVLSCIPGPMQVKLTFENAYDVKRETSHPRQKKTQSNTSDLVKLLWGEEVEGIQQSGLNTPHIIMYLTLQLDSETSKEEQEILYHYPMSEASQKLKSVRGIFLTLCDMLENVTGTQVTSSSLLLNGKQIHVAYWKESDKLLLIGLPAEEVPLPRLRNMIENVIQTLKFMYGSLDSAFCQIENVPRLDHFFNLFFQRALQPAKLHSSASPSAQQYDASSAVLLDNLPGVRWLTLPLEIKMELDMALSDLEAADFAELSEDYYDMRRLYTILGSSLFYKGYLICSHLPKDDLIDIAVYCRHYCLLPLAAKQRIGQLIIWREVFPQHHLRPLADSSTEVFPEPEGRYFLLVVGLKHYMLCVLLEAGGCASKAIGSPGPDCVYVDQVKTTLHQLDGVDSRIDERLASSPVPCLSCADWFLTGSREKTDSLTTSPILSRLQGTSKVATSPTCRRTLFGDYSLKTRKPSPSCSSGGSDNGCEGGEDDGFSPHTTPDAVRKQRESQGSDGLEESGTLLKVTKKKSTLPNPFHLGNLKKDLPEKELEIYNTVKLTSGPENTLFHYVALETVQGIFITPTLEEVAQLSGSIHPQLIKNFHQCCLSIRAVFQQTLVEEKKKGLNSGDHSDSAKSVSSLNPVKEHGVLFECSPGNWTDQKKAPPVMAYWVVGRLFLHPKPQELYVCFHDSVTEIAIEIAFKLFFGLTL

SEQ ID NO: 41895 - protein, 435 aa, Homo sapiens
  Payload ID: 8518
  Gene Symbol: INTU
  Gene Name: inturned planar cell polarity protein
  Uniprot ID: Q9ULD6
  ENSP ID: ENSP00000421995
MASVASCDSRPSSDELPGDPSSQEEDEDYDFEDRVSDSGSYSSASSDYDDLEPEWLDSVQKNGELFYLELSEDEEESLLPETPTVNHVRFSENEIIIEDDYKERKKYEPKLKQFTKILRRKRLLPKRCNKKNSNDNGPVSILKHQSNQKTGVIVQQRYKDVNVYVNPKKLTVIKAKEQLKLLEVLVGIIHQTKWSWRRTGKQGDGERLVVHGLLPGGSAMKSGQVLIGDVLVAVNDVDVTTENIERVLSCIPGPMQVKLTFENAYDVKRETSHPRQKKTQSNTSDLVKLLWGEEVEGIQQSGLNTPHIIMYLTLQLDSETSKEEQEILYHYPMSEASQKLKSVRGIFLTLCDMLENVTGTQVTSSSLLLNGKQIHVAYWKESDKLLLIGLPAEEVPLPRLRNMIENVIQTLKFMYGSLDSIMKEFSVIVSSGKII

SEQ ID NO: 41896 - protein, 201 aa, Homo sapiens
  Payload ID: 8518
  Gene Symbol: INTU
  Gene Name: inturned planar cell polarity protein
  ENSP ID: ENSP00000422550
MFQVGRSSIPKPAPRSLEDLDSVQRVLLHSDLEPEWLDSVQKNGELFYLELSEDEEESLLPETPTVNHVRFSENEIIIEDDYKERKKYEPKLKQFTKILRRKRLLPKRCNKKNSNDNGPVSILKHQSNQKTGVIVQQRYKDVNVYVNPKKLTVIKAKEQLKLLEVLVGIIHQTKWSWRRTGKQGDGERLVVHGLLPGGSAM

SEQ ID NO: 41897 - protein, 96 aa, Homo sapiens
  Payload ID: 8518
  Gene Symbol: INTU
  Gene Name: inturned planar cell polarity protein
  ENSP ID: ENSP00000426171
LLDNLPGVRWLTLPLEIKMELDMALSDLEAADFAELGYLICSHLPKDDLIDIAVYCRHYCLLPLAAKQRIGQLIIWREVFPQHHLRPLADSSTEVF

SEQ ID NO: 41898 - protein, 408 aa, Homo sapiens
  Payload ID: 8518
  Gene Symbol: INTU
  Gene Name: inturned planar cell polarity protein
  Uniprot ID: Q9ULD6
  ENSP ID: ENSP00000426287
MASVASCDSRPSSDELPGDPSSQEEDEDYDFEDRVSDSGSYSSASSDYDDLEPEWLDSVQKNGELFYLELSEDEEESLLPETPTVNHVRFSENEIIIEDDYKERKKYEPKLKQFTKILRRKRLLPKRCNKKNSNDNGPVSILKHQSNQKTGVIVQQRYKDVNVYVNPKKLTVIKAKEQLKLLEVLVGIIHQTKWSWRRTGKQGDGERLVVHGLLPGGSAMKSGQVLIGDVLVAVNDVDVTTENIERVLSCIPGPMQVKLTFENAYDVKRETSHPRQKKTQSNTSDLVKLLWGEEVEGIQQSGLNTPHIIMYLTLQLDSETSKEEQEILYHYPMSEASQKLKSVRGIFLTLCDMLENVTGTQVTSSSLLLNGKQIHVAYWKESDKLLLIGLPAEEIELPSSAHTHGERN

SEQ ID NO: 41899 - protein, 93 aa, Homo sapiens
  Payload ID: 8518
  Gene Symbol: INTU
  Gene Name: inturned planar cell polarity protein
  ENSP ID: ENSP00000427150
  MOD_RES (1)..(1): Any amino acid
XKTRKPSPSCSSGGSDNGCEGGEDDGFSPHTTPDAVRKQRESQGSDGLEESGTLLKVTKKKSTLPNPFHLGNLKKDLPEKELEIYNTVKKRKD

SEQ ID NO: 41900 - protein, 895 aa, Homo sapiens
  Payload ID: 8519
  Gene Symbol: INVS
  Gene Name: inversin
  Uniprot ID: Q9Y283
  ENSP ID: ENSP00000262456
MNKSENLLFAGSSLASQVHAAAVNGDKGALQRLIVGNSALKDKEDQFGRTPLMYCVLADRLDCADALLKAGADVNKTDHSQRTALHLAAQKGNYRFMKLLLTRRANWMQKDLEEMTPLHLTTRHRSPKCLALLLKFMAPGEVDTQDKNKQTALHWSAYYNNPEHVKLLIKHDSNIGIPDVEGKIPLHWAANHKDPSAVHTVRCILDAAPTESLLNWQDYEGRTPLHFAVADGNVTVVDVLTSYESCNITSYDNLFRTPLHWAALLGHAQIVHLLLERNKSGTIPSDSQGATPLHYAAQSNFAETVKVFLKHPSVKDDSDLEGRTSFMWAAGKGSDDVLRTMLSLKSDIDINMADKYGGTALHAAALSGHVSTVKLLLENNAQVDATDVMKHTPLFRACEMGHKDVIQTLIKGGARVDLVDQDGHSLLHWAALGGNADVCQILIENKINPNVQDYAGRTPLQCAAYGGYINCMAVLMENNADPNIQDKEGRTALHWSCNNGYLDAIKLLLDFAAFPNQMENNEERYTPLDYALLGERHEVIQFMLEHGALSIAAIQDIAAFKIQAVYKGYKVRKAFRDRKNLLMKHEQLRKDAAAKKREEENKRKEAEQQKGRRSPDSCRPQALPCLPSTQDVPSRQSRAPSKQPPAGNVAQGPEPRDSRGSPGGSLGGALQKEQHVSSDLQGTNSRRPNETAREHSKGQSACVHFRPNEGSDGSRHPGVPSVEKSRELRLQIIQRERRRKELFRKKNKAAAVIQRAWRSYQLRKHLSHLRHMKQLGAGDVDRWRQESTALLLQVWRKELELKFPQTTAVSKAPKSPSKGTSGTKSTKHSVLKQIYGCSHEGKIHHPTRSVKASSVLRLNSVSNLQCIHLLENSGRSKNFSYNLQSATQPKNKTKP

SEQ ID NO: 41901 - protein, 1065 aa, Homo sapiens
  Payload ID: 8519
  Gene Symbol: INVS
  Gene Name: inversin
  Uniprot ID: Q9Y283
  ENSP ID: ENSP00000262457
MNKSENLLFAGSSLASQVHAAAVNGDKGALQRLIVGNSALKDKEDQFGRTPLMYCVLADRLDCADALLKAGADVNKTDHSQRTALHLAAQKGNYRFMKLLLTRRANWMQKDLEEMTPLHLTTRHRSPKCLALLLKFMAPGEVDTQDKNKQTALHWSAYYNNPEHVKLLIKHDSNIGIPDVEGKIPLHWAANHKDPSAVHTVRCILDAAPTESLLNWQDYEGRTPLHFAVADGNVTVVDVLTSYESCNITSYDNLFRTPLHWAALLGHAQIVHLLLERNKSGTIPSDSQGATPLHYAAQSNFAETVKVFLKHPSVKDDSDLEGRTSFMWAAGKGSDDVLRTMLSLKSDIDINMADKYGGTALHAAALSGHVSTVKLLLENNAQVDATDVMKHTPLFRACEMGHKDVIQTLIKGGARVDLVDQDGHSLLHWAALGGNADVCQILIENKINPNVQDYAGRTPLQCAAYGGYINCMAVLMENNADPNIQDKEGRTALHWSCNNGYLDAIKLLLDFAAFPNQMENNEERYTPLDYALLGERHEVIQFMLEHGALSIAAIQDIAAFKIQAVYKGYKVRKAFRDRKNLLMKHEQLRKDAAAKKREEENKRKEAEQQKGRRSPDSCRPQALPCLPSTQDVPSRQSRAPSKQPPAGNVAQGPEPRDSRGSPGGSLGGALQKEQHVSSDLQGTNSRRPNETAREHSKGQSACVHFRPNEGSDGSRHPGVPSVEKSRGETAGDERCAKGKGFVKQPSCIRVAGPDEKGEDSRRAAASLPPHDSHWKPSRRHDTEPKAKCAPQKRRTQELRGGRCSPAGSSRPGSARGEAVHAGQNPPHHRTPRNKVTQAKLTGGLYSHLPQSTEELRSGARRLETSTLSEDFQVSKETDPAPGPLSGQSVNIDLLPVELRLQIIQRERRRKELFRKKNKAAAVIQRAWRSYQLRKHLSHLRHMKQLGAGDVDRWRQESTALLLQVWRKELELKFPQTTAVSKAPKSPSKGTSGTKSTKHSVLKQIYGCSHEGKIHHPTRSVKASSVLRLNSVSNLQCIHLLENSGRSKNFSYNLQSATQPKNKTKP

SEQ ID NO: 41902 - protein, 101 aa, Homo sapiens
  Payload ID: 8519
  Gene Symbol: INVS
  Gene Name: inversin
  Uniprot ID: Q9Y283
  ENSP ID: ENSP00000364056
MNKSENLLFAGSSLASQVHAAAVNGDKGALQRLIVGNSALKDKEDQFGRTPLMYCVLADRLDCADALLKAGADVNKTDHSQRTALHLAAQKALRTISTGRI

SEQ ID NO: 41903 - protein, 717 aa, Homo sapiens
  Payload ID: 8520
  Gene Symbol: INF2
  Gene Name: inverted formin, FH2 and WH2 domain containing
  ENSP ID: ENSP00000252527
GMEEVIVAQVDHGLGSAWVPSHRRVNPPTLRMKKLNWQKLPSNVAREHNSMWASLSSPDAEAVEPDFSSIERLFSFPAAKPKEPTMVAPRARKEPKEITFLDAKKSLNLNIFLKQFKCSNEEVAAMIRAGDTTKFDVEVLKQLLKLLPEKHEIENLRAFTEERAKLASADHFYLLLLAIPCYQLRIECMLLCEGAAAVLDMVRPKAQLVLAACESLLTSRQLPIFCQLILRIGNFLNYGSHTGDADGFKISTLLKLTETKSQQNRVTLLHHVLEEAEKSHPDLLQLPRDLEQPSQAAGINLEIIRSEASSNLKKLLETERKVSASVAEVQEQYTERLQASISAFRALDELFEAIEQKQRELADYLCEDAQQLSLEDTFSTMKAFRDLFLRALKENKDRKEQAAKAERRKQQLAEEEARRPRGEDGKPVRKGPGKQEEVCVIDALLADIRKGFQLRKTARGRGDTDGGSKAASMDPPRATEPVATSNPAGDPVGSTRCPASEPGLDATTASESRGWDLVDAVTPGPQPTLEQLEEGGPRPLERRSSWYVDASDVLTTEDPQCPQPLEGAWPVTLGDAQALKPLKFSSNQPPAAGSSRQDAKDPTSLLGVLQAEADSTSEGLEDAVHSRGARPPAAGPGGDEDEDEEDTAPESALDTSLDKSFSEDAVTDSSGSGTLPRARGRASKGTGKRRKKRPSRSQEEVPPDSDDNKTKKLCVIQ

SEQ ID NO: 41904 - protein, 1240 aa, Homo sapiens
  Payload ID: 8520
  Gene Symbol: INF2
  Gene Name: inverted formin, FH2 and WH2 domain containing
  Uniprot ID: Q27J81
  ENSP ID: ENSP00000376406
MSVKEGAQRKWAALKEKLGPQDSDPTEANLESADPELCIRLLQMPSVVNYSGLRKRLEGSDGGWMVQFLEQSGLDLLLEALARLSGRGVARISDALLQLTCVSCVRAVMNSRQGIEYILSNQGYVRQLSQALDTSNVMVKKQVFELLAALCIYSPEGHVLTLDALDHYKTVCSQQYRFSIVMNELSGSDNVPYVVTLLSVINAVILGPEDLRARTQLRNEFIGLQLLDVLARLRDLEDADLLIQLEAFEEAKAEDEEELLRVSGGVDMSSHQEVFASLFHKVSCSPVSAQLLSVLQGLLHLEPTLRSSQLLWEALESLVNRAVLLASDAQECTLEEVVERLLSVKGRPRPSPLVKAHKSVQANLDQSQRGSSPQNTTTPKPSVEGQQPAAAAACEPVDHAQSESILKVSQPRALEQQASTPPPPPPPPLLPGSSAEPPPPPPPPPLPSVGAKALPTAPPPPPLPGLGAMAPPAPPLPPPLPGSCEFLPPPPPPLPGLGCPPPPPPLLPGMGWGPPPPPPPLLPCTCSPPVAGGMEEVIVAQVDHGLGSAWVPSHRRVNPPTLRMKKLNWQKLPSNVAREHNSMWASLSSPDAEAVEPDFSSIERLFSFPAAKPKEPTMVAPRARKEPKEITFLDAKKSLNLNIFLKQFKCSNEEVAAMIRAGDTTKFDVEVLKQLLKLLPEKHEIENLRAFTEERAKLASADHFYLLLLAIPCYQLRIECMLLCEGAAAVLDMVRPKAQLVLAACESLLTSRQLPIFCQLILRIGNFLNYGSHTGDADGFKISTLLKLTETKSQQNRVTLLHHVLEEAEKSHPDLLQLPRDLEQPSQAAGINLEIIRSEASSNLKKLLETERKVSASVAEVQEQYTERLQASISAFRALDELFEAIEQKQRELADYLCEDAQQLSLEDTFSTMKAFRDLFLRALKENKDRKEQAAKAERRKQQLAEEEARRPRGEDGKPVRKGPGKQEEVCVIDALLADIRKGFQLRKTARGRGDTDGGSKAASMDPPRATEPVATSNPAGDPVGSTRCPASEPGLDATTASESRGWDLVDAVTPGPQPTLEQLEEGGPRPLERRSSWYVDASDVLTTEDPQCPQPLEGAWPVTLGDAQALKPLKFSSNQPPAAGSSRQDAKDPTSLLGVLQAEADSTSEGLEDAVHSRGARPPAAGPGGDEDEDEEDTAPESALDTSLDKSFSEDAVTDSSGSGTLPRARGRASKGTGKRRKKRPSRSQEGLRPRPKAK

SEQ ID NO: 41905 - protein, 1249 aa, Homo sapiens
  Payload ID: 8520
  Gene Symbol: INF2
  Gene Name: inverted formin, FH2 and WH2 domain containing
  Uniprot ID: Q27J81
  ENSP ID: ENSP00000376410
MSVKEGAQRKWAALKEKLGPQDSDPTEANLESADPELCIRLLQMPSVVNYSGLRKRLEGSDGGWMVQFLEQSGLDLLLEALARLSGRGVARISDALLQLTCVSCVRAVMNSRQGIEYILSNQGYVRQLSQALDTSNVMVKKQVFELLAALCIYSPEGHVLTLDALDHYKTVCSQQYRFSIVMNELSGSDNVPYVVTLLSVINAVILGPEDLRARTQLRNEFIGLQLLDVLARLRDLEDADLLIQLEAFEEAKAEDEEELLRVSGGVDMSSHQEVFASLFHKVSCSPVSAQLLSVLQGLLHLEPTLRSSQLLWEALESLVNRAVLLASDAQECTLEEVVERLLSVKGRPRPSPLVKAHKSVQANLDQSQRGSSPQNTTTPKPSVEGQQPAAAAACEPVDHAQSESILKVSQPRALEQQASTPPPPPPPPLLPGSSAEPPPPPPPPPLPSVGAKALPTAPPPPPLPGLGAMAPPAPPLPPPLPGSCEFLPPPPPPLPGLGCPPPPPPLLPGMGWGPPPPPPPLLPCTCSPPVAGGMEEVIVAQVDHGLGSAWVPSHRRVNPPTLRMKKLNWQKLPSNVAREHNSMWASLSSPDAEAVEPDFSSIERLFSFPAAKPKEPTMVAPRARKEPKEITFLDAKKSLNLNIFLKQFKCSNEEVAAMIRAGDTTKFDVEVLKQLLKLLPEKHEIENLRAFTEERAKLASADHFYLLLLAIPCYQLRIECMLLCEGAAAVLDMVRPKAQLVLAACESLLTSRQLPIFCQLILRIGNFLNYGSHTGDADGFKISTLLKLTETKSQQNRVTLLHHVLEEAEKSHPDLLQLPRDLEQPSQAAGINLEIIRSEASSNLKKLLETERKVSASVAEVQEQYTERLQASISAFRALDELFEAIEQKQRELADYLCEDAQQLSLEDTFSTMKAFRDLFLRALKENKDRKEQAAKAERRKQQLAEEEARRPRGEDGKPVRKGPGKQEEVCVIDALLADIRKGFQLRKTARGRGDTDGGSKAASMDPPRATEPVATSNPAGDPVGSTRCPASEPGLDATTASESRGWDLVDAVTPGPQPTLEQLEEGGPRPLERRSSWYVDASDVLTTEDPQCPQPLEGAWPVTLGDAQALKPLKFSSNQPPAAGSSRQDAKDPTSLLGVLQAEADSTSEGLEDAVHSRGARPPAAGPGGDEDEDEEDTAPESALDTSLDKSFSEDAVTDSSGSGTLPRARGRASKGTGKRRKKRPSRSQEEVPPDSDDNKTKKLCVIQ

SEQ ID NO: 41906 - protein, 234 aa, Homo sapiens
  Payload ID: 8520
  Gene Symbol: INF2
  Gene Name: inverted formin, FH2 and WH2 domain containing
  Uniprot ID: Q27J81
  ENSP ID: ENSP00000381380
MSVKEGAQRKWAALKEKLGPQDSDPTEANLESADPELCIRLLQMPSVVNYSGLRKRLEGSDGGWMVQFLEQSGLDLLLEALARLSGRGVARISDALLQLTCVSCVRAVMNSRQGIEYILSNQGYVRQLSQALDTSNVMVKKQVFELLAALCIYSPEGHVLTLDALDHYKTVCSQQYRFSIVMNELSGSDNVPYVVTLLSVINAVILGPEDLRARTQLRNEFIGLQLLDVLARLR

SEQ ID NO: 41907 - protein, 142 aa, Homo sapiens
  Payload ID: 8520
  Gene Symbol: INF2
  Gene Name: inverted formin, FH2 and WH2 domain containing
  ENSP ID: ENSP00000483829
MQCFASLYCLEVAELGALGRGKLAGSAMAGQGPLPWGLAPVPACPAPEVGVGGGLPLLPLPGLCPAAETWPSHQQKTPPSASCPAWAGPGDNTGPPEGLQGDTQQPLPPHCPPSEGSLPEPAPCQVCALRLAAGCVANKKQT

SEQ ID NO: 41908 - protein, 585 aa, Homo sapiens
  Payload ID: 8521
  Gene Symbol: IVL
  Gene Name: involucrin
  Uniprot ID: P07476
  ENSP ID: ENSP00000357753
MSQQHTLPVTLSPALSQELLKTVPPPVNTHQEQMKQPTPLPPPCQKVPVELPVEVPSKQEEKHMTAVKGLPEQECEQQQKEPQEQELQQQHWEQHEEYQKAENPEQQLKQEKTQRDQQLNKQLEEEKKLLDQQLDQELVKRDEQLGMKKEQLLELPEQQEGHLKHLEQQEGQLKHPEQQEGQLELPEQQEGQLELPEQQEGQLELPEQQEGQLELPEQQEGQLELPEQQEGQLELPQQQEGQLELSEQQEGQLELSEQQEGQLKHLEHQEGQLEVPEEQMGQLKYLEQQEGQLKHLDQQEKQPELPEQQMGQLKHLEQQEGQPKHLEQQEGQLEQLEEQEGQLKHLEQQEGQLEHLEHQEGQLGLPEQQVLQLKQLEKQQGQPKHLEEEEGQLKHLVQQEGQLKHLVQQEGQLEQQERQVEHLEQQVGQLKHLEEQEGQLKHLEQQQGQLEVPEQQVGQPKNLEQEEKQLELPEQQEGQVKHLEKQEAQLELPEQQVGQPKHLEQQEKHLEHPEQQDGQLKHLEQQEGQLKDLEQQKGQLEQPVFAPAPGQVQDIQPALPTKGEVLLPVEHQQQKQEVQWPPKHK

SEQ ID NO: 41909 - protein, 293 aa, Homo sapiens
  Payload ID: 8522
  Gene Symbol: IYD
  Gene Name: iodotyrosine deiodinase
  Uniprot ID: Q6PHW0
  ENSP ID: ENSP00000229447
MYFLTPILVAILCILVVWIFKNADRSMEKKKGEPRTRAEARPWVDEDLKDSSDLHQAEEDADEWQESEENVEHIPFSHNHYPEKEMVKRSQEFYELLNKRRSVRFISNEQVPMEVIDNVIRTAGTAPSGAHTEPWTFVVVKDPDVKHKIRKIIEEEEEINYMKRMGHRWVTDLKKLRTNWIKEYLDTAPILILIFKQVHGFAANGKKKVHYYNEISVSIACGILLAALQVNNGITMRHQTARHRHLIEGPGRSSEACSKLSSQGCPECRSGDCHYHSSQLWPSTEGAPGPPRT

SEQ ID NO: 41910 - protein, 289 aa, Homo sapiens
  Payload ID: 8522
  Gene Symbol: IYD
  Gene Name: iodotyrosine deiodinase
  Uniprot ID: Q6PHW0
  ENSP ID: ENSP00000343763
MYFLTPILVAILCILVVWIFKNADRSMEKKKGEPRTRAEARPWVDEDLKDSSDLHQAEEDADEWQESEENVEHIPFSHNHYPEKEMVKRSQEFYELLNKRRSVRFISNEQVPMEVIDNVIRTAGTAPSGAHTEPWTFVVVKDPDVKHKIRKIIEEEEEINYMKRMGHRWVTDLKKLRTNWIKEYLDTAPILILIFKQVHGFAANGKKKVHYYNEISVSIACGILLAALQNAGLVTVTTTPLNCGPRLRVLLGRPAHEKLLMLLPVGYPSKEATVPDLKRKPLDQIMVTV

SEQ ID NO: 41911 - protein, 247 aa, Homo sapiens
  Payload ID: 8522
  Gene Symbol: IYD
  Gene Name: iodotyrosine deiodinase
  Uniprot ID: Q6PHW0
  ENSP ID: ENSP00000356304
MYFLTPILVAILCILVVWIFKNADRSMEKKKGEPRTRAEARPWVDEDLKDSSDLHQAEEDADEWQESEENVEHIPFSHNHYPEKEMVKRSQEFYELLNKRRSVRFISNEQVPMEVIDNVIRTAGTAPSGAHTEPWTFVVVKDPDVKHKIRKIIEEEEEINYMKRMGHRWVTDLKKLRTNWIKEYLDTAPILILIFKQVHGFAANGKKKVHYYNEISVSIACGILLAALQVFGKIILKELALISFLNL

SEQ ID NO: 41912 - protein, 270 aa, Homo sapiens
  Payload ID: 8522
  Gene Symbol: IYD
  Gene Name: iodotyrosine deiodinase
  ENSP ID: ENSP00000376084
MYFLTPILVAILCILVVWIFKNADRSMEKKKGEPRTRAEARPWVDEDLKDSSDLHQAEEDADEWQESEENVEHIPFSHNHYPEKEMVKRSQEFYELLNKRRSVRFISNEQVPMEVIDNVIRTAGTAPSGAHTEPWTFVVVKDPDVKHKIRKIIEEEEEINYMKRMGHRWVTDLKKLRTNWIKEYLDTAPILILIFKQVHGFAANGKKKVHYYNEISVSIACGILLAALQVNNGITMRHQTARHRHLIEGPGRSSEACSKLSSQGCPGFYC

SEQ ID NO: 41913 - protein, 247 aa, Homo sapiens; identical to SEQ ID NO: 41911
  Payload ID: 8522
  Gene Symbol: IYD
  Gene Name: iodotyrosine deiodinase
  Uniprot ID: Q6PHW0
  ENSP ID: ENSP00000376085

SEQ ID NO: 41914 - protein, 192 aa, Homo sapiens
  Payload ID: 8522
  Gene Symbol: IYD
  Gene Name: iodotyrosine deiodinase
  ENSP ID: ENSP00000390081
MKEADADEWQESEENVEHIPFSHNHYPEKEMVKRSQEFYELLNKRRSVRFISNEQVPMEVIDNVIRTAGTAPSGAHTEPWTFVVVKDPDVKHKIRKIIEEEEEINYMKRMGHRWVTDLKKLRTNWIKEYLDTAPILILIFKQVHGFAANGKKKVHYYNEISVSIACGILLAALQVFGKIILKELALISFLNL

SEQ ID NO: 41915 - protein, 89 aa, Homo sapiens
  Payload ID: 8522
  Gene Symbol: IYD
  Gene Name: iodotyrosine deiodinase
  ENSP ID: ENSP00000397342
PWVDEDLKDSSDLHQAEEDADEWQESEENVEHIPFSHNHYPEKEMVKRSQEFYELLNKRRNSPEWGSHRALDLRGCEGPRREAQDSKDH

SEQ ID NO: 41916 - protein, 284 aa, Homo sapiens
  Payload ID: 8522
  Gene Symbol: IYD
  Gene Name: iodotyrosine deiodinase
  ENSP ID: ENSP00000441276
MYFLTPILVAILCILVVWIFKNADRSMEKKKGEPRTRAEARPWVDEDLKDSSDLHQAEEDADEWQESEENVEHIPFSHNHYPEKEMVKRSQEFYELLNKRRSVRFISNEQVPMEVIDNVIRTAGTAPSGAHTEPWTFVVVKDPDVKHKIRKIIEEEEEINYMKRMGHRWVTDLKKLRTNWIKEYLDTAPILILIFKQVHGFAANGKKKVHYYNEISVSIACGILLAALQVNNGITMRHQTARHRHLIEGPGRSSEACSKLSSQGCPGASAAGSLFHFAIEFAAP

SEQ ID NO: 41917 - protein, 963 aa, Homo sapiens
  Payload ID: 8523
  Gene Symbol: IQSEC1
  Gene Name: IQ motif and Sec7 domain 1
  Uniprot ID: Q6DN90
  ENSP ID: ENSP00000273221
MWCLHCNSERTQSLLELELDSGVEGEAPSSETGTSLDSPSAYPQGPLVPGSSLSPDHYEHTSVGAYGLYSGPPGQQQRTRRPKLQHSTSILRKQAEEEAIKRSRSLSESYELSSDLQDKQVEMLERKYGGRLVTRHAARTIQTAFRQYQMNKNFERLRSSMSENRMSRRIVLSNMRMQFSFEGPEKVHSSYFEGKQVSVTNDGSQLGALVSPECGDLSEPTTLKSPAPSSDFADAITELEDAFSRQVKSLAESIDDALNCRSLHTEEAPALDAARARDTEPQTALHGMDHRKLDEMTASYSDVTLYIDEEELSPPLPLSQAGDRPSSTESDLRLRAGGAAPDYWALAHKEDKADTDTSCRSTPSLERQEQRLRVEHLPLLTIEPPSDSSVDLSDRSERGSLKRQSAYERSLGGQQGSPKHGPHSGAPKSLPREEPELRPRPPRPLDSHLAINGSANRQSKSESDYSDGDNDSINSTSNSNDTINCSSESSSRDSLREQTLSKQTYHKEARNSWDSPAFSNDVIRKRHYRIGLNLFNKKPEKGVQYLIERGFVPDTPVGVAHFLLQRKGLSRQMIGEFLGNRQKQFNRDVLDCVVDEMDFSTMELDEALRKFQAHIRVQGEAQKVERLIEAFSQRYCICNPGVVRQFRNPDTIFILAFAIILLNTDMYSPNVKPERKMKLEDFIKNLRGVDDGEDIPREMLMGIYERIRKRELKTNEDHVSQVQKVEKLIVGKKPIGSLHPGLGCVLSLPHRRLVCYCRLFEVPDPNKPQKLGLHQREIFLFNDLLVVTKIFQKKKNSVTYSFRQSFSLYGMQVLLFENQYYPNGIRLTSSVPGADIKVLINFNAPNPQDRKKFTDDLRESIAEVQEMEKHRIESELEKQKGVVRPSMSQCSSLKKESGNGTLSRACLDDSYASGEGLKRSALSSSLRDLSEAGKRGRRSSAGSLESNVEFQPFEPLQPSVLCS

SEQ ID NO: 41918 - protein, 814 aa, Homo sapiens
  Payload ID: 8523
  Gene Symbol: IQSEC1
  Gene Name: IQ motif and Sec7 domain 1
  ENSP ID: ENSP00000478001
MLERKYGGRLVTRHAARTIQTAFRQYQMNKNFERLRSSMSENRMSRRIVLSNMRMQFSFEGPEKVHSSYFEGKQVSVTNDGSQLGALVSPECGDLSEPTTLKSPAPSSDFADAITELEDAFSRQVKSLAESIDDALNCRSLHTEEAPALDAARARDTEPQTALHGMDHRKLDEMTASYSDVTLYIDEEELSPPLPLSQAGDRPSSTESDLRLRAGGAAPDYWALAHKEDKADTDTSCRSTPSLERQEQRLRVEHLPLLTIEPPSDSSVDLSDRSERGSLKRQSAYERSLGGQQGSPKHGPHSGAPKSLPREEPELRPRPPRPLDSHLAINGSANRQSKSESDYSDGDNDSINSTSNSNDTINCSSESSSRDSLREQTLSKQTYHKEARNSWDSPAFSNDVIRKRHYRIGLNLFNKKPEKGVQYLIERGFVPDTPVGVAHFLLQRKGLSRQMIGEFLGNRQKQFNRDVLDCVVDEMDFSTMELDEALRKFQAHIRVQGEAQKVERLIEAFSQRYCICNPGVVRQFRNPDTIFILAFAIILLNTDMYSPNVKPERKMKLEDFIKNLRGVDDGEDIPREMLMGIYERIRKRELKTNEDHVSQVQKVEKLIVGKKPIGSLHPGLGCVLSLPHRRLVCYCRLFEVPDPNKPQKLGLHQREIFLFNDLLVVTKIFQKKKNSVTYSFRQSFSLYGMQVLLFENQYYPNGIRLTSSVPGADIKVLINFNAPNPQDRKKFTDDLRESIAEVQEMEKHRIESELEKQKGVVRPSMSQCSSLKKESGNGTLSRACLDDSYASGEGLKRSALSSSLRDLSEAGVHH

SEQ ID NO: 41919 - protein, 1114 aa, Homo sapiens
  Payload ID: 8523
  Gene Symbol: IQSEC1
  Gene Name: IQ motif and Sec7 domain 1
  ENSP ID: ENSP00000480301
MACRRRYFVEGEAPSSETGTSLDSPSAYPQGPLVPGSSLSPDHYEHTSVGAYGLYSGPPGQQQRTRRPKLQHSTSILRKQAEEEAIKRSRSLSESYELSSDLQDKQVEMLERKYGGRLVTRHAARTIQTAFRQYQMNKNFERLRSSMSENRMSRRIVLSNMRMQFSFEGPEKVHSSYFEGKQVSVTNDGSQLGALVSPECGDLSEPTTLKSPAPSSDFADAITELEDAFSRQVKSLAESIDDALNCRSLHTEEAPALDAARARDTEPQTALHGMDHRKLDEMTASYSDVTLYIDEEELSPPLPLSQAGDRPSSTESDLRLRAGGAAPDYWALAHKEDKADTDTSCRSTPSLERQEQRLRVEHLPLLTIEPPSDSSVDLSDRSERGSLKRQSAYERSLGGQQGSPKHGPHSGAPKSLPREEPELRPRPPRPLDSHLAINGSANRQSKSESDYSDGDNDSINSTSNSNDTINCSSESSSRDSLREQTLSKQTYHKEARNSWDSPAFSNDVIRKRHYRIGLNLFNKKPEKGVQYLIERGFVPDTPVGVAHFLLQRKGLSRQMIGEFLGNRQKQFNRDVLDCVVDEMDFSTMELDEALRKFQAHIRVQGEAQKVERLIEAFSQRYCICNPGVVRQFRNPDTIFILAFAIILLNTDMYSPNVKPERKMKLEDFIKNLRGVDDGEDIPREMLMGIYERIRKRELKTNEDHVSQVQKVEKLIVGKKPIGSLHPGLGCVLSLPHRRLVCYCRLFEVPDPNKPQKLGLHQREIFLFNDLLVVTKIFQKKKNSVTYSFRQSFSLYGMQVLLFENQYYPNGIRLTSSVPGADIKVLINFNAPNPQDRKKFTDDLRESIAEVQEMEKHRIESELEKQKGVVRPSMSQCSSLKKESGNGTLSRACLDDSYASGEGLKRSALSSSLRDLSEAGKRGRRSSAGSLESNVEGSIISSPHMRRRATSTRECPSRPHQTMPNSSSLLGSLFGSKRGKPPPQAHLPSAPALPPPHPPVVLPHLQHSVAGHHLGPPEGLPQAAMHGHHTQYCHMQNPPPYHHHHHHHPPQHIQHAHQYHHGPHGGHPAYGAHAHGHPPLPSAHVGHTVHHHGQPPAPPPPTSSKAKPSGISTIV

SEQ ID NO: 41920 - protein, 949 aa, Homo sapiens
  Payload ID: 8524
  Gene Symbol: IQSEC2
  Gene Name: IQ motif and Sec7 domain 2
  Uniprot ID: Q5JU85
  ENSP ID: ENSP00000364514
MEPPGRSSRSTASHTLHQYCCPTQVLDSMKLTPSGRLAESSVEGDAPGSDLSTAVDSPGSQPPYRLSQLPPSSSHMGGPPAGVGLPWAQRARLQPASVALRKQEEEEIKRSKALSDSYELSTDLQDKKVEMLERKYGGSFLSRRAARTIQTAFRQYRMNKNFERLRSSASESRMSRRIILSNMRMQFSFEEYEKAQNPAYFEGKPASLDEGAMAGARSHRLERGLPYGGSCGGGIDGGGSSVTTSGEFSNDITELEDSFSKQVKSLAESIDEALNCHPSGPMSEEPGSAQLEKRESKEQQEDSSATSFSDLPLYLDDTVPQQSPERLPSTEPPPQGRPEFWAPAPLPPVPPPVPSGTREDGSREEGTRRGPGCLECRDFRLRAAHLPLLTIEPPSDSSVDLSDRSDRGSVHRQLVYEADGCSPHGTLKHKGPPGRAPIPHRHYPAPEGPAPAPPGPLPPAPNSGTGPSGVAGGRRLGKCEAAGENSDGGDNESLESSSNSNETINCSSGSSSRDSLREPPATGLCKQTYQRETRHSWDSPAFNNDVVQRRHYRIGLNLFNKKPEKGIQYLIERGFLSDTPVGVAHFILERKGLSRQMIGEFLGNRQKQFNRDVLDCVVDEMDFSSMDLDDALRKFQSHIRVQGEAQKVERLIEAFSQRYCVCNPALVRQFRNPDTIFILAFAIILLNTDMYSPSVKAERKMKLDDFIKNLRGVDNGEDIPRDLLVGIYQRIQGRELRTNDDHVSQVQAVERMIVGKKPVLSLPHRRLVCCCQLYEVPDPNRPQRLGLHQREVFLFNDLLVVTKIFQKKKILVTYSFRQSFPLVEMHMQLFQNSYYQFGIKLLSAVPGGERKVLIIFNAPSLQDRLRFTSDLRESIAEVQEMEKYRVESELEKQKGMMRPNASQPGGAKDSVNGTMARSSLEDTYGAGDGLKRGALSSSLRDLSDAGVCY

SEQ ID NO: 41921 - protein, 1488 aa, Homo sapiens
  Payload ID: 8524
  Gene Symbol: IQSEC2
  Gene Name: IQ motif and Sec7 domain 2
  Uniprot ID: Q5JU85
  ENSP ID: ENSP00000379712
MEAGSGPPGGPGSESPNRAVEYLLELNNIIESQQQLLETQRRRIEELEGQLDQLTQENRDLREESQLHRGELHRDPHGARDSPGRESQYQNLRETQFHHRELRESQFHQAARDVGYPNREGAYQNREAVYRDKERDASYPLQDTTGYTARERDVAQCHLHHENPALGRERGGREAGPAHPGREKEAGYSAAVGVGPRPPRERGQLSRGASRSSSPGAGGGHSTSTSTSPATTLQRKSDGENSRTVSVEGDAPGSDLSTAVDSPGSQPPYRLSQLPPSSSHMGGPPAGVGLPWAQRARLQPASVALRKQEEEEIKRSKALSDSYELSTDLQDKKVEMLERKYGGSFLSRRAARTIQTAFRQYRMNKNFERLRSSASESRMSRRIILSNMRMQFSFEEYEKAQNPAYFEGKPASLDEGAMAGARSHRLERGLPYGGSCGGGIDGGGSSVTTSGEFSNDITELEDSFSKQVKSLAESIDEALNCHPSGPMSEEPGSAQLEKRESKEQQEDSSATSFSDLPLYLDDTVPQQSPERLPSTEPPPQGRPEFWAPAPLPPVPPPVPSGTREDGSREEGTRRGPGCLECRDFRLRAAHLPLLTIEPPSDSSVDLSDRSDRGSVHRQLVYEADGCSPHGTLKHKGPPGRAPIPHRHYPAPEGPAPAPPGPLPPAPNSGTGPSGVAGGRRLGKCEAAGENSDGGDNESLESSSNSNETINCSSGSSSRDSLREPPATGLCKQTYQRETRHSWDSPAFNNDVVQRRHYRIGLNLFNKKPEKGIQYLIERGFLSDTPVGVAHFILERKGLSRQMIGEFLGNRQKQFNRDVLDCVVDEMDFSSMDLDDALRKFQSHIRVQGEAQKVERLIEAFSQRYCVCNPALVRQFRNPDTIFILAFAIILLNTDMYSPSVKAERKMKLDDFIKNLRGVDNGEDIPRDLLVGIYQRIQGRELRTNDDHVSQVQAVERMIVGKKPVLSLPHRRLVCCCQLYEVPDPNRPQRLGLHQREVFLFNDLLVVTKIFQKKKILVTYSFRQSFPLVEMHMQLFQNSYYQFGIKLLSAVPGGERKVLIIFNAPSLQDRLRFTSDLRESIAEVQEMEKYRVESELEKQKGMMRPNASQPGGAKDSVNGTMARSSLEDTYGAGDGLKRGALSSSLRDLSDAGKRGRRNSVGSLDSTIEGSVISSPRPHQRMPPPPPPPPPEEYKSQRPVSNSSSFLGSLFGSKRGKGPFQMPPPPTGQASASSSSASSTHHHHHHHHHGHSHGGLGVLPDGQSKLQALHAQYCQGPGPAPPPYLPPQQPSLPPPPQQPPPLPQLGSIPPPPASAPPVGPHRHFHAHGPVPGPQHYTLGRPGRAPRRGAGGHPQFAPHGRHPLHQPTSPLPLYSPAPQHPPAHKQGPKHFIFSHHPQMMPAAGAAGGPGSRPPGGSYSHPHHPQSPLSPHSPIPPHPSYPPLPPPSPHTPHSPLPPTSPHGPLHASGPPGTANPPSANPKAKPSRISTVV

SEQ ID NO: 41922 - protein, 759 aa, Homo sapiens
  Payload ID: 8525
  Gene Symbol: IQSEC3
  Gene Name: IQ motif and Sec7 domain 3
  Uniprot ID: Q9UPP2
  ENSP ID: ENSP00000372292
MLEHKYGGHLVSRRAACTIQTAFRQYQLSKNFEKIRNSLLESRLPRRISLRKVRSPTAESLAAEKALMEGYGLVGLPLVRSPSLPPTFAGTLTELEDSFTEQVQSLAKSIDDALSTWSLKTMCSLRESGAYQLHQALQAAAGPPGLEAEGRAPESAGPGPGDDAAETPGLPPAHSGTLMMAFRDVTVQIANQNISVSSSTALSVANCLGAQTVQAPAEPAAGKAEQGETSGREAPEAPAVGREDASAEDSCAEAAASGAADGATAPKTEEEEEEEETAEVGRGAEAEAGDLEQLSSSSTSTKSAKSGSEASASASKDALQAMILSLPRYHCENPASCKSPTLSTDTLRKRLYRIGLNLFNINPDKGIQFLISRGFIPDTPIGVAHFLLQRKGLSRQMIGEFLGNSKKQFNRDVLDCVVDEMDFSSMELDEALRKFQAHIRVQGEAQKVERLIEAFSQRYCMCNPEVVQQFHNPDTIFILAFAIILLNTDMYSPNIKPDRKMMLEDFIRNLRGVDDGADIPRELVVGIYERIQQKELKSNEDHVTYVTKVEKSIVGMKTVLSVPHRRLVCCSRLFEVTDVNKLQKQAAHQREVFLFNDLLVILKLCPKKKSSSTYTFCKSVGLLGMQFQLFENEYYSHGITLVTPLSGSEKKQVLHFCALGSDEMQKFVEDLKESIAEVTELEQIRIEWELEKQQGTKTLSFKPCGAQGDPQSKQGSPTAKREAALRERPAESTVEVLINASPARLTILPISRDTIKSYC

SEQ ID NO: 41923 - protein, 1182 aa, Homo sapiens
  Payload ID: 8525
  Gene Symbol: IQSEC3
  Gene Name: IQ motif and Sec7 domain 3
  Uniprot ID: Q9UPP2
  ENSP ID: ENSP00000437554
MESLLENPVRAVLYLKELTAIVQNQQSLIHTQRERIDELERRLDELSAENRSLWEHQQLLQAQPPPGLVPPSSAPLPAAPATAPAAAARAQEPLQDQGQRSAAAPHPAPDRPPRQHHGQLLEQPQRGPGSRAHTPQSPHKHLGTQGAVTDKEKERPPSCCAAAGALLQHKSPSALGKGVLSRRPENETVLHQFCCPAADACSDLASQSDGSCTQAGGGMEDSVVAAAAVAAGRPSAHAPKAQAQELQEEEERPGAGAASPRAGPQHKASPGRQQPALATALCPHAPAASDYELSLDLKNKQIEMLEHKYGGHLVSRRAACTIQTAFRQYQLSKNFEKIRNSLLESRLPRRISLRKVRSPTAESLAAEKALMEGYGLVGLPLVRSPSLPPTFAGTLTELEDSFTEQVQSLAKSIDDALSTWSLKTMCSLRESGAYQLHQALQAAAGPPGLEAEGRAPESAGPGPGDDAAETPGLPPAHSGTLMMAFRDVTVQIANQNISVSSSTALSVANCLGAQTVQAPAEPAAGKAEQGETSGREAPEAPAVGREDASAEDSCAEAAASGAADGATAPKTEEEEEEEETAEVGRGAEAEAGDLEQLSSSSTSTKSAKSGSEASASASKDALQAMILSLPRYHCENPASCKSPTLSTDTLRKRLYRIGLNLFNINPDKGIQFLISRGFIPDTPIGVAHFLLQRKGLSRQMIGEFLGNSKKQFNRDVLDCVVDEMDFSSMELDEALRKFQAHIRVQGEAQKVERLIEAFSQRYCMCNPEVVQQFHNPDTIFILAFAIILLNTDMYSPNIKPDRKMMLEDFIRNLRGVDDGADIPRELVVGIYERIQQKELKSNEDHVTYVTKVEKSIVGMKTVLSVPHRRLVCCSRLFEVTDVNKLQKQAAHQREVFLFNDLLVILKLCPKKKSSSTYTFCKSVGLLGMQFQLFENEYYSHGITLVTPLSGSEKKQVLHFCALGSDEMQKFVEDLKESIAEVTELEQIRIEWELEKQQGTKTLSFKPCGAQGDPQSKQGSPTAKREAALRERPAESTVEVSIHNRLQTSQHNSGLGAERGAPVPPPDLQPSPPRQQTPPLPPPPPTPPGTLVQCQQIVKVIVLDKPCLARMEPLLSQALSCYTSSSSDSCGSTPLGGPGSPVKVTHQPPLPPPPPPYNHPHQFCPPGSLLHGHRYSSGSRSLV

SEQ ID NO: 41924 - protein, 759 aa, Homo sapiens; identical to SEQ ID NO: 41922
  Payload ID: 8525
  Gene Symbol: IQSEC3
  Gene Name: IQ motif and Sec7 domain 3
  Uniprot ID: Q9UPP2
  ENSP ID: ENSP00000461043

SEQ ID NO: 41925 - protein, 1038 aa, Homo sapiens
  Payload ID: 8525
  Gene Symbol: IQSEC3
  Gene Name: IQ motif and Sec7 domain 3
  ENSP ID: ENSP00000461496
MESLLENPVRAVLYLKELTAIVQNQQSLIHTQRERIDELERRLDELSAENRSLWEHQQLLQAQPPPGLVPPSSAPLPAAPATAPAAAARAQEPLQDQGQRSAAAPHPAPDRPPRQHHGQLLEQPQRGPGSRAHTPQSPHKHLGTQGAVTDKEKERPPSCCAAAGALLQHKSPSALGKGVLSRRPENETVLHQFCCPAADACSDLASQSDGSCTQAGGGMEDSVVAAAAVAAGRPSAHAPKAQAQELQEEEERPGAGAASPRAGPQHKASPGRQQPALATALCPHAPAASDYELSLDLKNKQIEMLEHKYGGHLVSRRAACTIQTAFRQYQLSKNFEKIRNSLLESRLPRRISLRKVRSPTAESLAAEKALMEGYGLVGLPLVRSPSLPPTFAGTLTELEDSFTEQVQSLAKSIDDALSTWSLKTMCSLRESGAYQLHQALQAAAGPPGLEAEGRAPESAGPGPGDDAAETPGLPPAHSGTLMMAFRDVTVQIANQNISVSSSTALSVANCLGAQTVQAPAEPAAGKAEQGETSGREAPEAPAVGREDASAEDSCAEAAASGAADGATAPKTEEEEEEEETAEVGRGAEAEAGDLEQLSSSSTSTKSAKSGSEASASASKDALQAMILSLPRYHCENPASCKSPTLSTDTLRKRLYRIGLNLFNINPDKGIQFLISRGFIPDTPIGVAHFLLQRKGLSRQMIGEFLGNSKKQFNRDVLDCVVDEMDFSSMELDEALRKFQAHIRVQGEAQKVERLIEAFSQRYCMCNPEVVQQFHNPDTIFILAFAIILLNTDMYSPNIKPDRKMMLEDFIRNLRGVDDGADIPRELVVGIYERIQQKELKSNEDHVTYVTKVEKSIVGMKTVLSVPHRRLVCCSRLFEVTDVNKLQKQAAHQREVFLFNDLLVILKLCPKKKSSSTYTFCKSVGLLGMQFQLFENEYYSHGITLVTPLSGSEKKQVLHFCALGSDEMQKFVEDLKESIAEVTELEQIRIEWELEKQQGTKTLSFKPCGAQGDPQSKQGSPTAKREAALRERPAESTVE

SEQ ID NO: 41926 - protein, 791 aa, Homo sapiens
  Payload ID: 8526
  Gene Symbol: IQUB
  Gene Name: IQ motif and ubiquitin domain containing
  Uniprot ID: Q8NA54
  ENSP ID: ENSP00000324882
MSNQQEKYEAQNIVNSTEESDDAFDTVTIPVPSEEPQESDQTEEHESGIEQFSESHAIHVEEQSDQSFSSLEPDNEQLMEEVISPRQVSYTPQHHEKQYAMQRPNDDSLAFLDKIKSVKESLQESVEDSLATVKVVLIPVGQEIVIPFKVDTILKYLKDHFSHLLGIPHSVLQIRYSGKILKNNETLVQHGVKPQEIVQVEIFSTNPDLYPVRRIDGLTDVSQIITVTVQTGLDQYQQVPVEIVKSDFHKPFLGGFRHKVTGVEYHNAGTQTVPKRIPERLSIFCRDTQTVFQKKNLQQTTNTTSTQMTNIGVYVSNMTDKLVTPGKYFSAAEYHAQRLKAVIVIQTYYRQWHAKIFVENLRRQKSLRLEWETQQELRKIREKEEWIKLDYHRRHNPKTNEDFEFLYNALEFWRQEELTRINQSFTGAERKAALCELLEKETQIIASIGRHRYIAYMANQEAAIQAFLDKCSAPKIWRTPNGKTIEMDTQFTIRARELQNIYKCIMLKNISQDERLDVLLTLKHTVKEHECKLTQEILELIDREVDLMMRGVKHHNLEGLRKRIATLFFHYIKTPLFNPEVAKYLKVPQDPLKFYKKIYFCHSCQLYLPSTEFSVSSTSRRIYRCRNCINLQNEAQKRESFLKYKCLLQQLYYTEADYEDDSKIAFLMQLQDIQYLTENIWASQSVLSACDNLSDLVMVRWNKSLEWSPWNCILLTKDEAAAHLKLTSIEEGYERSFIHKIKHKHILAKNYFSQVPVLASFILDDGEIDEIRWKYHSDTTPKIIESQRPPH

SEQ ID NO: 41927 - protein, 596 aa, Homo sapiens
  Payload ID: 8526
  Gene Symbol: IQUB
  Gene Name: IQ motif and ubiquitin domain containing
  Uniprot ID: Q8NA54
  ENSP ID: ENSP00000417285
MSNQQEKYEAQNIVNSTEESDDAFDTVTIPVPSEEPQESDQTEEHESGIEQFSESHAIHVEEQSDQSFSSLEPDNEQLMEEVISPRQVSYTPQHHEKQYAMQRPNDDSLAFLDKIKSVKESLQESVEDSLATVKVVLIPVGQEIVIPFKVDTILKYLKDHFSHLLGIPHSVLQIRYSGKILKNNETLVQHGVKPQEIVQVEIFSTNPDLYPVRRIDGLTDVSQIITVTVQTGLDQYQQVPVEIVKSDFHKPFLGGFRHKVTGVEYHNAGTQTVPKRIPERLSIFCRDTQTVFQKKNLQQTTNTTSTQMTNIGVYVSNMTDKLVTPGKYFSAAEYHAQRLKAVIVIQTYYRQWHAKIFVENLRRQKSLRLEWETQQELRKIREKEEWIKLDYHRRHNPKTNEDFEFLYNALEFWRQEELTRINQSFTGAERKAALCELLEKETQIIASIGRHRYIAYMANQEAAIQAFLDKCSAPKIWRTPNGKTIEMDTQFTIRARELQNIYKCIMLKNISQDERLDVLLTLKHTVKEHECKLTQEILELIDREVDLMMRGVKHHNLEGLRKRIATLFFHYIKTPLFNPEVAKYLKMGGEYLSMAL

SEQ ID NO: 41928 - protein, 421 aa, Homo sapiens
  Payload ID: 8526
  Gene Symbol: IQUB
  Gene Name: IQ motif and ubiquitin domain containing
  ENSP ID: ENSP00000417636
MSNQQEKYEAQNIVNSTEESDDAFDTVTIPVPSEEPQESDQTEEHESGIEQFSESHAIHVEEQSDQSFSSLEPDNEQLMEEVISPRQVSYTPQHHEKQYAMQRPNDDSLAFLDKIKSVKESLQESVEDSLATVKVVLIPVGQEIVIPFKVDTILKYLKDHFSHLLGIPHSVLQIRYSGKILKNNETLVQHGVKPQEIVQVEIFSTNPDLYPVRRIDGLTDVSQIITVTVQTGLDQYQQVPVEIVKSDFHKPFLGGFRHKVTGVEYHNAGTQTVPKRIPERLSIFCRDTQTVFQKKNLQQTTNTTSTQMTNIGVYVSNMTDKLVTPGKYFSAAEYHAQRLKAVIVIQTYYRQWHAKIFVENLRRQKSLRLEWETQQELRKIREKEEWIKLDYHRRHNPKTNEDFEFLYNALELFSSKNMENP

SEQ ID NO: 41929 - protein, 791 aa, Homo sapiens; identical to SEQ ID NO: 41926
  Payload ID: 8526
  Gene Symbol: IQUB
  Gene Name: IQ motif and ubiquitin domain containing
  Uniprot ID: Q8NA54
  ENSP ID: ENSP00000417769

SEQ ID NO: 41930 - protein, 598 aa, Homo sapiens
  Payload ID: 8527
  Gene Symbol: IQCB1
  Gene Name: IQ motif containing B1
  Uniprot ID: Q15051
  ENSP ID: ENSP00000311505
MKPTGTDPRILSIAAEVAKSPEQNVPVILLKLKEIINITPLGSSELKKIKQDIYCYDLIQYCLLVLSQDYSRIQGGWTTISQLTQILSHCCVGLEPGEDAEEFYNELLPSAAENFLVLGRQLQTCFINAAKAEEKDELLHFFQIVTDSLFWLLGGHVELIQNVLQSDHFLHLLQADNVQIGSAVMMMLQNILQINSGDLLRIGRKALYSILDEVIFKLFSTPSPVIRSTATKLLLLMAESHQEILILLRQSTCYKGLRRLLSKQETGTEFSQELRQLVGLLSPMVYQEVEEQKLHQAACLIQAYWKGFQTRKRLKKLPSAVIALQRSFRSKRSKMLLEINRQKEEEDLKLQLQLQRQRAMRLSRELQLSMLEIVHPGQVEKHYREMEEKSALIIQKHWRGYRERKNFHQQRQSLIEYKAAVTLQRAALKFLAKCRKKKKLFAPWRGLQELTDARRVELKKRVDDYVRRHLGSPMSDVVSRELHAQAQERLQHYFMGRALEERAQQHREALIAQISTNVEQLMKAPSLKEAEGKEPELFLSRSRPVAAKAKQAHLTTLKHIQAPWWKKLGEESGDEIDVPKDELSIELENLFIGGTKPP

SEQ ID NO: 41931 - protein, 465 aa, Homo sapiens
  Payload ID: 8527
  Gene Symbol: IQCB1
  Gene Name: IQ motif containing B1
  Uniprot ID: Q15051
  ENSP ID: ENSP00000323756
MKPTGTDPRILSIAAEVAKSPEQNVPVILLKLKEIINITPLGSSELKKIKQDIYCYDLIQYCLLVLSQDYSRIQGGWTTISQLTQILSHCCVGLEPGEDAEEFYNELLPSAAENFLVLGRQLQTCFINAAKAEEKDELLHFFQIVTDSLFWLLGGHVELIQNVLQSDHFLHLLQADNVQIGSAVMMMLQNILQINRSKRSKMLLEINRQKEEEDLKLQLQLQRQRAMRLSRELQLSMLEIVHPGQVEKHYREMEEKSALIIQKHWRGYRERKNFHQQRQSLIEYKAAVTLQRAALKFLAKCRKKKKLFAPWRGLQELTDARRVELKKRVDDYVRRHLGSPMSDVVSRELHAQAQERLQHYFMGRALEERAQQHREALIAQISTNVEQLMKAPSLKEAEGKEPELFLSRSRPVAAKAKQAHLTTLKHIQAPWWKKLGEESGDEIDVPKDELSIELENLFIGGTKPP

SEQ ID NO: 41932 - protein, 303 aa, Homo sapiens
  Payload ID: 8527
  Gene Symbol: IQCB1
  Gene Name: IQ motif containing B1
  Uniprot ID: Q15051
  ENSP ID: ENSP00000377261
MKPTGTDPRILSIAAEVAKSPEQNVPVILLKLKEIINITPLGSSELKKIKQDIYCYDLIQYCLLVLSQDYSRIQGGWTTISQLTQILSHCCVGLEPGEDAEEFYNELLPSAAENFLVLGRQLQTCFINAAKAEEKDELLHFFQIVTDSLFWLLGGHVELIQNVLQSDHFLHLLQADNVQIGSAVMMMLQNILQINSGDLLRIGRKALYSILDEVIFKLFSTPSPVIRSTATKLLLLMAESHQEILILLRQSTCYKGLRRLLSKQETGTEFSQELRQLVGLLSPMVYQEVEEQIQTIKDVAGDK

SEQ ID NO: 41933 - protein, 84 aa, Homo sapiens
  Payload ID: 8527
  Gene Symbol: IQCB1
  Gene Name: IQ motif containing B1
  ENSP ID: ENSP00000417832
MMMLQNILQINSGDLLRIGRKALYSILDEVIFKLFSTPSPVIRSTATKLLLLMAESHQEILILLRQSTCYKGLRRLLSKQETGT

SEQ ID NO: 41934 - protein, 143 aa, Homo sapiens
  Payload ID: 8527
  Gene Symbol: IQCB1
  Gene Name: IQ motif containing B1
  ENSP ID: ENSP00000419168
MMMLQNILQINSGDLLRIGRKALYSILDEVIFKLFSTPSPVIRSTATKLLLLMAESHQEILILLRQSTCYKGLRRLLSKQETGTEFSQELRQLVGLLSPMVYQEVEEQKLHQAACLIQAYWKGFQTRKRLKKLPSAVIALQRS

SEQ ID NO: 41935 - protein, 87 aa, Homo sapiens
  Payload ID: 8527
  Gene Symbol: IQCB1
  Gene Name: IQ motif containing B1
  ENSP ID: ENSP00000419376
MKPTGTDPRILSIAAEVAKSPEQNVPVILLKLKEIINITPLGSSELKKIKQDIYCYDLIQYCLLVLSQDYSRIQGGWTTISQLTQIL

SEQ ID NO: 41936 - protein, 466 aa, Homo sapiens
  Payload ID: 8528
  Gene Symbol: IQCC
  Gene Name: IQ motif containing C
  Uniprot ID: Q4KMZ1
  ENSP ID: ENSP00000291358
MEPELLVRKVSALQACVRGFLVRRQFQSLRAEYEAIVREVEGDLGTLQWTEGRIPRPRFLPEKAKSHQTWKAGDRVANPEQGLWNHFPCEESEGEATWEEMVLKKSGESSANQGSLCRDHSSWLQMKQNRKPSQEKTRDTTRMENPEATDQRLPHSQPQLQELQYHRSHLAMELLWLQQAINSRKEYLLLKQTLRSPEAGPIREEPRVFLEHGEQACERDQSQPSAPLEDQSYRDRTTGELEQEDDSCHRVKSPHRSPGSLATTQKNIAGAKCREPCYSKSGPPSSIPSNSQALGDRLTKGPDDGRQTFGGTCLLQMKILEDQTPRGLKPRNHCPRKSRTQLSALYEDSNIKEMSPRKLDHKEPDCRTVRTQELGLSEDHIIWDGTLGGPEHSVLDLWRTKPPKGQAPTDRSSRDGTSNEPSHEGQKKQRTIPWRSKSPEILSSTKAGCTGEEQWRGRPWKTEPPG

SEQ ID NO: 41937 - protein, 546 aa, Homo sapiens
  Payload ID: 8528
  Gene Symbol: IQCC
  Gene Name: IQ motif containing C
  Uniprot ID: Q4KMZ1
  ENSP ID: ENSP00000442291
MEPELLVRKVSALQVRGRARGSQDFSFREIMGSRTWTSQRDATTFSPLTARQPLEIPAVPNRAEESWDPRTPCPARPHSHHTLAPDQGNGKSLKACVRGFLVRRQFQSLRAEYEAIVREVEGDLGTLQWTEGRIPRPRFLPEKAKSHQTWKAGDRVANPEQGLWNHFPCEESEGEATWEEMVLKKSGESSANQGSLCRDHSSWLQMKQNRKPSQEKTRDTTRMENPEATDQRLPHSQPQLQELQYHRSHLAMELLWLQQAINSRKEYLLLKQTLRSPEAGPIREEPRVFLEHGEQACERDQSQPSAPLEDQSYRDRTTGELEQEDDSCHRVKSPHRSPGSLATTQKNIAGAKCREPCYSKSGPPSSIPSNSQALGDRLTKGPDDGRQTFGGTCLLQMKILEDQTPRGLKPRNHCPRKSRTQLSALYEDSNIKEMSPRKLDHKEPDCRTVRTQELGLSEDHIIWDGTLGGPEHSVLDLWRTKPPKGQAPTDRSSRDGTSNEPSHEGQKKQRTIPWRSKSPEILSSTKAGCTGEEQWRGRPWKTEPPG

SEQ ID NO: 41938 - protein, 347 aa, Homo sapiens
  Payload ID: 8529
  Gene Symbol: IQCD
  Gene Name: IQ motif containing D
  Uniprot ID: Q96DY2
  ENSP ID: ENSP00000299732
MALDILAMAPLYQAPAINRIGPKTDPSKRPADPLKPLVLSRTKLTTIEAKRIMSILDEAIYKVELVTLLSYVASNREDMEGMLGEDVMRAVREHEDLCQVLLENVRCLKEKERQLQEQKEAEEEGWLRDRLLSIELQKSSLSPLMQQIKDSTKNVLRLLLSNPQAARLLQMQTQGRSAEAQNFIDSLIELRGFLFEKLLTSPMEARDKAQFLQDISRQNSNNQQIIDTLEKELAERMKNRNAEEELEDLDAVHREEKISLEELRRRHKVLVGEFAQIREEREINSKKRMEAEQEMVRMVRAATLIQALWKGYLVRSLLRSKKKRGKGKAKDKEKGKQKGKEKGKGKK

SEQ ID NO: 41939 - protein, 449 aa, Homo sapiens
  Payload ID: 8529
  Gene Symbol: IQCD
  Gene Name: IQ motif containing D
  Uniprot ID: Q96DY2
  ENSP ID: ENSP00000400669
MALDILAMAPLYQAPAINRIGPKTDPSKRPADPLKPLVLSRTKLTTIEAKRIMSILDEAIYKVELVTLLSYVASNREDMEGMLGEDVMRAVREHEDLCQVLLENVRCLKEKERQLQEQKEAEEEGWLRDRLLSIELQKSSLSPLMQQIKDSTKNVLRLLLSNPQAARLLQMQTQGRSAEAQNFIDSLIELRGFLFEKLLTSPMEARDKAQFLQDISRQNSNNQQIIDTLEKELAERMKNRNAEVEKENFVIQELKNHLHQVLKFSENSLVRTKQEAEKQQKADFRASQARVAKIQQEILQLQSQFYNLVMENREAEQALRKKKYKVETEIENWIQKYDTEMGEKQEELEDLDAVHREEKISLEELRRRHKVLVGEFAQIREEREINSKKRMEAEQEMVRMVRAATLIQALWKGYLVRSLLRSKKKRGKGKAKDKEKGKQKGKEKGKGKK

SEQ ID NO: 41940 - protein, 412 aa, Homo sapiens
  Payload ID: 8529
  Gene Symbol: IQCD
  Gene Name: IQ motif containing D
  ENSP ID: ENSP00000446623
MALDILAMAPLYQAPAINRIGPKTDPSKRPADPLKPLVLSRTKLTTIEAKRIMSILDEAIYKVELVTLLSYVASNREDMEGMLGEDVMRAVREHEDLCQVLLENVRCLKEKERQLQEQKEAEEEGWLRDRLLSIELQKSSLSPLMQQIKDSTKNVLRLLLSNPQAARLLQMQTQGRSAEAQNFIDSLIELRGFLFEKLLTSPMEARDKAQFLQDISRQNSNNQQIIDTLEKELAERMKNRNAEVEKENFVIQELKNHLHQVLKFSENSLVRTKQEAEKQQKADFRASQARVAKIQQEILQLQSQFYNLVMENREAEQALRKVPREAARMGRGGPWWGGWVGLFHHSWRSSSVGQGRTAPATQEVAWWRGRAQEQGRPKSKPVSPGRQEGAAHRPGDRGQTGILSQHCCMPAL

SEQ ID NO: 41941 - protein, 630 aa, Homo sapiens
  Payload ID: 8530
  Gene Symbol: IQCE
  Gene Name: IQ motif containing E
  Uniprot ID: Q6IPM2
  ENSP ID: ENSP00000313772
MPLGGRASLTPQKLWLGTAKPGSLTQALNSPLTWEHAWTGVPGGTPDCLTDTFRVKRPHLRRSASNGHVPGTPVYREKEDMYDEIIELKKSLHVQKSDVDLMRTKLRRLEEENSRKDRQIEQLLDPSRGTDFVRTLAEKRPDASWVINGLKQRILKLEQQCKEKDGTISKLQTDMKTTNLEEMRIAMETYYEEVHRLQTLLASSETTGKKPLGEKKTGAKRQKKMGSALLSLSRSVQELTEENQSLKEDLDRVLSTSPTISKTQGYVEWSKPRLLRRIVELEKKLSVMESSKSHAAEPVRSHPPACLASSSALHRQPRGDRNKDHERLRGAVRDLKEERTALQEQLLQRDLEVKQLLQAKADLEKELECAREGEEERREREEVLREEIQTLTSKLQELQEMKKEEKEDCPEVPHKAQELPAPTPSSRHCEQDWPPDSSEEGLPRPRSPCSDGRRDAAARVLQAQWKVYKHKKKKAVLDEAAVVLQAAFRGHLTRTKLLASKAHGSEPPSVPGLPDQSSPVPRVPSPIAQATGSPVQEEAIVIIQSALRAHLARARHSATGKRTTTAASTRRRSASATHGDASSPPFLAALPDPSPSGPQALAPLPGDDVNSDDSDDIVIAPSLPTKNFPV

SEQ ID NO: 41942 - protein, 42 aa, Homo sapiens
  Payload ID: 8530
  Gene Symbol: IQCE
  Gene Name: IQ motif containing E
  ENSP ID: ENSP00000314011
MFLGTGEPALDTSHLISLSREKWPPGGPSGRQGACLWAAERP

SEQ ID NO: 41943 - protein, 695 aa, Homo sapiens
  Payload ID: 8530
  Gene Symbol: IQCE
  Gene Name: IQ motif containing E
  Uniprot ID: Q6IPM2
  ENSP ID: ENSP00000385597
MFLGTGEPALDTGDDSLSAVTFDSDVETKAKRKAFHKPPPTSPKSPYLSKPRKVASWRSLRTAGSMPLGGRASLTPQKLWLGTAKPGSLTQALNSPLTWEHAWTGVPGGTPDCLTDTFRVKRPHLRRSASNGHVPGTPVYREKEDMYDEIIELKKSLHVQKSDVDLMRTKLRRLEEENSRKDRQIEQLLDPSRGTDFVRTLAEKRPDASWVINGLKQRILKLEQQCKEKDGTISKLQTDMKTTNLEEMRIAMETYYEEVHRLQTLLASSETTGKKPLGEKKTGAKRQKKMGSALLSLSRSVQELTEENQSLKEDLDRVLSTSPTISKTQGYVEWSKPRLLRRIVELEKKLSVMESSKSHAAEPVRSHPPACLASSSALHRQPRGDRNKDHERLRGAVRDLKEERTALQEQLLQRDLEVKQLLQAKADLEKELECAREGEEERREREEVLREEIQTLTSKLQELQEMKKEEKEDCPEVPHKAQELPAPTPSSRHCEQDWPPDSSEEGLPRPRSPCSDGRRDAAARVLQAQWKVYKHKKKKAVLDEAAVVLQAAFRGHLTRTKLLASKAHGSEPPSVPGLPDQSSPVPRVPSPIAQATGSPVQEEAIVIIQSALRAHLARARHSATGKRTTTAASTRRRSASATHGDASSPPFLAALPDPSPSGPQALAPLPGDDVNSDDSDDIVIAPSLPTKNFPV

SEQ ID NO: 41944 - protein, 644 aa, Homo sapiens
  Payload ID: 8530
  Gene Symbol: IQCE
  Gene Name: IQ motif containing E
  Uniprot ID: Q6IPM2
  ENSP ID: ENSP00000385945
MFLGTGEPALDTSHLISLSRASLTPQKLWLGTAKPGSLTQALNSPLTWEHAWTGVPGGTPDCLTDTFRVKRPHLRRSASNGHVPGTPVYREKEDMYDEIIELKKSLHVQKSDVDLMRTKLRRLEEENSRKDRQIEQLLDPSRGTDFVRTLAEKRPDASWVINGLKQRILKLEQQCKEKDGTISKLQTDMKTTNLEEMRIAMETYYEEVHRLQTLLASSETTGKKPLGEKKTGAKRQKKMGSALLSLSRSVQELTEENQSLKEDLDRVLSTSPTISKTQGYVEWSKPRLLRRIVELEKKLSVMESSKSHAAEPVRSHPPACLASSSALHRQPRGDRNKDHERLRGAVRDLKEERTALQEQLLQRDLEVKQLLQAKADLEKELECAREGEEERREREEVLREEIQTLTSKLQELQEMKKEEKEDCPEVPHKAQELPAPTPSSRHCEQDWPPDSSEEGLPRPRSPCSDGRRDAAARVLQAQWKVYKHKKKKAVLDEAAVVLQAAFRGHLTRTKLLASKAHGSEPPSVPGLPDQSSPVPRVPSPIAQATGSPVQEEAIVIIQSALRAHLARARHSATGKRTTTAASTRRRSASATHGDASSPPFLAALPDPSPSGPQALAPLPGDDVNSDDSDDIVIAPSLPTKNFPV

SEQ ID NO: 41945 - protein, 679 aa, Homo sapiens
  Payload ID: 8530
  Gene Symbol: IQCE
  Gene Name: IQ motif containing E
  Uniprot ID: Q6IPM2
  ENSP ID: ENSP00000396178
MFLGTGEPALDTKAKRKAFHKPPPTSPKSPYLSKPRKVASWRSLRTAGSMPLGGRASLTPQKLWLGTAKPGSLTQALNSPLTWEHAWTGVPGGTPDCLTDTFRVKRPHLRRSASNGHVPGTPVYREKEDMYDEIIELKKSLHVQKSDVDLMRTKLRRLEEENSRKDRQIEQLLDPSRGTDFVRTLAEKRPDASWVINGLKQRILKLEQQCKEKDGTISKLQTDMKTTNLEEMRIAMETYYEEVHRLQTLLASSETTGKKPLGEKKTGAKRQKKMGSALLSLSRSVQELTEENQSLKEDLDRVLSTSPTISKTQGYVEWSKPRLLRRIVELEKKLSVMESSKSHAAEPVRSHPPACLASSSALHRQPRGDRNKDHERLRGAVRDLKEERTALQEQLLQRDLEVKQLLQAKADLEKELECAREGEEERREREEVLREEIQTLTSKLQELQEMKKEEKEDCPEVPHKAQELPAPTPSSRHCEQDWPPDSSEEGLPRPRSPCSDGRRDAAARVLQAQWKVYKHKKKKAVLDEAAVVLQAAFRGHLTRTKLLASKAHGSEPPSVPGLPDQSSPVPRVPSPIAQATGSPVQEEAIVIIQSALRAHLARARHSATGKRTTTAASTRRRSASATHGDASSPPFLAALPDPSPSGPQALAPLPGDDVNSDDSDDIVIAPSLPTKNFPV

SEQ ID NO: 41946 - protein, 128 aa, Homo sapiens
  Payload ID: 8530
  Gene Symbol: IQCE
  Gene Name: IQ motif containing E
  ENSP ID: ENSP00000402108
MPLGGRASLTPQKLWLGTAKPGSLTQALNSPLTWEHAWTGVPGGTPDCLTDTFRVKRPHLRRSASNGHVPGTPVYREKEDMYDEIIELKKSLHVQKSDVDLMRTKLRRLEEENSRKDRQIEQLLDPSR

SEQ ID NO: 41947 - protein, 246 aa, Homo sapiens
  Payload ID: 8530
  Gene Symbol: IQCE
  Gene Name: IQ motif containing E
  ENSP ID: ENSP00000404643
MFLGTGEPALDTGDDSLSAVTFDSDVETKAKRKAFHKPPPTSPKSPYLSKPRKVASWRSLRTAGSMPLGGRASLTPQKLWLGTAKPGSLTQALNSPLTWEHAWTGVPGGTPDCLTDTFRVKRPHLRRSASNVSFFLETESRCVAQAGLKFLDSSDPLTLASQNPGITGHVPGTPVYREKEDMYDEIIELKKSLHVQKSDVDLMRTKLRRLEEENSRKDRQIEQLLDPSRGTDFVRTLAEKRPDASW

SEQ ID NO: 41948 - protein, 269 aa, Homo sapiens
  Payload ID: 8530
  Gene Symbol: IQCE
  Gene Name: IQ motif containing E
  ENSP ID: ENSP00000405982
MLRCADTQVTILGRLHSQVPRNRRQGTQGHAGAARRPGGGRVVRKTWARAFIMRRRGRGEAQELPAPTPSSRHCEQDWPPDSSEEGLPRPRSPCSDGRRDAAARVLQAQWKVYKHKKKKAVLDEAAVVLQAAFRGHLTRTKLLASKAHGSEPPSVPGLPDQSSPVPRVPSPIAQATGSPVQEEAIVIIQSALRAHLARARHSATGKRTTTAASTRRRSASATHGDASSPPFLAALPGNFIHLDSGTRAAGLLRSQPKSGHLQEARAVSG

SEQ ID NO: 41949 - protein, 128 aa, Homo sapiens; identical to SEQ ID NO: 41946
  Payload ID: 8530
  Gene Symbol: IQCE
  Gene Name: IQ motif containing E
  ENSP ID: ENSP00000413570

SEQ ID NO: 41950 - protein, 193 aa, Homo sapiens
  Payload ID: 8530
  Gene Symbol: IQCE
  Gene Name: IQ motif containing E
  ENSP ID: ENSP00000415261
KNIRILSPLSKTFTEKEVINGLKQRILKLEQQCKEKDGTISKLQTDMKTTNLEEMRIAMETYYEEVHRLQTLLASSETTGKKPLGEKKTGAKRQKKMGSALLSLSRSVQELTEENQSLKEDLDRVLSTSPTISKTQGYVEWSKPRLLRRIVELEKKLSVMESSKSHAAEPVRSHPPACLASSSALHRQPRGDR

SEQ ID NO: 41951 - protein, 686 aa, Homo sapiens
  Payload ID: 8530
  Gene Symbol: IQCE
  Gene Name: IQ motif containing E
  ENSP ID: ENSP00000480668
MFLGTGEPALDTKAKRKAFHKPPPTSPKSPYLSKPRKVASWRSLRTAGSMPLGGRASLTPQKLWLGTAKPGSLTQALNSPLTWEHAWTGVPGGTPDCLTDTFRVKRPHLRRSASNGHVPGTPVYREKEDMYDEIIELKKSLHVQKSDVDLMRTKLRRLEEENSRKDRQIEQLLDPSRGTDFVRTLAEKRPDASWVINGLKQRILKLEQQCKEKDGTISKLQTDMKTTNLEEMRIAMETYYEEVHRLQTLLASSETTGKKPLGEKKTGAKRQKKMGSALLSLSRSVQELTEENQSLKEDLDRVLSTSPTISKTQGYVEWSKPRLLRRIVELEKKLSVMESSKSHAAEPVRSHPPACLASSSALHRQPRGDRNKDHERLRGAVRDLKEERTALQEQLLQRDLEVKQLLQAKADLEKELECAREGEEERREREEVLREEIQTLTSKLQELQEMKKEEKEDCPEVPHKAQELPAPTPSSRHCEQDWPPDSSEEGLPRPRSPCSDGRRDAAARVLQAQWKVYKHKKKKAVLDEAAVVLQAAFRGHLTRTKLLASKAHGSEPPSVPGLPDQSSPVPRVPSPIAQATGSPVQEEAIVIIQSALRAHLARARHSATGKRTTTAASTRRRSASATHGDASSPPFLAALPGNFIHLDSGTRAAGLLRSQPKSGHLQEARAVSGRKGGVSHLELPLN

SEQ ID NO: 41952 - protein, 702 aa, Homo sapiens
  Payload ID: 8530
  Gene Symbol: IQCE
  Gene Name: IQ motif containing E
  ENSP ID: ENSP00000480715
MFLGTGEPALDTGDDSLSAVTFDSDVETKAKRKAFHKPPPTSPKSPYLSKPRKVASWRSLRTAGSMPLGGRASLTPQKLWLGTAKPGSLTQALNSPLTWEHAWTGVPGGTPDCLTDTFRVKRPHLRRSASNGHVPGTPVYREKEDMYDEIIELKKSLHVQKSDVDLMRTKLRRLEEENSRKDRQIEQLLDPSRGTDFVRTLAEKRPDASWVINGLKQRILKLEQQCKEKDGTISKLQTDMKTTNLEEMRIAMETYYEEVHRLQTLLASSETTGKKPLGEKKTGAKRQKKMGSALLSLSRSVQELTEENQSLKEDLDRVLSTSPTISKTQGYVEWSKPRLLRRIVELEKKLSVMESSKSHAAEPVRSHPPACLASSSALHRQPRGDRNKDHERLRGAVRDLKEERTALQEQLLQRDLEVKQLLQAKADLEKELECAREGEEERREREEVLREEIQTLTSKLQELQEMKKEEKEDCPEVPHKAQELPAPTPSSRHCEQDWPPDSSEEGLPRPRSPCSDGRRDAAARVLQAQWKVYKHKKKKAVLDEAAVVLQAAFRGHLTRTKLLASKAHGSEPPSVPGLPDQSSPVPRVPSPIAQATGSPVQEEAIVIIQSALRAHLARARHSATGKRTTTAASTRRRSASATHGDASSPPFLAALPGNFIHLDSGTRAAGLLRSQPKSGHLQEARAVSGRKGGVSHLELPLN

SEQ ID NO: 41953 - protein, 630 aa, Homo sapiens; identical to SEQ ID NO: 41941
  Payload ID: 8530
  Gene Symbol: IQCE
  Gene Name: IQ motif containing E
  Uniprot ID: Q6IPM2
  ENSP ID: ENSP00000485601

SEQ ID NO: 41954 - protein, 205 aa, Homo sapiens
  Payload ID: 8531
  Gene Symbol: IQCF1
  Gene Name: IQ motif containing F1
  Uniprot ID: Q8N6M8
  ENSP ID: ENSP00000307958
MEEKQPQKTKEPSKEDEPQQKEMPTHLSLGAESKAEAKTPVLVETQTVDNANEKSEKPPENQKKLSDKDTVATKIQAWWRGTLVRRALLHAALSACIIQCWWRLILSKILKKRRQAALEAFSRKEWAAVTLQSQARMWRIRRRYCQVLNAVRIIQAYWRCRSCASRGFIKGQYRVTANQLHLQLEILLDSGPCIVTECIPFSIKE

SEQ ID NO: 41955 - protein, 42 aa, Homo sapiens
  Payload ID: 8531
  Gene Symbol: IQCF1
  Gene Name: IQ motif containing F1
  ENSP ID: ENSP00000317715
MEEKQPQKTKEPSKEDEPQQKEMPTHLSLGAESKAEQGKVLL

SEQ ID NO: 41956 - protein, 164 aa, Homo sapiens
  Payload ID: 8532
  Gene Symbol: IQCF2
  Gene Name: IQ motif containing F2
  Uniprot ID: Q8IXL9
  ENSP ID: ENSP00000329904
MRVRFCTKGNLILVIIEDVEESIEWKTLQKKKQQKIKEKLRIRTKAAVKIQAWWRGTLVRRTLLHAALRAWIIQCWWRMTLSRVLEKKRQAALIAYATRERAVIKLQSLVRMWRVRWRYCQVLNAIYIIQGHWQCHNCQTCALLQGHCVVTATHLQFHIEIINS

SEQ ID NO: 41957 - protein, 154 aa, Homo sapiens
  Payload ID: 8533
  Gene Symbol: IQCF3
  Gene Name: IQ motif containing F3
  Uniprot ID: P0C7M6
  ENSP ID: ENSP00000401767
MGSKCCKGGPDEDAVERQRRQKLLLAQLHHRKRVKAAGQIQAWWRGVLVRRTLLVAALRAWMIQCWWRTLVQRRIRQRRQALLRVYVIQEQATVKLQSCIRMWQCRQCYRQMCNALCLFQVPESSLAFQTDGFLQVQYAIPSKQPEFHIEILSI

SEQ ID NO: 41958 - protein, 154 aa, Homo sapiens; identical to SEQ ID NO: 41957
  Payload ID: 8533
  Gene Symbol: IQCF3
  Gene Name: IQ motif containing F3
  Uniprot ID: P0C7M6
  ENSP ID: ENSP00000402012

SEQ ID NO: 41959 - protein, 93 aa, Homo sapiens
  Payload ID: 8533
  Gene Symbol: IQCF3
  Gene Name: IQ motif containing F3
  ENSP ID: ENSP00000402530
MGSKCCKGGPDEDAVERQRRQKGLDDSVLVEDVGAETDPSAAAGPVEGLRHPGAGDGQAPVLHPHVAVPAMLPPNVQCSLLVPGPREQPCLPD

SEQ ID NO: 41960 - protein, 154 aa, Homo sapiens; identical to SEQ ID NO: 41957
  Payload ID: 8533
  Gene Symbol: IQCF3
  Gene Name: IQ motif containing F3
  Uniprot ID: P0C7M6
  ENSP ID: ENSP00000409373

SEQ ID NO: 41961 - protein, 154 aa, Homo sapiens; identical to SEQ ID NO: 41957
  Payload ID: 8533
  Gene Symbol: IQCF3
  Gene Name: IQ motif containing F3
  Uniprot ID: P0C7M6
  ENSP ID: ENSP00000415609

SEQ ID NO: 41962 - protein, 148 aa, Homo sapiens
  Payload ID: 8534
  Gene Symbol: IQCF5
  Gene Name: IQ motif containing F5
  Uniprot ID: A8MTL0
  ENSP ID: ENSP00000394653
MGPEEKTIMTERSAAVFIQAWWRGMLVRRTLLHAALRAWIIQCWWRQVLEKLLAKRRRMVLEFYVQQEWAAVRLQSWVRMWCVRQRYCRLLNAVRIIQVYWRWHSCHSRVFIEGHYELKENQLNIQLEISLGLQACKVQQCIPLPLKE

SEQ ID NO: 41963 - protein, 107 aa, Homo sapiens
  Payload ID: 8535
  Gene Symbol: IQCF6
  Gene Name: IQ motif containing F6
  Uniprot ID: A8MYZ5
  ENSP ID: ENSP00000381760
MVRRTLLQAALRAWVIQCWWRSMQAKMLEQRRRLALRLYTCQEWAVVKVQAQVRMWQARRRFLQARQAACIIQSHWRWHASQTRGLIRGHYEVRASRLELDIEILMT

SEQ ID NO: 41964 - protein, 443 aa, Homo sapiens
  Payload ID: 8536
  Gene Symbol: IQCG
  Gene Name: IQ motif containing G
  Uniprot ID: Q9H095
  ENSP ID: ENSP00000265239
MEEDSLEDSNLPPKVWHSEMTVSVTGEPPSTVEEEGIPKETDIEIIPEIPETLEPLSLPDVLRISAVLEDTTDQLSILNYIMPVQYEGRQSICVKSREMNLEGTNLDKLPMASTITKIPSPLITEEGPNLPEIRHRGRFAVEFNKMQDLVFKKPTRQTIMTTETLKKIQIDRQFFSDVIADTIKELQDSATYNSLLQALSKERENKMHFYDIIAREEKGRKQIISLQKQLINVKKEWQFEVQSQNEYIANLKDQLQEMKAKSNLENRYMKTNTELQIAQTQKKCNRTEELLVEEIEKLRMKTEEEARTHTEIEMFLRKEQQKLEERLEFWMEKYDKDTEMKQNELNALKATKASDLAHLQDLAKMIREYEQVIIEDRIEKERSKKKVKQDLLELKSVIKLQAWWRGTMIRREIGGFKMPKDKVDSKDSKGKGKGKDKRRGKKK

SEQ ID NO: 41965 - protein, 310 aa, Homo sapiens
  Payload ID: 8536
  Gene Symbol: IQCG
  Gene Name: IQ motif containing G
  ENSP ID: ENSP00000389897
MEEDSLEDSNLPPKVWHSEMTVSVTGEPPSTVEEEGIPKETDIEIIPEIPETLEPLSLPDVLRISAVLEDTTDQLSILNYIMPVQYEGRQSICVKSREMNLEGTNLDKLPMASTITKIPSPLITEEGPNLPEIRHRGRFAVEFNKMQDLVFKKPTRQTIMTTETLKKIQIDRQFFSDVIADTIKELQDSATYNSLLQALSKERENKMHFYDIIAREEKGRKQIISLQKQLINVKKEWQFEVQSQNEYIANLKDQLQEMKAKSNLENRYMKTNTELQIAQTQKKCNRTEELLVEEIEVIPGTLAKNPGDGN

SEQ ID NO: 41966 - protein, 54 aa, Homo sapiens
  Payload ID: 8536
  Gene Symbol: IQCG
  Gene Name: IQ motif containing G
  ENSP ID: ENSP00000393743
MEEDSLEDSNLPPKVWHSEMTVSVTGEPPSTVEEEGIPKETDIEIIPEIPETLE

SEQ ID NO: 41967 - protein, 198 aa, Homo sapiens
  Payload ID: 8536
  Gene Symbol: IQCG
  Gene Name: IQ motif containing G
  ENSP ID: ENSP00000406411
MTVSVTGEPPSTVEEEGIPKETDIEIIPEIPETLEPLSLPDVLRISAVLEDTTDQLSILNYIMPVQYEGRQSICVKSREMNLEGTNLDKLPMASTITKIPSPLITEEGPNLPEIRHRGRFAVEFNKMQDLVFKKPTRQTIMTTETLKKIQIDRQFFSDVIADTIKELQDSATYNSLLQALSKERENKMHFYDIIAREE

SEQ ID NO: 41968 - protein, 443 aa, Homo sapiens; identical to SEQ ID NO: 41964
  Payload ID: 8536
  Gene Symbol: IQCG
  Gene Name: IQ motif containing G
  Uniprot ID: Q9H095
  ENSP ID: ENSP00000407736

SEQ ID NO: 41969 - protein, 1657 aa, Homo sapiens
  Payload ID: 8537
  Gene Symbol: IQGAP1
  Gene Name: IQ motif containing GTPase activating protein 1
  Uniprot ID: P46940
  ENSP ID: ENSP00000268182
MSAADEVDGLGVARPHYGSVLDNERLTAEEMDERRRQNVAYEYLCHLEEAKRWMEACLGEDLPPTTELEEGLRNGVYLAKLGNFFSPKVVSLKKIYDREQTRYKATGLHFRHTDNVIQWLNAMDEIGLPKIFYPETTDIYDRKNMPRCIYCIHALSLYLFKLGLAPQIQDLYGKVDFTEEEINNMKTELEKYGIQMPAFSKIGGILANELSVDEAALHAAVIAINEAIDRRIPADTFAALKNPNAMLVNLEEPLASTYQDILYQAKQDKMTNAKNRTENSERERDVYEELLTQAEIQGNINKVNTFSALANIDLALEQGDALALFRALQSPALGLRGLQQQNSDWYLKQLLSDKQQKRQSGQTDPLQKEELQSGVDAANSAAQQYQRRLAAVALINAAIQKGVAEKTVLELMNPEAQLPQVYPFAADLYQKELATLQRQSPEHNLTHPELSVAVEMLSSVALINRALESGDVNTVWKQLSSSVTGLTNIEEENCQRYLDELMKLKAQAHAENNEFITWNDIQACVDHVNLVVQEEHERILAIGLINEALDEGDAQKTLQALQIPAAKLEGVLAEVAQHYQDTLIRAKREKAQEIQDESAVLWLDEIQGGIWQSNKDTQEAQKFALGIFAINEAVESGDVGKTLSALRSPDVGLYGVIPECGETYHSDLAEAKKKKLAVGDNNSKWVKHWVKGGYYYYHNLETQEGGWDEPPNFVQNSMQLSREEIQSSISGVTAAYNREQLWLANEGLITRLQARCRGYLVRQEFRSRMNFLKKQIPAITCIQSQWRGYKQKKAYQDRLAYLRSHKDEVVKIQSLARMHQARKRYRDRLQYFRDHINDIIKIQAFIRANKARDDYKTLINAEDPPMVVVRKFVHLLDQSDQDFQEELDLMKMREEVITLIRSNQQLENDLNLMDIKIGLLVKNKITLQDVVSHSKKLTKKNKEQLSDMMMINKQKGGLKALSKEKREKLEAYQHLFYLLQTNPTYLAKLIFQMPQNKSTKFMDSVIFTLYNYASNQREEYLLLRLFKTALQEEIKSKVDQIQEIVTGNPTVIKMVVSFNRGARGQNALRQILAPVVKEIMDDKSLNIKTDPVDIYKSWVNQMESQTGEASKLPYDVTPEQALAHEEVKTRLDSSIRNMRAVTDKFLSAIVSSVDKIPYGMRFIAKVLKDSLHEKFPDAGEDELLKIIGNLLYYRYMNPAIVAPDAFDIIDLSAGGQLTTDQRRNLGSIAKMLQHAASNKMFLGDNAHLSIINEYLSQSYQKFRRFFQTACDVPELQDKFNVDEYSDLVTLTKPVIYISIGEIINTHTLLLDHQDAIAPEHNDPIHELLDDLGEVPTIESLIGESSGNLNDPNKEALAKTEVSLTLTNKFDVPGDENAEMDARTILLNTKRLIVDVIRFQPGETLTEILETPATSEQEAEHQRAMQRRAIRDAKTPDKMKKSKSVKEDSNLTLQEKKEKIQTGLKKLTELGTVDPKNKYQELINDIARDIRNQRRYRQRRKAELVKLQQTYAALNSKATFYGEQVDYYKSYIKTCLDNLASKGKVSKKPREMKGKKSKKISLKYTAARLHEKGVLLEIEDLQVNQFKNVIFEISPTEEVGDFEVKAKFMGVQMETFMLHYQDLLQLQYEGVAVMKLFDRAKVNVNLLIFLLNKKFYGK

SEQ ID NO: 41970 - protein, 43 aa, Homo sapiens
  Payload ID: 8537
  Gene Symbol: IQGAP1
  Gene Name: IQ motif containing GTPase activating protein 1
  ENSP ID: ENSP00000452723
MPRCIYCIHALSLYLFKLGLAPQIQDLYGKVDFTEEEINNMKT

SEQ ID NO: 41971 - protein, 1085 aa, Homo sapiens
  Payload ID: 8537
  Gene Symbol: IQGAP1
  Gene Name: IQ motif containing GTPase activating protein 1
  ENSP ID: ENSP00000453181
MSAADEVDGLGVARPHYGSVLDNERLTAEEMDERRRGIWQSNKDTQEAQKFALGIFAINEAVESGDVGKTLSALRSPDVGLYGVIPECGETYHSDLAEAKKKKLAVGDNNSKWVKHWVKGGYYYYHNLETQEGGWDEPPNFVQNSMQLSREEIQSSISGVTAAYNREQLWLANEGLITRLQARCRGYLVRQEFRSRMNFLKKQIPAITCIQSQWRGYKQKKAYQDRLAYLRSHKDEVVKIQSLARMHQARKRYRDRLQYFRDHINDIIKIQAFIRANKARDDYKTLINAEDPPMVVVRKFVHLLDQSDQDFQEELDLMKMREEVITLIRSNQQLENDLNLMDIKIGLLVKNKITLQDVVSHSKKLTKKNKEQLSDMMMINKQKGGLKALSKEKREKLEAYQHLFYLLQTNPTYLAKLIFQMPQNKSTKFMDSVIFTLYNYASNQREEYLLLRLFKTALQEEIKSKVDQIQEIVTGNPTVIKMVVSFNRGARGQNALRQILAPVVKEIMDDKSLNIKTDPVDIYKSWVNQMESQTGEASKLPYDVTPEQALAHEEVKTRLDSSIRNMRAVTDKFLSAIVSSVDKIPYGMRFIAKVLKDSLHEKFPDAGEDELLKIIGNLLYYRYMNPAIVAPDAFDIIDLSAGGQLTTDQRRNLGSIAKMLQHAASNKMFLGDNAHLSIINEYLSQSYQKFRRFFQTACDVPELQDKFNVDEYSDLVTLTKPVIYISIGEIINTHTLLLDHQDAIAPEHNDPIHELLDDLGEVPTIESLIGESSGNLNDPNKEALAKTEVSLTLTNKFDVPGDENAEMDARTILLNTKRLIVDVIRFQPGETLTEILETPATSEQEAEHQRAMQRRAIRDAKTPDKMKKSKSVKEDSNLTLQEKKEKIQTGLKKLTELGTVDPKNKYQELINDIARDIRNQRRYRQRRKAELVKLQQTYAALNSKATFYGEQVDYYKSYIKTCLDNLASKGKVSKKPREMKGKKSKKISLKYTAARLHEKGVLLEIEDLQVNQFKNVIFEISPTEEVGDFEVKAKFMGVQMETFMLHYQDLLQLQYEGVAVMKLFDRAKVNVNLLIFLLNKKFYGK

SEQ ID NO: 41972 - protein, 107 aa, Homo sapiens
  Payload ID: 8537
  Gene Symbol: IQGAP1
  Gene Name: IQ motif containing GTPase activating protein 1
  ENSP ID: ENSP00000480393
VKGGYYYYHNLETQEGGWDEPPNFVQNSMQLSREEIQSSISGVTAAYNREQLWLANEGLITRLQARCRGYLVRQEFRSRMNFLKKQIPAITCIQVFQNLSHRQQAGI

SEQ ID NO: 41973 - protein, 48 aa, Homo sapiens
  Payload ID: 8537
  Gene Symbol: IQGAP1
  Gene Name: IQ motif containing GTPase activating protein 1
  ENSP ID: ENSP00000484647
  MOD_RES (1)..(1): Any amino acid
XEVDGLGVARPHYGSVLDNERLTAEEMDERRRQNVAYEYLCHLEEAKR

SEQ ID NO: 41974 - protein, 1191 aa, Homo sapiens
  Payload ID: 8537
  Gene Symbol: IQGAP1
  Gene Name: IQ motif containing GTPase activating protein 1
  ENSP ID: ENSP00000488618
MSAADEVDGLGVARPHYGSVLDNERLTAEEMDERRRQNVAYEYLCHLEEAKRWMEACLGEDLPPTTELEEGLRNGVYLAKLGNFFSPKVVSLKKIYDREQTRYKATGLHFRHTDNVIQWLNAMDEIGLPKIFYPETTDIYDRKNMPRCIYCIHALSLYLFKLGLAPQIQDLYGKVDFTEEEINNMKTELEKYGIQMPAFSKIGGILANELSVDEAALHAAVIAINEAIDRRIPADTFAALKNPNAMLVNLEEPLASTYQDILYQAKQDKMTNAKNRTENSERERDVYEELLTQAEIQGNINKVNTFSALANIDLALEQGDALALFRALQSPALGLRGLQQQNSDWYLKQLLSDKQQKRQSGQTDPLQKEELQSGVDAANSAAQQYQRRLAAVALINAAIQKGVAEKTVLELMNPEAQLPQVYPFAADLYQKELATLQRQSPEHNLTHPELSVAVEMLSSVALINRALESGDVNTVWKQLSSSVTGLTNIEEENCQRYLDELMKLKAQAHAENNEFITWNDIQACVDHVNLVVQEEHERILAIGLINEALDEGDAQKTLQALQIPAAKLEGVLAEVAQHYQDTLIRAKREKAQEIQDESAVLWLDEIQGGIWQSNKDTQEAQKFALGIFAINEAVESGDVGKTLSALRSPDVGLYGVIPECGETYHSDLAEAKKKKLAVGDNNSKWVKHWVKGGYYYYHNLETQEGGWDEPPNFVQNSMQLSREEIQSSISGVTAAYNREQLWLANEGLITRLQARCRGYLVRQEFRSRMNFLKKQIPAITCIQSQWRGYKQKKAYQDRLAYLRSHKDEVVKIQSLARMHQARKRYRDRLQYFRDHINDIIKIQAFIRANKARDDYKTLINAEDPPMVVVRKFVHLLDQSDQDFQEELDLMKMREEVITLIRSNQQLENDLNLMDIKIGLLVKNKITLQDVVSHSKKLTKKNKEQLSDMMMINKQKGGLKALSKEKREKLEAYQHLFYLLQTNPTYLAKLIFQMPQNKSTKFMDSVIFTLYNYASNQREEYLLLRLFKTALQEEIKSKVDQIQEIVTGNPTVIKMVVSFNRGARGQNALRQILAPVVKEIMDDKSLNIKTDPVDIYKSWVNQMESQTGEASKLPYDVTPEQALAHEEVKTRLDSSIRNMRAVTDKFLSAIVSSVDKIPYGMRFIAKVLKDSLHEKFPDAGEDELLKFCAFLQ

SEQ ID NO: 41975 - protein, 1575 aa, Homo sapiens
  Payload ID: 8538
  Gene Symbol: IQGAP2
  Gene Name: IQ motif containing GTPase activating protein 2
  Uniprot ID: Q13576
  ENSP ID: ENSP00000274364
MPHEELPSLQRPRYGSIVDDERLSAEEMDERRRQNIAYEYLCHLEEAKRWMEVCLVEELPPTTELEEGLRNGVYLAKLAKFFAPKMVSEKKIYDVEQTRYKKSGLHFRHTDNTVQWLRAMESIGLPKIFYPETTDVYDRKNIPRMIYCIHALSLYLFKLGIAPQIQDLLGKVDFTEEEISNMRKELEKYGIQMPSFSKIGGILANELSVDEAALHAAVIAINEAVEKGIAEQTVVTLRNPNAVLTLVDDNLAPEYQKELWDAKKKKEENARLKNSCISEEERDAYEELLTQAEIQGNINKVNRQAAVDHINAVIPEGDPENTLLALKKPEAQLPAVYPFAAAMYQNELFNLQKQNTMNYLAHEELLIAVEMLSAVALLNQALESNDLVSVQNQLRSPAIGLNNLDKAYVERYANTLLSVKLEVLSQGQDNLSWNEIQNCIDMVNAQIQEENDRVVAVGYINEAIDEGNPLRTLETLLLPTANISDVDPAHAQHYQDVLYHAKSQKLGDSESVSKVLWLDEIQQAVDDANVDKDRAKQWVTLVVDVNQCLEGKKSSDILSVLKSSTSNANDIIPECADKYYDALVKAKELKSERVSSDGSWLKLNLHKKYDYYYNTDSKESSWVTPESCLYKESWLTGKEIEDIIEEVTVGYIRENIWSASEELLLRFQATSSGPILREEFEARKSFLHEQEENVVKIQAFWKGYKQRKEYMHRRQTFIDNTDSIVKIQSWFRMATARKSYLSRLQYFRDHNNEIVKIQSLLRANKARDDYKTLVGSENPPLTVIRKFVYLLDQSDLDFQEELEVARLREEVVTKIRANQQLEKDLNLMDIKIGLLVKNRITLEDVISHSKKLNKKKGGEMEILNNTDNQGIKSLSKERRKTLETYQQLFYLLQTNPLYLAKLIFQMPQNKSTKFMDTVIFTLYNYASNQREEYLLLKLFKTALEEEIKSKVDQVQDIVTGNPTVIKMVVSFNRGARGQNTLRQLLAPVVKEIIDDKSLIINTNPVEVYKAWVNQLETQTGEASKLPYDVTTEQALTYPEVKNKLEASIENLRRVTDKVLNSIISSLDLLPYGLRYIAKVLKNSIHEKFPDATEDELLKIVGNLLYYRYMNPAIVAPDGFDIIDMTAGGQINSDQRRNLGSVAKVLQHAASNKLFEGENEHLSSMNNYLSETYQEFRKYFKEACNVPEPEEKFNMDKYTDLVTVSKPVIYISIEEIISTHSLLLEHQDAIAPEKNDLLSELLGSLGEVPTVESFLGEGAVDPNDPNKANTLSQLSKTEISLVLTSKYDIEDGEAIDSRSLMIKTKKLIIDVIRNQPGNTLTEILETPATAQQEVDHATDMVSRAMIDSRTPEEMKHSQSMIEDAQLPLEQKKRKIQRNLRTLEQTGHVSSENKYQDILNEIAKDIRNQRIYRKLRKAELAKLQQTLNALNKKAAFYEEQINYYDTYIKTCLDNLKRKNTRRSIKLDGKGEPKGAKRAKPVKYTAAKLHEKGVLLDIDDLQTNQFKNVTFDIIATEDVGIFDVRSKFLGVEMEKVQLNIQDLLQMQYEGVAVMKMFDKVKVNVNLLIYLLNKKFYGK

SEQ ID NO: 41976 - protein, 1071 aa, Homo sapiens
  Payload ID: 8538
  Gene Symbol: IQGAP2
  Gene Name: IQ motif containing GTPase activating protein 2
  Uniprot ID: Q13576
  ENSP ID: ENSP00000379535
MHSLPGVVAVGYINEAIDEGNPLRTLETLLLPTANISDVDPAHAQHYQDVLYHAKSQKLGDSESVSKVLWLDEIQQAVDDANVDKDRAKQWVTLVVDVNQCLEGKKSSDILSVLKSSTSNANDIIPECADKYYDALVKAKELKSERVSSDGSWLKLNLHKKYDYYYNTDSKESSWVTPESCLYKESWLTGKEIEAFWKGYKQRKEYMHRRQTFIDNTDSIVKIQSWFRMATARKSYLSRLQYFRDHNNEIVKIQSLLRANKARDDYKTLVGSENPPLTVIRKFVYLLDQSDLDFQEELEVARLREEVVTKIRANQQLEKDLNLMDIKIGLLVKNRITLEDVISHSKKLNKKKGGEMEILNNTDNQGIKSLSKERRKTLETYQQLFYLLQTNPLYLAKLIFQMPQNKSTKFMDTVIFTLYNYASNQREEYLLLKLFKTALEEEIKSKVDQVQDIVTGNPTVIKMVVSFNRGARGQNTLRQLLAPVVKEIIDDKSLIINTNPVEVYKAWVNQLETQTGEASKLPYDVTTEQALTYPEVKNKLEASIENLRRVTDKVLNSIISSLDLLPYGLRYIAKVLKNSIHEKFPDATEDELLKIVGNLLYYRYMNPAIVAPDGFDIIDMTAGGQINSDQRRNLGSVAKVLQHAASNKLFEGENEHLSSMNNYLSETYQEFRKYFKEACNVPEPEEKFNMDKYTDLVTVSKPVIYISIEEIISTHSLLLEHQDAIAPEKNDLLSELLGSLGEVPTVESFLGEGAVDPNDPNKANTLSQLSKTEISLVLTSKYDIEDGEAIDSRSLMIKTKKLIIDVIRNQPGNTLTEILETPATAQQEVDHATDMVSRAMIDSRTPEEMKHSQSMIEDAQLPLEQKKRKIQRNLRTLEQTGHVSSENKYQDILNEIAKDIRNQRIYRKLRKAELAKLQQTLNALNKKAAFYEEQINYYDTYIKTCLDNLKRKNTRRSIKLDGKGEPKGAKRAKPVKYTAAKLHEKGVLLDIDDLQTNQFKNVTFDIIATEDVGIFDVRSKFLGVEMEKVQLNIQDLLQMQYEGVAVMKMFDKVKVNVNLLIYLLNKKFYGK

SEQ ID NO: 41977 - protein, 1402 aa, Homo sapiens
  Payload ID: 8538
  Gene Symbol: IQGAP2
  Gene Name: IQ motif containing GTPase activating protein 2
  ENSP ID: ENSP00000421097
MEVCLVEELPPTTELEEGLRNGVYLAKLAKFFAPKMVSEKKIYDVEQTRYKKSGLHFRHTDNTVQWLRAMESIGLPKIFYPETTDVYDRKNIPRMIYCIHALSLYLFKLGIAPQIQDLLGKVDFTEEEISNMRKELEKYGIQMPSFSKIGGILANELSVDEAALHAAVIAINEAVEKGIAEQTVVTLRNPNAVLTLVDDNLAPEYQKELWDAKKKKEENARLKNSCISEEERDAYEELLTQAEIQGNINKVNRQAAVDHINAVIPEGDPENTLLALKKPEAQLPAVYPFAAAMYQNELFNLQKQNTMNYLAHEELLIAVEMLSAVALLNQALESNDLVSVQNQLRSPAIGLNNLDKAYVERYANTLLSVKLEVLSQGQDNLSWNEIQNCIDMVNAQIQEENDRVVAVGYINEAIDEGNPLRTLETLLLPTANISDVDPAHAQHYQDVLYHAKSQKLGDSESVSKVLWLDEIQQAVDDANVDKDRAKQWVTLVVDVNQCLEGKKSSDILSVLKSSTSNANDIIPECADKYYDALVKAKELKSERVSSDGSWLKLNLHKKYDYYYNTDSKESSWVTPESCLYKESWLTGKEIEDIIEEVTVGYIRENIWSASEELLLRFQATSSGPILREEFEARKSFLHEQEENVVKIQAFWKGYKQRKEYMHRRQTFIDNTDSIVKIQSWFRMATARKSYLSRLQYFRDHNNEIVKIQSLLRANKARDDYKTLVGSENPPLTVIRKFVYLLDQSDLDFQEELEVARLREEVVTKIRANQQLEKDLNLMDIKIGLLVKNRITLEDVISHSKKLNKKKGGEMEILNNTDNQGIKSLSKERRKTLETYQQLFYLLQTNPLYLAKLIFQMPQNKSTKFMDTVIFTLYNYASNQREEYLLLKLFKTALEEEIKSKVDQVQDIVTGNPTVIKMVVSFNRGARGQNTLRQLLAPVVKEIIDDKSLIINTNPVEVYKAWVNQLETQTGEASKLPYDVTTEQALTYPEVKNKLEASIENLRRVTDKVLNSIISSLDLLPYGLRYIAKVLKNSIHEKFPDATEDELLKIVGNLLYYRYMNPAIVAPDGFDIIDMTAGGQINSDQRRNLGSVAKVLQHAASNKLFEGENEHLSSMNNYLSETYQEFRKYFKEACNVPEPEEKFNMDKYTDLVTVSKPVIYISIEEIISTHSLLLEHQDAIAPEKNDLLSELLGSLGEVPTVESFLGEGAVDPNDPNKANTLSQLSKTEISLVLTSKYDIEDGEAIDSRSLMIKTKKLIIDVIRNQPGNTLTEILETPATAQQEVDHATDMVSRAMIDSRTPEEMKHSQSMIEDAQLPLEQKKRKIQRNLRTLEQTGHVSSENKYQDILNEIAKDIRNQRIYRKLRKAELAKLQQTLNALNKKAAFYEEQINYYDTYIKTCLDN

SEQ ID NO: 41978 - protein, 110 aa, Homo sapiens
  Payload ID: 8538
  Gene Symbol: IQGAP2
  Gene Name: IQ motif containing GTPase activating protein 2
  ENSP ID: ENSP00000421319
MGCFKGVVAVGYINEAIDEGNPLRTLETLLLPTANISDVDPAHAQHYQDVLYHAKSQKLGDSESVSKVLWLDEIQQAVDDANVDKDRAKQYGLFNLGSICEKHLGFISLA

SEQ ID NO: 41979 - protein, 509 aa, Homo sapiens
  Payload ID: 8538
  Gene Symbol: IQGAP2
  Gene Name: IQ motif containing GTPase activating protein 2
  ENSP ID: ENSP00000422661
MGCFKGVVAVGYINEAIDEGNPLRTLETLLLPTANISDVDPAHAQHYQDVLYHAKSQKLGDSESVSKVLWLDEIQQAVDDANVDKDRAKQWVTLVVDVNQCLEGKKSSDILSVLKSSTSNANDIIPECADKYYDALVKAKELKSERVSSDGSWLKLNLHKKYDYYYNTDSKESSWVTPESCLYKESWLTGKEIEDIIEEVTVGYIRENIWSASEELLLRFQATSSGPILREEFEARKSFLHEQEENVVKIQAFWKGYKQRKEYMHRRQTFIDNTDSIVKIQSWFRMATARKSYLSRLQYFRDHNNEIVKIQSLLRANKARDDYKTLVGSENPPLTVIRKFVYLLDQSDLDFQEELEVARLREEVVTKIRANQQLEKDLNLMDIKIGLLVKNRITLEDVISHSKKLNKKKGGEMEILNNTDNQGIKSLSKERRKTLETYQQLFYLLQTNPLYLAKLIFQMPQNKSTKFMDTVIFTLYNYASNQREEYLLLKLFKTALEEEIKSKVDQVQD

SEQ ID NO: 41980 - protein, 60 aa, Homo sapiens
  Payload ID: 8538
  Gene Symbol: IQGAP2
  Gene Name: IQ motif containing GTPase activating protein 2
  ENSP ID: ENSP00000423258
MHSLPGVVAVGYINEAIDEGNPLRTLETLLLPTANISDVDPAHAQHYQDVLYHAKSQKLG

SEQ ID NO: 41981 - protein, 824 aa, Homo sapiens
  Payload ID: 8538
  Gene Symbol: IQGAP2
  Gene Name: IQ motif containing GTPase activating protein 2
  ENSP ID: ENSP00000423672
MDERRRQNIAYEYLCHLEEAKRWMEVCLVEELPPTTELEEGLRNGVYLAKLAKFFAPKMVSEKKIYDVEQTRYKKSGLHFRHTDNTVQWLRAMESIGLPKIFYPETTDVYDRKNIPRMIYCIHALSLYLFKLGIAPQIQDLLGKVDFTEEEISNMRKELEKYGIQMPSFSKIGGILANELSVDEAALHAAVIAINEAVEKGIAEQTVVTLRNPNAVLTLVDDNLAPEYQKELWDAKKKKEENARLKNSCISEEERDAYEELLTQAEIQGNINKVNRQAAVDHINAVIPEGDPENTLLALKKPEAQLPAVYPFAAAMYQNELFNLQKQNTMNYLAHEELLIAVEMLSAVALLNQALESNDLVSVQNQLRSPAIGLNNLDKAYVERYANTLLSVKLEVLSQGQDNLSWNEIQNCIDMVNAQIQEENDRVVAVGYINEAIDEGNPLRTLETLLLPTANISDVDPAHAQHYQDVLYHAKSQKLGDSESVSKVLWLDEIQQAVDDANVDKDRAKQWVTLVVDVNQCLEGKKSSDILSVLKSSTSNANDIIPECADKYYDALVKAKELKSERVSSDGSWLKLNLHKKYDYYYNTDSKESSWVTPESCLYKESWLTGKEIEDIIEEVTVGYIRENIWSASEELLLRFQATSSGPILREEFEARKSFLHEQEENVVKIQAFWKGYKQRKEYMHRRQTFIDNTDSIVKIQSWFRMATARKSYLSRLQYFRDHNNEIVKIQSLLRANKARDDYKTLVGSENPPLTVIRKFVYLLDQSDLDFQEELEVARLREEVVTKIRANQQLEKDLNLMDIKIGLLVKNRITLEDVISHSKK

SEQ ID NO: 41982 - protein, 167 aa, Homo sapiens
  Payload ID: 8538
  Gene Symbol: IQGAP2
  Gene Name: IQ motif containing GTPase activating protein 2
  ENSP ID: ENSP00000425351
MGCFKGVVAVGYINEAIDEGNPLRTLETLLLPTANISDVDPAHAQHYQDVLYHAKSQKLGDSESVSKVLWLDEIQQAVDDANVDKDRAKQWVTLVVDVNQCLEGKKSSDILSVLKSSTSNANDIIPECADKYYDALVKAKELKSERVTVHGSNSTCTKNMTTITTLI

SEQ ID NO: 41983 - protein, 79 aa, Homo sapiens
  Payload ID: 8538
  Gene Symbol: IQGAP2
  Gene Name: IQ motif containing GTPase activating protein 2
  ENSP ID: ENSP00000425941
VAPDGFDIIDMTAGGQINSDQRRNLGSVAKVLQHAASNKLFEGENEHLSSMNNYLSETYQEFSSCWNTRMQLPLRKMTY

SEQ ID NO: 41984 - protein, 1071 aa, Homo sapiens
  Payload ID: 8538
  Gene Symbol: IQGAP2
  Gene Name: IQ motif containing GTPase activating protein 2
  Uniprot ID: Q13576
  ENSP ID: ENSP00000426027
MGCFKGVVAVGYINEAIDEGNPLRTLETLLLPTANISDVDPAHAQHYQDVLYHAKSQKLGDSESVSKVLWLDEIQQAVDDANVDKDRAKQWVTLVVDVNQCLEGKKSSDILSVLKSSTSNANDIIPECADKYYDALVKAKELKSERVSSDGSWLKLNLHKKYDYYYNTDSKESSWVTPESCLYKESWLTGKEIEAFWKGYKQRKEYMHRRQTFIDNTDSIVKIQSWFRMATARKSYLSRLQYFRDHNNEIVKIQSLLRANKARDDYKTLVGSENPPLTVIRKFVYLLDQSDLDFQEELEVARLREEVVTKIRANQQLEKDLNLMDIKIGLLVKNRITLEDVISHSKKLNKKKGGEMEILNNTDNQGIKSLSKERRKTLETYQQLFYLLQTNPLYLAKLIFQMPQNKSTKFMDTVIFTLYNYASNQREEYLLLKLFKTALEEEIKSKVDQVQDIVTGNPTVIKMVVSFNRGARGQNTLRQLLAPVVKEIIDDKSLIINTNPVEVYKAWVNQLETQTGEASKLPYDVTTEQALTYPEVKNKLEASIENLRRVTDKVLNSIISSLDLLPYGLRYIAKVLKNSIHEKFPDATEDELLKIVGNLLYYRYMNPAIVAPDGFDIIDMTAGGQINSDQRRNLGSVAKVLQHAASNKLFEGENEHLSSMNNYLSETYQEFRKYFKEACNVPEPEEKFNMDKYTDLVTVSKPVIYISIEEIISTHSLLLEHQDAIAPEKNDLLSELLGSLGEVPTVESFLGEGAVDPNDPNKANTLSQLSKTEISLVLTSKYDIEDGEAIDSRSLMIKTKKLIIDVIRNQPGNTLTEILETPATAQQEVDHATDMVSRAMIDSRTPEEMKHSQSMIEDAQLPLEQKKRKIQRNLRTLEQTGHVSSENKYQDILNEIAKDIRNQRIYRKLRKAELAKLQQTLNALNKKAAFYEEQINYYDTYIKTCLDNLKRKNTRRSIKLDGKGEPKGAKRAKPVKYTAAKLHEKGVLLDIDDLQTNQFKNVTFDIIATEDVGIFDVRSKFLGVEMEKVQLNIQDLLQMQYEGVAVMKMFDKVKVNVNLLIYLLNKKFYGK

SEQ ID NO: 41985 - protein, 1525 aa, Homo sapiens
  Payload ID: 8538
  Gene Symbol: IQGAP2
  Gene Name: IQ motif containing GTPase activating protein 2
  ENSP ID: ENSP00000442313
MEVCLVEELPPTTELEEGLRNGVYLAKLAKFFAPKMVSEKKIYDVEQTRYKKSGLHFRHTDNTVQWLRAMESIGLPKIFYPETTDVYDRKNIPRMIYCIHALSLYLFKLGIAPQIQDLLGKVDFTEEEISNMRKELEKYGIQMPSFSKIGGILANELSVDEAALHAAVIAINEAVEKGIAEQTVVTLRNPNAVLTLVDDNLAPEYQKELWDAKKKKEENARLKNSCISEEERDAYEELLTQAEIQGNINKVNRQAAVDHINAVIPEGDPENTLLALKKPEAQLPAVYPFAAAMYQNELFNLQKQNTMNYLAHEELLIAVEMLSAVALLNQALESNDLVSVQNQLRSPAIGLNNLDKAYVERYANTLLSVKLEVLSQGQDNLSWNEIQNCIDMVNAQIQEENDRVVAVGYINEAIDEGNPLRTLETLLLPTANISDVDPAHAQHYQDVLYHAKSQKLGDSESVSKVLWLDEIQQAVDDANVDKDRAKQWVTLVVDVNQCLEGKKSSDILSVLKSSTSNANDIIPECADKYYDALVKAKELKSERVSSDGSWLKLNLHKKYDYYYNTDSKESSWVTPESCLYKESWLTGKEIEDIIEEVTVGYIRENIWSASEELLLRFQATSSGPILREEFEARKSFLHEQEENVVKIQAFWKGYKQRKEYMHRRQTFIDNTDSIVKIQSWFRMATARKSYLSRLQYFRDHNNEIVKIQSLLRANKARDDYKTLVGSENPPLTVIRKFVYLLDQSDLDFQEELEVARLREEVVTKIRANQQLEKDLNLMDIKIGLLVKNRITLEDVISHSKKLNKKKGGEMEILNNTDNQGIKSLSKERRKTLETYQQLFYLLQTNPLYLAKLIFQMPQNKSTKFMDTVIFTLYNYASNQREEYLLLKLFKTALEEEIKSKVDQVQDIVTGNPTVIKMVVSFNRGARGQNTLRQLLAPVVKEIIDDKSLIINTNPVEVYKAWVNQLETQTGEASKLPYDVTTEQALTYPEVKNKLEASIENLRRVTDKVLNSIISSLDLLPYGLRYIAKVLKNSIHEKFPDATEDELLKIVGNLLYYRYMNPAIVAPDGFDIIDMTAGGQINSDQRRNLGSVAKVLQHAASNKLFEGENEHLSSMNNYLSETYQEFRKYFKEACNVPEPEEKFNMDKYTDLVTVSKPVIYISIEEIISTHSLLLEHQDAIAPEKNDLLSELLGSLGEVPTVESFLGEGAVDPNDPNKANTLSQLSKTEISLVLTSKYDIEDGEAIDSRSLMIKTKKLIIDVIRNQPGNTLTEILETPATAQQEVDHATDMVSRAMIDSRTPEEMKHSQSMIEDAQLPLEQKKRKIQRNLRTLEQTGHVSSENKYQDILNEIAKDIRNQRIYRKLRKAELAKLQQTLNALNKKAAFYEEQINYYDTYIKTCLDNLKRKNTRRSIKLDGKGEPKGAKRAKPVKYTAAKLHEKGVLLDIDDLQTNQFKNVTFDIIATEDVGIFDVRSKFLGVEMEKVQLNIQDLLQMQYEGVAVMKMFDKVKVNVNLLIYLLNKKFYGK

SEQ ID NO: 41986 - protein, 1631 aa, Homo sapiens
  Payload ID: 8539
  Gene Symbol: IQGAP3
  Gene Name: IQ motif containing GTPase activating protein 3
  Uniprot ID: Q86VI3
  ENSP ID: ENSP00000354451
MERRAAGPGWAAYERLTAEEMDEQRRQNVAYQYLCRLEEAKRWMEACLKEELPSPVELEESLRNGVLLAKLGHCFAPSVVPLKKIYDVEQLRYQATGLHFRHTDNINFWLSAIAHIGLPSTFFPETTDIYDKKNMPRVVYCIHALSLFLFRLGLAPQIHDLYGKVKFTAEELSNMASELAKYGLQLPAFSKIGGILANELSVDEAAVHAAVLAINEAVERGVVEDTLAALQNPSALLENLREPLAAVYQEMLAQAKMEKAANARNHDDRESQDIYDHYLTQAEIQGNINHVNVHGALEVVDDALERQSPEALLKALQDPALALRGVRRDFADWYLEQLNSDREQKAQELGLVELLEKEEVQAGVAAANTKGDQEQAMLHAVQRINKAIRRRVAADTVKELMCPEAQLPPVYPVASSMYQLELAVLQQQQGELGQEELFVAVEMLSAVVLINRALEARDASGFWSSLVNPATGLAEVEGENAQRYFDALLKLRQERGMGEDFLSWNDLQATVSQVNAQTQEETDRVLAVSLINEALDKGSPEKTLSALLLPAAGLDDVSLPVAPRYHLLLVAAKRQKAQVTGDPGAVLWLEEIRQGVVRANQDTNTAQRMALGVAAINQAIKEGKAAQTERVLRNPAVALRGVVPDCANGYQRALESAMAKKQRPADTAFWVQHDMKDGTAYYFHLQTFQGIWEQPPGCPLNTSHLTREEIQSAVTKVTAAYDRQQLWKANVGFVIQLQARLRGFLVRQKFAEHSHFLRTWLPAVIKIQAHWRGYRQRKIYLEWLQYFKANLDAIIKIQAWARMWAARRQYLRRLHYFQKNVNSIVKIQAFFRARKAQDDYRILVHAPHPPLSVVRRFAHLLNQSQQDFLAEAELLKLQEEVVRKIRSNQQLEQDLNIMDIKIGLLVKNRITLQEVVSHCKKLTKRNKEQLSDMMVLDKQKGLKSLSKEKRQKLEAYQHLFYLLQTQPIYLAKLIFQMPQNKTTKFMEAVIFSLYNYASSRREAYLLLQLFKTALQEEIKSKVEQPQDVVTGNPTVVRLVVRFYRNGRGQSALQEILGKVIQDVLEDKVLSVHTDPVHLYKNWINQTEAQTGQRSHLPYDVTPEQALSHPEVQRRLDIALRNLLAMTDKFLLAITSSVDQIPYGMRYVAKVLKATLAEKFPDATDSEVYKVVGNLLYYRFLNPAVVAPDAFDIVAMAAGGALAAPQRHALGAVAQLLQHAAAGKAFSGQSQHLRVLNDYLEETHLKFRKFIHRACQVPEPEERFAVDEYSDMVAVAKPMVYITVGELVNTHRLLLEHQDCIAPDHQDPLHELLEDLGELPTIPDLIGESIAADGHTDLSKLEVSLTLTNKFEGLEADADDSNTRSLLLSTKQLLADIIQFHPGDTLKEILSLSASREQEAAHKQLMSRRQACTAQTPEPLRRHRSLTAHSLLPLAEKQRRVLRNLRRLEALGLVSARNGYQGLVDELAKDIRNQHRHRHRRKAELVKLQATLQGLSTKTTFYEEQGDYYSQYIRACLDHLAPDSKSSGKGKKQPSLHYTAAQLLEKGVLVEIEDLPASHFRNVIFDITPGDEAGKFEVNAKFLGVDMERFQLHYQDLLQLQYEGVAVMKLFNKAKVNVNLLIFLLNKKFLRK

SEQ ID NO: 41987 - protein, 1588 aa, Homo sapiens
  Payload ID: 8539
  Gene Symbol: IQGAP3
  Gene Name: IQ motif containing GTPase activating protein 3
  ENSP ID: ENSP00000436603
MEACLKEELPSPVELEESLRNGVLLAKLGHCFAPSVVPLKKIYDVEQLRYQATGLHFRHTDNINFWLSAIAHIGLPSTFFPETTDIYDKKNMPRVVYCIHALSLFLFRLGLAPQIHDLYGKVKFTAEELSNMASELAKYGLQLPAFSKIGGILANELSVDEAAVHAAVLAINEAVERGVVEDTLAALQNPSALLENLREPLAAVYQEMLAQAKMEKAANARNHDDRESQDIYDHYLTQAEIQGNINHVNVHGALEVVDDALERQSPEALLKALQDPALALRGVRRDFADWYLEQLNSDREQKAQELGLVELLEKEEVQAGVAAANTKGDQEQAMLHAVQRINKAIRRRVAADTVKELMCPEAQLPPVYPVASSMYQLELAVLQQQQGELGQEELFVAVEMLSAVVLINRALEARDASGFWSSLVNPATGLAEVEGENAQRYFDALLKLRQERGMGEDFLSWNDLQATVSQVNAQTQEETDRVLAVSLINEALDKGSPEKTLSALLLPAAGLDDVSLPVAPRYHLLLVAAKRQKAQVTGDPGAVLWLEEIRQGVVRANQDTNTAQRMALGVAAINQAIKEGKAAQTERVLRNPAVALRGVVPDCANGYQRALESAMAKKQRPADTAFWVQHDMKDGTAYYFHLQTFQGIWEQPPGCPLNTSHLTREEIQSAVTKVTAAYDRQQLWKANVGFVIQLQARLRGFLVRQKFAEHSHFLRTWLPAVIKIQAHWRGYRQRKIYLEWLQYFKANLDAIIKIQAWARMWAARRQYLRRLHYFQKNVNSIVKIQAFFRARKAQDDYRILVHAPHPPLSVVRRFAHLLNQSQQDFLAEAELLKLQEEVVRKIRSNQQLEQDLNIMDIKIGLLVKNRITLQEVVSHCKKLTKRNKEQLSDMMVLDKQKGLKSLSKEKRQKLEAYQHLFYLLQTQPIYLAKLIFQMPQNKTTKFMEAVIFSLYNYASSRREAYLLLQLFKTALQEEIKSKVEQPQDVVTGNPTVVRLVVRFYRNGRGQSALQEILGKVIQDVLEDKVLSVHTDPVHLYKNWINQTEAQTGQRSHLPYDVTPEQALSHPEVQRRLDIALRNLLAMTDKFLLAITSSVDQIPYGMRYVAKVLKATLAEKFPDATDSEVYKVVGNLLYYRFLNPAVVAPDAFDIVAMAAGGALAAPQRHALGAVAQLLQHAAAGKAFSGQSQHLRVLNDYLEETHLKFRKFIHRACQVPEPEERFAVDEYSDMVAVAKPMVYITVGELVNTHRLLLEHQDCIAPDHQDPLHELLEDLGELPTIPDLIGESIAADGHTDLSKLEVSLTLTNKFEGLEADADDSNTRSLLLSTKQLLADIIQFHPGDTLKEILSLSASREQEAAHKQLMSRRQACTAQTPEPLRRHRSLTAHSLLPLAEKQRRVLRNLRRLEALGLVSARNGYQGLVDELAKDIRNQHRHRHRRKAELVKLQATLQGLSTKTTFYEEQGDYYSQYIRACLDHLAPDSKSSGKGKKQPSLHYTAAQLLEKGVLVEIEDLPASHFRNVIFDITPGDEAGKFEVNAKFLGVDMERFQLHYQDLLQLQYEGVAVMKLFNKAKVNVNLLIFLLNKKFLRK

SEQ ID NO: 41988 - protein, 1027 aa, Homo sapiens
  Payload ID: 8540
  Gene Symbol: IQCH
  Gene Name: IQ motif containing H
  Uniprot ID: Q86VS3
  ENSP ID: ENSP00000336861
MAQNTENHDPVGSILIQIHEDLYQLKEKLTKFSPEEKGETLDIQSLETAIKRTEVGLRIHIEKYLNVVNQNVLTTSVNDESLYTPQASKWLLPTVIDQKSFIFPQESEGTFWQPQRQHSSSLPVFPRAKIKVSKLIKGSNISSLTVLPSSHCTDPYFTPIPVLQADAHKGILSMIERGLIPPTARITFQNPPITPRAAPLHSFDEARKIPTVATFTIPREPPPSPAEVKFFPKKQRSKGKSRRSRGHHDRKAMKVKTPLRALKSLWDYDFLIYDGVIDNTAPDFLAFKEHFSLAWGGIFSLLEHVEKFLRNYAIPEVKIKGNNLVALLPEFELTNKLTRYDLLSVLEDPAHVQMLINLPGQRYKGQDGNSEAAMKIQATWKCYKARKFFLFYRQQKWASGVIAIAWLLYCHKTRLKKILKESRQRHLENFRIRAKHLAANWNRIRTSRRTIIHIPSLGYSQPVREHIADFNTQQNMQLGRLCDILDANVNVIYICSHHMNDELVLYYKKILSLHAAVKSGNLEDRSDLQDRFKIITPEAVNIFPKHHMCLATHLMYSPKAIKRIKNLIRGTEAYIVSGLLHRDDLAVADMLDIPILGSEPELAHLYSTKSGGKRVFDSANVAVPPGIYDIYSQQQMIEQLSQLITDHLQIQRWLFKMDSEFRGNGTAFCDIPSYLKCYKWVLKESSRYGLEDWRKKWAQEPALVKISEELAGILAQHAQPVNEKRFPTWRKFLQTFLSQGGVIEAFPPADNVTNLTVDMLIEPNGKISVLSTGDQLHAESPFISSGTTVPQTSVDPQVLTYLCLQIGKACRMRDVVGYFSIDLVTFIDPSTLEQQVWATGLNLAYSDQLALTQLTLYLTNGHLDCSLSTLEVPRFVPKERKKTKCMSALSMPMLATSRYAVMTTQLRHSNLSLVFHYVFLQICRAHGIGYDVEERQGTVFILYEHLKRHKLGMLTIGEDLQGVLMTFARHLFIIHQEISAPNMQGETNFKTTIADIETILRVTKENKMRFEEEQQSKDDKNLSKPKK

SEQ ID NO: 41989 - protein, 621 aa, Homo sapiens
  Payload ID: 8540
  Gene Symbol: IQCH
  Gene Name: IQ motif containing H
  Uniprot ID: Q86VS3
  ENSP ID: ENSP00000351617
MTKAMKVKTPLRALKSLWDYDFLIYDGVIDNTAPDFLAFKEHFSLAWGGIFSLLEHVEKFLRNYAIPEVKIKGNNLVALLPEFELTNKLTRYDLLSVLEDPAHVQMLINLPGQRYKGQDGNSEAAMKIQATWKCYKARKFFLFYRQQKWASGVIAIAWLLYCHKTRLKKILKESRQRHLENFRIRAKHLAANWNRIRTSRRTIIHIPSLGYSQPVREHIADFNTQQNMQLGRLCDILDANVNVIYICSHHMNDELVLYYKKILSLHAAVKSGNLEDRSDLQDRFKIITPEAVNIFPMIEQLSQLITDHLQIQRWLFKMDSEFRGNGTAFCDIPSYLKCYKWVLKESSRYGLEDWRKKWAQEPALVKISEELAGILAQHAQPVNEKRFPTWRKFLQTFLSQGGVIEAFPPADNVTNLTVDMLIEPNGKISVLSTGDQLHAESPFISSGTTVPQTSVDPQVLTYLCLQIGKACRMRDVVGYFSIDLVTFIDPSTLEQQVWATGLNLAYSDQLALTQLTLYLTNGHLDCSLSTLEVPRFVPKERKKTKCMSALSMPMLATSRYAVMTTQLRHSNLSLVFHYVFLQICRAHGIGYDVENNRRGSPGGPHDLCSPSLHHPSRNIST

SEQ ID NO: 41990 - protein, 60 aa, Homo sapiens
  Payload ID: 8540
  Gene Symbol: IQCH
  Gene Name: IQ motif containing H
  ENSP ID: ENSP00000421223
MAQNTENHDPVGSILIQIHEDLYQLKEKLTKFSPEEKGETLDIQSLETAIKRTEVGLRGF

SEQ ID NO: 41991 - protein, 168 aa, Homo sapiens
  Payload ID: 8540
  Gene Symbol: IQCH
  Gene Name: IQ motif containing H
  Uniprot ID: Q86VS3
  ENSP ID: ENSP00000427323
MAQNTENHDPVGSILIQIHEDLYQLKEKLTKFSPEEKGETLDIQSLETAIKRTEVGLRIHIEKYLNVVNQNVLTTSVNDESLYTPQASKWLLPTVIDQKSFIFPQESEGTFWQPQRQHSSSLPVFPRAKRKIGLNVKILQDPENIHHRAAVNANYGISLPYINQRKAC

SEQ ID NO: 41992 - protein, 170 aa, Homo sapiens
  Payload ID: 8540
  Gene Symbol: IQCH
  Gene Name: IQ motif containing H
  ENSP ID: ENSP00000441306
MAQNTENHDPVGSILIQIHEDLYQLKEKLTKFSPEEKGETLDIQSLETAIKRTEVGLRIHIEKYLNVVNQNVLTTSVNDESLYTPQASKWLLPTVIDQKSFIFPQESEGTFWQPQRQHSSSLPVFPRAKRKIGLNVKILQDPENIHHRAAVNANYGISLPYINQRKACGF

SEQ ID NO: 41993 - protein, 684 aa, Homo sapiens
  Payload ID: 8540
  Gene Symbol: IQCH
  Gene Name: IQ motif containing H
  Uniprot ID: Q86VS3
  ENSP ID: ENSP00000444118
MKVKTPLRALKSLWDYDFLIYDGVIDNTAPDFLAFKEHFSLAWGGIFSLLEHVEKFLRNYAIPEVKIKGNNLVALLPEFELTNKLTRYDLLSVLEDPAHVQMLINLPGQRYKGQDGNSEAAMKIQATWKCYKARKFFLFYRQQKWASGVIAIAWLLYCHKTRLKKILKESRQRHLENFRIRAKHLAANWNRIRTSRRTIIHIPSLGYSQPVREHIADFNTQQNMQLGRLCDILDANVNVIYICSHHMNDELVLYYKKILSLHAAVKSGNLEDRSDLQDRFKIITPEAVNIFPMIEQLSQLITDHLQIQRWLFKMDSEFRGNGTAFCDIPSYLKCYKWVLKESSRYGLEDWRKKWAQEPALVKISEELAGILAQHAQPVNEKRFPTWRKFLQTFLSQGGVIEAFPPADNVTNLTVDMLIEPNGKISVLSTGDQLHAESPFISSGTTVPQTSVDPQVLTYLCLQIGKACRMRDVVGYFSIDLVTFIDPSTLEQQVWATGLNLAYSDQLALTQLTLYLTNGHLDCSLSTLEVPRFVPKERKKTKCMSALSMPMLATSRYAVMTTQLRHSNLSLVFHYVFLQICRAHGIGYDVEERQGTVFILYEHLKRHKLGMLTIGEDLQGVLMTFARHLFIIHQEISAPNMQGETNFKTTIADIETILRVTKENKMRFEEEQQSKDDKNLSKPKK

SEQ ID NO: 41994 - protein, 19 aa, Homo sapiens
  Payload ID: 8540
  Gene Symbol: IQCH
  Gene Name: IQ motif containing H
  ENSP ID: ENSP00000453749
MAQNTENHDPVGSILIQGF

SEQ ID NO: 41995 - protein, 46 aa, Homo sapiens
  Payload ID: 8540
  Gene Symbol: IQCH
  Gene Name: IQ motif containing H
  ENSP ID: ENSP00000454387
KLTKFSPEEKGETLDIQSLETAIKRTEVGLRPLSLYLGNHLHLQQK

SEQ ID NO: 41996 - protein, 90 aa, Homo sapiens
  Payload ID: 8540
  Gene Symbol: IQCH
  Gene Name: IQ motif containing H
  ENSP ID: ENSP00000456293
TVFILYEHLKRHKLGMLTIGEDLQGVLMTFARHLFIIHQEISAPNMQGETNFKTTIADIETILRVTKENKMRFEEEQQSKDDKNLSKPKK

SEQ ID NO: 41997 - protein, 194 aa, Homo sapiens
  Payload ID: 8540
  Gene Symbol: IQCH
  Gene Name: IQ motif containing H
  ENSP ID: ENSP00000457425
  MOD_RES (1)..(1): Any amino acid
XFLFYRQQKWASGVIAIAWLLYCHKTRLKKILKESRQRHLENFRIRAKHLAANWNRIRTSRRTIIHIPSLGYSQPVREHIADFNTQQNMQLGRLCDILDANVNVIYICSHHMNDELVLYYKKILSLHAAVKSGNLEDRSDLQDRFKIITPEAVNIFPMIEQLSQLITDHLQIQRWLFKMDSEFRGNGTAFCDIP

SEQ ID NO: 41998 - protein, 305 aa, Homo sapiens
  Payload ID: 8540
  Gene Symbol: IQCH
  Gene Name: IQ motif containing H
  Uniprot ID: Q86VS3
  ENSP ID: ENSP00000486970
MIERGLIPPTARITFQNPPITPRAAPLHSFDEARKIPTVATFTIPREPPPSPAEVKFFPKKQRSKGKSRRSRGHHDRKAMKVKTPLRALKSLWDYDFLIYDGVIDNTAPDFLAFKEHFSLAWGGIFSLLEHVEKFLRNYAIPEVKIKGNNLVALLPEFELTNKLTRYDLLSVLEDPAHVQMLINLPGQRYKGQDGNSEAAMKIQATWKCYKARKFFLFYRQQKWASGVIAIAWLLYCHKTRLKKILKESRQRHLENFRIRAKHLAANWNRIRTSRRTIIHIPSLGITLLPANLSATSITHHIMAP

SEQ ID NO: 41999 - protein, 112 aa, Homo sapiens
  Payload ID: 8541
  Gene Symbol: IQCJ
  Gene Name: IQ motif containing J
  Uniprot ID: Q1A5X6
  ENSP ID: ENSP00000380932
MRLEELKRLQNPLEQVNDGKYSFENHQLAMDAENNIEKYPLNLQPLESKVKIIQRAWREYLQRQEPLGKRSPSPPSVSSEKLSSSVSMNTFSDSSTPVSVMFLFLCPDLTFN

SEQ ID NO: 42000 - protein, 159 aa, Homo sapiens
  Payload ID: 8541
  Gene Symbol: IQCJ
  Gene Name: IQ motif containing J
  Uniprot ID: Q1A5X6
  ENSP ID: ENSP00000402153
MRLEELKRLQNPLEQVNDGKYSFENHQLAMDAENNIEKYPLNLQPLESKVKIIQRAWREYLQRQEPLGKRSPSPPSVSSEKLSSSVSMNTFSDSSTPFARAPVGKIHPYISWRLQSPGDKLPGGRKVILLYLDQLARPTGFIHTLKEPQIERLGFLTLQ

SEQ ID NO: 42001 - protein, 132 aa, Homo sapiens
  Payload ID: 8541
  Gene Symbol: IQCJ
  Gene Name: IQ motif containing J
  Uniprot ID: Q1A5X6
  ENSP ID: ENSP00000418141
MRLEELKRLQNPLEQVNDGKYSFENIQRAWREYLQRQEPLGKRSPSPPSVSSEKLSSSVSMNTFSDSSTPFARAPVGKIHPYISWRLQSPGDKLPGGRKVILLYLDQLARPTGFIHTLKEPQIERLGFLTLQ

SEQ ID NO: 42002 - protein, 189 aa, Homo sapiens
  Payload ID: 8542
  Gene Symbol: IQCK
  Gene Name: IQ motif containing K
  Uniprot ID: Q8N0W5
  ENSP ID: ENSP00000309261
MAAPRQIPSHIVRLKPSCSTDSSFTRTPVPTVSLASRELPVSSWQVTEPSSKNLWEQICKEYEAEQPPFPEGYKVKQEPVITVAPVEEMLFHGFSAEHYFPVSHFTMISRTPCPQDKSETINPKTCSPKEYLETFIFPVLLPGMASLLHQAKKEKCFEPTAANPTLAPADRRGSSPLHSILLESLCGSL

SEQ ID NO: 42003 - protein, 287 aa, Homo sapiens
  Payload ID: 8542
  Gene Symbol: IQCK
  Gene Name: IQ motif containing K
  Uniprot ID: Q8N0W5
  ENSP ID: ENSP00000324901
MAAPRQIPSHIVRLKPSCSTDSSFTRTPVPTVSLASRELPVSSWQVTEPSSKNLWEQICKEYEAEQPPFPEGYKVKQEPVITVAPVEEMLFHGFSAEHYFPVSHFTMISRTPCPQDKSETINPKTCSPKEYLETFIFPVLLPGMASLLHQAKKEKCFERKRTKFIACDFLTEWLYNQNPKRAGEPFTEFFSIPFVEERLKQHPRPPIPLSLLLTEEEAALYIQSFWRACVVRCDPEIQELRQWQKKLREAKHIHQQVKIFWAKQEQKVKCKMEDDAVPAAKMKIPSS

SEQ ID NO: 42004 - protein, 58 aa, Homo sapiens
  Payload ID: 8542
  Gene Symbol: IQCK
  Gene Name: IQ motif containing K
  ENSP ID: ENSP00000455504
AEETSRGQAHSPASQNFLGQARTKSEMQNGGRCSTCSQDENSIILTIAKTMQQSAGGR

SEQ ID NO: 42005 - protein, 94 aa, Homo sapiens
  Payload ID: 8542
  Gene Symbol: IQCK
  Gene Name: IQ motif containing K
  ENSP ID: ENSP00000456448
MAAPRQIPSHIVRLKPSCSTDSSFTRTPVPTVSLASRELPVSSWQVTEPSSKNLWEQICKGCASRGNAFSWLQCRALFSGFPFHHDLTYTLSSR

SEQ ID NO: 42006 - protein, 167 aa, Homo sapiens
  Payload ID: 8542
  Gene Symbol: IQCK
  Gene Name: IQ motif containing K
  ENSP ID: ENSP00000457506
  MOD_RES (1)..(1): Any amino acid
XPSHIVRLKPSCSTDSSFTRTPVPTVSLASRELPVSSWQVTEPSSKNLWEQICKEYEAEQPPFPEGYKVKQEPVITVAPVEEMLFHGFSAEHYFPVSHFTMISRTPCPQDKSETINPKTCSPKEYLETFIFPVLLPGMASLLHQAKKEKCFEIDCSPWHLSTPCQLS

SEQ ID NO: 42007 - protein, 94 aa, Homo sapiens; identical to SEQ ID NO: 42005
  Payload ID: 8542
  Gene Symbol: IQCK
  Gene Name: IQ motif containing K
  ENSP ID: ENSP00000457519

SEQ ID NO: 42008 - protein, 123 aa, Homo sapiens
  Payload ID: 8542
  Gene Symbol: IQCK
  Gene Name: IQ motif containing K
  ENSP ID: ENSP00000458010
  MOD_RES (1)..(1): Any amino acid
XPRQIPSHIVRLKPSCSTDSSFTRTPVPTVSLASRELPVSSWQVTEPSSKNLWEQICKEYEAEQPPFPEGYKVKQEPVITVAPVEEMLFHGFSAEHYFPVSHFTMISRTPCPQDKSETINPKT

SEQ ID NO: 42009 - protein, 282 aa, Homo sapiens
  Payload ID: 8542
  Gene Symbol: IQCK
  Gene Name: IQ motif containing K
  ENSP ID: ENSP00000458669
MAAPRQIPSHIVRLKPSCSTDSSFTRTPVPTVSLASRELPVSSWQVTEPSSKNLWEQICKEYEAEQPPFPEGYKVKQEPVITVAPVEEMLFHGFSAEHYFPVSHFTMISRTPCPQDKSETINPKTCSPKEYLETFIFPVLLPGMASLLHQAKKEKCFERKRTKFIACDFLTEWLYNQNPKRAGEPFTEFFSIPFVEERLKQHPRPPIPLSLLLTEEEAALYIQSFWRACVVRCDPEIQELRQWQKKLREAKHIHQQVKIFWAKQEQKGKLLDSLSLVHSRKA

SEQ ID NO: 42010 - protein, 679 aa, Homo sapiens
  Payload ID: 8543
  Gene Symbol: IQCA1
  Gene Name: IQ motif containing with AAA domain 1
  Uniprot ID: Q86XH1
  ENSP ID: ENSP00000254653
MSNAMYNKMWHQTQEALGALLDKEPQKMIEPQRNQVFIFQTLATFYVKYVQIFRNLENVYDQFVHPQKRILIRKVLDGVMGRILELKNEMVELELTEFHYFDDILQDLKLAPQQLDIPIPKYFLKEKLEVIKGREKILAQILADSGIDTSDMKYPVKSIPFDEAVKLIQIAERARQGRLRALFMKQIYLQEYRAKQSKMLGKKVTDTWAAALRIQKVWRRFHQRKETEKLREEEMIFLGMNPPPLFNEVSATVIQAEKVDRLRNEVQIKHEEDYREALVTIKNDLKLIEGVDIKENLQDQIRHWFIECRNLTGTFPDYPDVEEGGSAIIFSDKTIQQVIEDIIANQEEEEKNKKKKKKKEKQPKKAKKQKKGTKEKNKEEDEKWKMSPSLFLPAMKEGCNAYKEIWMKKDESWNFSQDYDPELIKEEKRKELQSEIRIQVDELMRQELKNLKLAVDRERERPVKAGKKKDKKKGKKGKKKEKKAKKDKDLTADRTIESLYKELVEEGLLIQALKVNLSDYIGEYSYLGTTLRQVSIEPMPSLLDVRQLITLYGIWPLGSAAVHEKAPLVKSLLLAGPSGVGKKMLVHAICTETGANLFNLSSSNIAGKYPGKNGLQMMLHAVFKVARQLQPSVVWIEDTEKTFYKKVPNAEKMFTPSAGEVAALQKNLKRSTSRMNLNA

SEQ ID NO: 42011 - protein, 781 aa, Homo sapiens
  Payload ID: 8543
  Gene Symbol: IQCA1
  Gene Name: IQ motif containing with AAA domain 1
  Uniprot ID: Q86XH1
  ENSP ID: ENSP00000311951
MSNAMYNKMWHQTQEALGALLDKEPQKMIEPQRNQVFIFQTLATFYVKYVQIFRNLENVYDQFVHPQKRILIRKVLDGVMGRILELKNEMVELELTEFHYFDDILQDLKLAPQQLDIPIPKYFLKEKLEVIKGREKILAQILADSGIDTSDMKYPVKSIPFDEAVKLIQIAERARQGRLRALFMKQIYLQEYRAKQSKMLGKKVTDTWAAALRIQKVWRRFHQRKETEKLREEEMIFLGMNPPPLFNEVSATVIQAEKVDRLRNEVQIKHEEDYREALVTIKNDLKLIEGVDIKENLQDQIRHWFIECRNLTGTFPDYPDVEEGGSAIIFSDKTIQQEEDEKWKMSPSLFLPAMKEGCNAYKEIWMKKDESWNFSQDYDPELIKEEKRKELQSEIRIQVDELMRQELKNLKLAVDRERERPVKAGKKKDKKGKKGKKKEKKAKKDKDLTADRTIESLYKELVEEGLLIQALKVNLSDYIGEYSYLGTTLRQVSIEPMPSLLDVRQLITLYGIWPLGSAAVHEKAPLVKSLLLAGPSGVGKKMLVHAICTETGANLFNLSSSNIAGKYPGKNGLQMMLHAVFKVARQLQPSVVWIEDTEKTFYKKVPNAEKMNEPKRLKKHLPQILKLLKPDDRILIVGTTRRPFDAELQSFCKVYQKIILVPRPDYASRYVLWKQIIERNGGVLTSALNVSCLAKVTDGFTQGHIVEVVKGVLTDQRIRRQIHKPLTAVEFITAITSMNPVYKEEEESFKNWYAKTPLGKKRALAITGGSTEKAKDKGKRK

SEQ ID NO: 42012 - protein, 822 aa, Homo sapiens
  Payload ID: 8543
  Gene Symbol: IQCA1
  Gene Name: IQ motif containing with AAA domain 1
  Uniprot ID: Q86XH1
  ENSP ID: ENSP00000387347
MSNAMYNKMWHQTQEALGALLDKEPQKMIEPQRNQVFIFQTLATFYVKYVQIFRNLENVYDQFVHPQKRILIRKVLDGVMGRILELKNEMVELELTEFHYFDDILQDLKLAPQQLDIPIPKYFLKEKLEVIKGREKILAQILADSGIDTSDMKYPVKSIPFDEAVKLIQIAERARQGRLRALFMKQIYLQEYRAKQSKMLGKKVTDTWAAALRIQKVWRRFHQRKETEKLREEEMIFLGMNPPPLFNEVSATVIQAEKVDRLRNEVQIKHEEDYREALVTIKNDLKLIEGVDIKENLQDQIRHWFIECRNLTGTFPDYPDVEEGGSAIIFSDKTIQQVIEDIIANQEEEEKNKKKKKKKEKQPKKAKKQKKGTKEKNKEEDEKWKMSPSLFLPAMKEGCNAYKEIWMKKDESWNFSQDYDPELIKEEKRKELQSEIRIQVDELMRQELKNLKLAVDRERERPVKAGKKKDKKGKKGKKKEKKAKKDKDLTADRTIESLYKELVEEGLLIQALKVNLSDYIGEYSYLGTTLRQVSIEPMPSLLDVRQLITLYGIWPLGSAAVHEKAPLVKSLLLAGPSGVGKKMLVHAICTETGANLFNLSSSNIAGKYPGKNGLQMMLHAVFKVARQLQPSVVWIEDTEKTFYKKVPNAEKMNEPKRLKKHLPQILKLLKPDDRILIVGTTRRPFDAELQSFCKVYQKIILVPRPDYASRYVLWKQIIERNGGVLTSALNVSCLAKVTDGFTQGHIVEVVKGVLTDQRIRRQIHKPLTAVEFITAITSMNPVYKEEEESFKNWYAKTPLGKKRALAITGGSTEKAKDKGKRK

SEQ ID NO: 42013 - protein, 536 aa, Homo sapiens
  Payload ID: 8543
  Gene Symbol: IQCA1
  Gene Name: IQ motif containing with AAA domain 1
  ENSP ID: ENSP00000390964
  MOD_RES (1)..(1): Any amino acid
XQSRGKRVWWKEMTPSLSAEENRMYNKMWHQTQEALGALLDKEPQKMIEPQRNQVFIFQTLATFYVKYVQIFRNLENVYDQFVHPQKRILIRKVLDGVMGRILELKNEMVELELTEFHYFDDILQDLKLAPQQLDIPIPKYFLKEKLEVIKGREKILAQILADSGIDTSDMKYPVKSIPFDEAVKLIQIAERARQGRLRALFMKQIYLQEYRAKQSKMLGKKVTDTWAAALRIQKVWRRFHQRKETEKLREEEMIFLGMNPPPLFNEVSATVIQAEKVDRLRNEVQIKHEEDYREALVTIKNDLKLIEGVDIKENLQDQIRHWFIECRNLTGTFPDYPDVEEGGSAIIFSDKTIQQVIEDIIANQEEEEKNKKKKKKKEKQPKKAKKQKKGTKEKNKEEDEKWKMSPSLFLPAMKEGCNAYKEIWMKKDESWNFSQDYDPELIKEEKRKELQSEIRIQVDELMRQELKNLKLAVDRERERPVKAGKKKDKKKGKKGKKKEKKAKKDKDLTADRTIESLYKELVEEGLLIQALKVNL

SEQ ID NO: 42014 - protein, 830 aa, Homo sapiens
  Payload ID: 8543
  Gene Symbol: IQCA1
  Gene Name: IQ motif containing with AAA domain 1
  ENSP ID: ENSP00000407213
MTPSLSAEENRMYNKMWHQTQEALGALLDKEPQKMIEPQRNQVFIFQTLATFYVKYVQIFRNLENVYDQFVHPQKRILIRKVLDGVMGRILELKNEMVELELTEFHYFDDILQDLKLAPQQLDIPIPKYFLKEKLEVIKGREKILAQILADSGIDTSDMKYPVKSIPFDEAVKLIQIAERARQGRLRALFMKQIYLQEYRAKQSKMLGKKVTDTWAAALRIQKVWRRFHQRKETEKLREEEMIFLGMNPPPLFNEVSATVIQAEKVDRLRNEVQIKHEEDYREALVTIKNDLKLIEGVDIKENLQDQIRHWFIECRNLTGTFPDYPDVEEGGSAIIFSDKTIQQVIEDIIANQEEEEKNKKKKKKKEKQPKKAKKQKKGTKEKNKEEDEKWKMSPSLFLPAMKEGCNAYKEIWMKKDESWNFSQDYDPELIKEEKRKELQSEIRIQVDELMRQELKNLKLAVDRERERPVKAGKKKDKKKGKKGKKKEKKAKKDKDLTADRTIESLYKELVEEGLLIQALKVNLSDYIGEYSYLGTTLRQVSIEPMPSLLDVRQLITLYGIWPLGSAAVHEKAPLVKSLLLAGPSGVGKKMLVHAICTETGANLFNLSSSNIAGKYPGKNGLQMMLHAVFKVARQLQPSVVWIEDTEKTFYKKVPNAEKMNEPKRLKKHLPQILKLLKPDDRILIVGTTRRPFDAELQSFCKVYQKIILVPRPDYASRYVLWKQIIERNGGVLTSALNVSCLAKVTDGFTQGHIVEVVKGVLTDQRIRRQIHKPLTAVEFITAITSMNPVYKEEEESFKNWYAKTPLGKKRALAITGGSTEKAKDKGKRK

SEQ ID NO: 42015 - protein, 121 aa, Homo sapiens
  Payload ID: 8544
  Gene Symbol: IQCA1L
  Gene Name: IQ motif containing with AAA domain 1 like
  ENSP ID: ENSP00000479307
  MOD_RES (1)..(1): Any amino acid
XLYAVLRLGSPDIHIMAPLIRSILLVGPSGMGKKMLVKAVCTETGANLFDLSPENLLGKYPGRNGAQMMVHIVFKVRSPQLLAFAVLRPVATKEGGFEVTSPISLLGSPTPTALCDLDWKC

SEQ ID NO: 42016 - protein, 818 aa, Homo sapiens
  Payload ID: 8544
  Gene Symbol: IQCA1L
  Gene Name: IQ motif containing with AAA domain 1 like
  ENSP ID: ENSP00000482119
MSEGAYQRLWESSHATLQELLDQEQLLLEPAPDRERQSFQYRLASLYLHYLGLLRRFDTVYDQMVQPQKRRLLRRLLDGVAGRVLELKDELVRADLCENHCLDRVLQDFKLTPADLEVPIPKYFLLEQSTTVRERGLILAEILSRLEPVSSQKSFTGMHRTEAIILVQKAERARQGRLRATFMREIRRDEEQDGRIREDGWHKFSQGQAAVTIQKVWKGYLQRKRTQQDRRMEMEFIGMLPSPNQVEHLSIISQPCLVEDVQRLRQMEKEEEFRAAMVKAHDSLVETEGPDMKEKMKEQIRQWFIECHDLTGRFPDYPDASSGGSYSIFADKTPEQVRMELEMQMQENRKKEQEKSKEKGKDEKEKKKGKEEKAKKGEVDAVLQVLPSKCIPMICAGHEEYLNTWKNRCESIHPSQNYDSETLREEKRKEVELEIRIQVDELMRQELRKLRLAVDKEEERPLRAPKKTPGKKTGKKKEKDLTSDRSVESLYEELVISGLLRKSESVALKDYIGDFLYLGSTLSLVKKLPMPSLFDIRQNVALYAVLRLGSPDIHIMAPLIRSILLVGPSGMGKKMLVKAVCTETGANLFDLSPENLLGKYPGRNGAQMMVHIVFKVARLLQPSVIWIGNAEKNFYKKTPKEDKEMDPKRIKKDLTKALRLLTPGDRVMLIGTTSRPQLAEMRGLCRVYERILFMPRPDYASRYVLWKRMIEARGIQPTQHLDISALAKVSDGYTPGHILQAIQSVLSERRFLQLSKRPLVASEFLGQLVKLDPVYREEEESLKDWYFKTPLGKKSMKHRMDQLEAEEAKLDKEKKKRK

SEQ ID NO: 42017 - protein, 118 aa, Homo sapiens
  Payload ID: 8544
  Gene Symbol: IQCA1L
  Gene Name: IQ motif containing with AAA domain 1 like
  ENSP ID: ENSP00000484243
  MOD_RES (1)..(1): Any amino acid
XQENRKKEQEKSKEKGKDEKEKKKGKEEKAKKGEVDAVLQVLPSKCIPMICAGHEEYLNTWKNRCESIHPSQNYDSETLREEKRKEVELEIRIQVTKTSAGDLRFEFHLGASPHVEGC

SEQ ID NO: 42018 - protein, 487 aa, Homo sapiens
  Payload ID: 8545
  Gene Symbol: IQCJ-SCHIP1
  Gene Name: IQCJ-SCHIP1 readthrough
  ENSP ID: ENSP00000337239
MERSGQRVTTWDCDQGKHSDSDYREDGMDLGSDAGSSSSSSRASSQSNSTKVTPCSECKSSSSPGGSLDLVSALEDYEEPFPVYQKKVIDEWAPEEDGEEEEEEDERDQRGYRDDRSPAREPGDVSARTRSGGGGGRSATTAMPPPVPNGNLHQHDPQDLRHNGNVVVAGRPSCSRGPRRAIQKPQPAGGRRSGRGPAAGGLCLQPPDGGTCVPEEPPVPPMDWEALEKHLAGLQFREQEVRNQGQARTNSTSAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNRKKSPVADLLPHMPHISECLMKRSLKPTDLRDMTIGQLQVIVNDLHSQIESLNEELVQLLLIRDELHTEQDAMLVDIEDLTRHAESQQKHMAEKMPAK

SEQ ID NO: 42019 - protein, 474 aa, Homo sapiens
  Payload ID: 8545
  Gene Symbol: IQCJ-SCHIP1
  Gene Name: IQCJ-SCHIP1 readthrough
  ENSP ID: ENSP00000400942
MERSGQRVTTWDCDQGKHSDSDYREDGMDLGSDAGSSSSSSRASSQSNSTKVTPCSECKSSSSPGGSLDLVSALEDYEEPFPVYQKKVIDEWAPEEDGEEEEEEDERDQRGYRDDRSPAREPGDVSARTRSGGGGGRSATTAMPPPVPNGNLHQHDPQDLRHNGNVVVAGRPSCSRGPRRAIQKPQPAGGRRSGRGPAAGGLCLQPPDGGTCVPEEPPVPPMDWEALEKHLAGLQFREQEAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNRKKSPVADLLPHMPHISECLMKRSLKPTDLRDMTIGQLQVIVNDLHSQIESLNEELVQLLLIRDELHTEQDAMLVDIEDLTRHAESQQKHMAEKMPAK

SEQ ID NO: 42020 - protein, 143 aa, Homo sapiens
  Payload ID: 8545
  Gene Symbol: IQCJ-SCHIP1
  Gene Name: IQCJ-SCHIP1 readthrough
  ENSP ID: ENSP00000417080
MDLGSDAGSSSSSSRASSQSNSTKVTPCSECKSSSSPGGSLDLVSALEDYEEPFPVYQKKVIDEWAPEEDGEEEEEEDERDQRGYRDDRSPAREPGDVSARTRSGGGGGRSATTAMPPPVPNGNLHQHDPQDLRHNGNVVVAG

SEQ ID NO: 42021 - protein, 451 aa, Homo sapiens
  Payload ID: 8545
  Gene Symbol: IQCJ-SCHIP1
  Gene Name: IQCJ-SCHIP1 readthrough
  ENSP ID: ENSP00000417305
MDLGSDAGSSSSSSRASSQSNSTKVTPCSECKSSSSPGGSLDLVSALEDYEEPFPVYQKKVIDEWAPEEDGEEEEEEDERDQRGYRDDRSPAREPGDVSARTRSGGGGGRSATTAMPPPVPNGNLHQHDPQDLRHNGNVVVAGRPSCSRGPRRAIQKPQPAGGRRSGRGPAAGGLCLQPPDGGTCVPEEPPVPPMDWEALEKHLAGLQFREQEAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNRKKSPVADLLPHMPHISECLMKRSLKPTDLRDMTIGQLQVIVNDLHSQIESLNEELVQLLLIRDELHTEQDAMLVDIEDLTRSVWLHSCQRRKAQGGLKSKN

SEQ ID NO: 42022 - protein, 167 aa, Homo sapiens
  Payload ID: 8545
  Gene Symbol: IQCJ-SCHIP1
  Gene Name: IQCJ-SCHIP1 readthrough
  ENSP ID: ENSP00000418452
MDLGSDAGSSSSSSRASSQSNSTKVTPCSECKSSSSPGGSLDLVSALEDYEEPFPVYQKKVIDEWAPEEDGEEEEEEDERDQRGYRDDRSPAREPGDVSARTRSGGGGGRSATTAMPPPVPNGNLHQHDPQDLRHNGNVVVAGRPSCSRGPRRAIQKPQPAGGRRSG

SEQ ID NO: 42023 - protein, 100 aa, Homo sapiens
  Payload ID: 8545
  Gene Symbol: IQCJ-SCHIP1
  Gene Name: IQCJ-SCHIP1 readthrough
  ENSP ID: ENSP00000418570
  MOD_RES (1)..(1): Any amino acid
XGTRARRGPTPPPHRKMRESLSDRSWHLEASLMMAQEFIPAVAKVGSQAFPPGLNEELVQLLLIRDELHTEQDAMLVDIEDLTRHAESQQKHMAEKMPAK

SEQ ID NO: 42024 - protein, 536 aa, Homo sapiens
  Payload ID: 8545
  Gene Symbol: IQCJ-SCHIP1
  Gene Name: IQCJ-SCHIP1 readthrough
  ENSP ID: ENSP00000418692
MRLEELKRLQNPLEQVNDGKYSFENIQRAWREYLQRQEPLGKRSPSPPSVSSEKLSSSVSMNTFSDSSTPDYREDGMDLGSDAGSSSSSSRASSQSNSTKVTPCSECKSSSSPGGSLDLVSALEDYEEPFPVYQKKVIDEWAPEEDGEEEEEEDERDQRGYRDDRSPAREPGDVSARTRSGGGGGRSATTAMPPPVPNGNLHQHDPQDLRHNGNVVVAGRPSCSRGPRRAIQKPQPAGGRRSGRGPAAGGLCLQPPDGGTCVPEEPPVPPMDWEALEKHLAGLQFREQEVRNQGQARTNSTSAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNRKKSPVADLLPHMPHISECLMKRSLKPTDLRDMTIGQLQVIVNDLHSQIESLNEELVQLLLIRDELHTEQDAMLVDIEDLTRHAESQQKHMAEKMPAK

SEQ ID NO: 42025 - protein, 158 aa, Homo sapiens
  Payload ID: 8545
  Gene Symbol: IQCJ-SCHIP1
  Gene Name: IQCJ-SCHIP1 readthrough
  ENSP ID: ENSP00000419125
MQMEELKRLQNPLEQVNDGKYSFENIQRAWREYLQRQEPLGKRSPSPPSVSSEKLSSSVSMNTFSDSSTPDYREDGMDLGSDAGSSSSSSRASSQSNSTKVTPCSECKSSSSPGGSLDLVSALEDYEEPFPVYQKKVIDEWAPEEDGEEEEEEDERDQ

SEQ ID NO: 42026 - protein, 153 aa, Homo sapiens
  Payload ID: 8545
  Gene Symbol: IQCJ-SCHIP1
  Gene Name: IQCJ-SCHIP1 readthrough
  ENSP ID: ENSP00000419349
MQMEELKRLQNPLEQVNDGKYSFENHQLAMDAENNIEKYPLNLQPLESKVKIIQRAWREYLQRQEPLGKRSPSPPSVSSEKLSSSVSMNTFSDSSTPDYREDGMDLGSDAGSSSSSSRASSQSNSTKVTPCSECKSSSSPGGSLDLVSALEDY

SEQ ID NO: 42027 - protein, 101 aa, Homo sapiens
  Payload ID: 8545
  Gene Symbol: IQCJ-SCHIP1
  Gene Name: IQCJ-SCHIP1 readthrough
  ENSP ID: ENSP00000419668
MRLEELKRLQNPLEQVNDGKYSFENHQLAMDAENNIEKYPLNLQPLESKHSASMARVPAAAGAPGEEEPVPTLCLLREAEQLCQHEHLLRQQHTRLPRGWD

SEQ ID NO: 42028 - protein, 563 aa, Homo sapiens
  Payload ID: 8545
  Gene Symbol: IQCJ-SCHIP1
  Gene Name: IQCJ-SCHIP1 readthrough
  ENSP ID: ENSP00000420182
MRLEELKRLQNPLEQVNDGKYSFENHQLAMDAENNIEKYPLNLQPLESKVKIIQRAWREYLQRQEPLGKRSPSPPSVSSEKLSSSVSMNTFSDSSTPDYREDGMDLGSDAGSSSSSSRASSQSNSTKVTPCSECKSSSSPGGSLDLVSALEDYEEPFPVYQKKVIDEWAPEEDGEEEEEEDERDQRGYRDDRSPAREPGDVSARTRSGGGGGRSATTAMPPPVPNGNLHQHDPQDLRHNGNVVVAGRPSCSRGPRRAIQKPQPAGGRRSGRGPAAGGLCLQPPDGGTCVPEEPPVPPMDWEALEKHLAGLQFREQEVRNQGQARTNSTSAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNRKKSPVADLLPHMPHISECLMKRSLKPTDLRDMTIGQLQVIVNDLHSQIESLNEELVQLLLIRDELHTEQDAMLVDIEDLTRHAESQQKHMAEKMPAK

SEQ ID NO: 42029 - protein, 91 aa, Homo sapiens
  Payload ID: 8545
  Gene Symbol: IQCJ-SCHIP1
  Gene Name: IQCJ-SCHIP1 readthrough
  ENSP ID: ENSP00000420478
MDAENNIEKYPLNLQPLESKVKIIQRAWREYLQRQEPLGKRSPSPPSVSSEKLSSSVSMNTFSDSSTPDYREDGMDLGSDAGSSSSSSRAS

SEQ ID NO: 42030 - protein, 255 aa, Homo sapiens
  Payload ID: 8545
  Gene Symbol: IQCJ-SCHIP1
  Gene Name: IQCJ-SCHIP1 readthrough
  ENSP ID: ENSP00000436076
MERSGQRVTTWDCDQGKHSDSAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNRKKSPVADLLPHMPHISECLMKRSLKPTDLRDMTIGQLQVIVNDLHSQIESLNEELVQLLLIRDELHTEQDAMLVDIEDLTRHAESQQKHMAEKMPAK

SEQ ID NO: 42031 - protein, 438 aa, Homo sapiens
  Payload ID: 8546
  Gene Symbol:
  Gene Name: Iron/zinc purple acid phosphatase-like protein  [Source:UniProtKB/Swiss-Prot
  Acc:Q6ZNF0]
  Uniprot ID: Q6ZNF0
  ENSP ID: ENSP00000327557
MHPLPGYWSCYCLLLLFSLGVQGSLGAPSAAPEQVHLSYPGEPGSMTVTWTTWVPTRSEVQFGLQPSGPLPLRAQGTFVPFVDGGILRRKLYIHRVTLRKLLPGVQYVYRCGSAQGWSRRFRFRALKNGAHWSPRLAVFGDLGADNPKAVPRLRRDTQQGMYDAVLHVGDFAYNLDQDNARVGDRFMRLIEPVAASLPYMTCPGNHEERYNFSNYKARFSMPGDNEGLWYSWDLGPAHIISFSTEVYFFLHYGRHLVQRQFRWLESDLQKANKNRAARPWIITMGHRPMYCSNADLDDCTRHESKVRKGLQGKLYGLEDLFYKYGVDLQLWAHEHSYERLWPIYNYQVFNGSREMPYTNPRGPVHIITGSAGCEERLTPFAVFPRPWSAVRVKEYGYTRLHILNGTHIHIQQVSDDQDGKIVDDVWVVRPLFGRRMYL

SEQ ID NO: 42032 - protein, 367 aa, Homo sapiens
  Payload ID: 8546
  Gene Symbol:
  Gene Name: Iron/zinc purple acid phosphatase-like protein  [Source:UniProtKB/Swiss-Prot
  Acc:Q6ZNF0]
  ENSP ID: ENSP00000469048
MHPLPGYWSCYCLLLLFSLGVQGSLGAPSAAPEQVHLSYPGEPGSMTVTWTTWVPTRSEVQFGLQPSGPLPLRAQGTFVPFVDGGILRRKLYIHRVTLRKLLPGVQYVYRCGSAQGWSRRFRFRALKNGAHWSPRLAVFGDLGADNPKAVPRLRRDTQQGMYDAVLHVATSLTTRLASACRGIMRACGTGNVGVLGDWPSPLKDGRCRGALVPDPCPLTPPAGIWVPPTSSPSPPRSISFSIMAATWYRGSFAGWRATSRKPIRTGQPGRGSSLWGTGPCTAPTQIWTTAHDMKARSAKASKASCTGWRIFSTNMEWICSCGLMSTRMNDCGQFTTTRYLTAAERCPTPTREGLSTSSQDLLAVRSG

SEQ ID NO: 42033 - protein, 227 aa, Homo sapiens
  Payload ID: 8546
  Gene Symbol:
  Gene Name: Iron/zinc purple acid phosphatase-like protein  [Source:UniProtKB/Swiss-Prot
  Acc:Q6ZNF0]
  ENSP ID: ENSP00000470089
  MOD_RES (1)..(1): Any amino acid
XGADNPKAVPRLRRDTQQGMYDAVLHVGDFAYNLDQDNARVGDRFMRLIEPVAASLPYMTCPGNHEERYNFSNYKARFSMPGDNEGLWYSWDLGPAHIISFSTEVYFFLHYGRHLVQRQFRWLESDLQKANKNRAARPWIITMGHRPMYCSNADLDDCTRHESKVRKGLQGKLYGLEDLFYKYGVDLQLWAHEHSYERLWPIYNYQDGKIVDDVWVVRPLFGRRMYL

SEQ ID NO: 42034 - protein, 334 aa, Homo sapiens
  Payload ID: 8546
  Gene Symbol:
  Gene Name: Iron/zinc purple acid phosphatase-like protein  [Source:UniProtKB/Swiss-Prot
  Acc:Q6ZNF0]
  ENSP ID: ENSP00000470989
MHPLPGYWSCYCLLLLFSLGVQGSLGAPSAAPEQVHLSYPGEPGSMTVTWTTWVPTRSEVQFGLQPSGPLPLRAQGTFVPFVDGGILRRKLYIHRVTLRKLLPGVQYVYRCGSAQGWSRRFRFRALKNGAHWSPRLAVFGDLGADNPKAVPRLRRDTQQGMYDAVLHVATSLTTRLASACRGIMRACGTAGIWVPPTSSPSPPRSISFSIMAATWYRGSFAGWRATSRKPIRTGQPGRGSSLWGTGPCTAPTQIWTTAHDMKARSAKASKASCTGWRIFSTNMEWICSCGLMSTRMNDCGQFTTTRYLTAAERCPTPTREGLSTSSQDLLMGRS

SEQ ID NO: 42035 - protein, 963 aa, Homo sapiens
  Payload ID: 8547
  Gene Symbol: IREB2
  Gene Name: iron-responsive element binding protein 2
  ENSP ID: ENSP00000258886
MDAPKAGYAFEYLIETLNDSSHKKFFDVSKLGTKYDVLPYSIRVLLEAAVRNCDGFLMKKEDVMNILDWKTKQSNVEVPFFPARVLLQDFTGIPAMVDFAAMREAVKTLGGDPEKVHPACPTDLTVDHSLQIDFSKCAIQNAPNPGGGDLQKAGKLSPLKVQPKKLPCRGQTTCRGSCDSGELGRNSGTFSSQIENTPILCPFHLQPVPEPETVLKNQEVEFGRNRERLQFFKWSSRVFKNVAVIPPGTGMAHQINLEYLSRVVFEEKDLLFPDSVVGTDSHITMVNGLGILGWGVGGIETEAVMLGLPVSLTLPEVVGCELTGSSNPFVTSIDVVLGITKHLRQVGVAGKFVEFFGSGVSQLSIVDRTTIANMCPEYGAILSFFPVDNVTLKHLEHTGFSKAKLESMETYLKAVKLFRNDQNSSGEPEYSQVIQINLNSIVPSVSGPKRPQDRVAVTDMKSDFQACLNEKVGFKGFQIAAEKQKDIVSIHYEGSEYKLSHGSVVIAAVISCTNNCNPSVMLAAGLLAKKAVEAGLRVKPYIRTSLSPGSGMVTHYLSSSGVLPYLSKLGFEIVGYGCSICVGNTAPLSDAVLNAVKQGDLVTCGILSGNKNFEGRLCDCVRANYLASPPLVVAYAIAGTVNIDFQTEPLGTDPTGKNIYLHDIWPSREEVHRVEEEHVILSMFKALKDKIEMGNKRWNSLEAPDSVLFPWDLKSTYIRCPSFFDKLTKEPIALQAIENAHVLLYLGDSVTTDHISPAGSIARNSAAAKYLTNRGLTPREFNSYGARRGNDAVMTRGTFANIKLFNKFIGKPAPKTIHFPSGQTLDVFEAAELYQKEGIPLIILAGKKYGSGNSRDWAAKGPYLLGVKAVLAESYEKIHKDHLIGIGIAPLQFLPGENADSLGLSGRETFSLTFPEELSPGITLNIQTSTGKVFSVIASFEDDVEITLYKHGGLLNFVARKFS

SEQ ID NO: 42036 - protein, 343 aa, Homo sapiens
  Payload ID: 8547
  Gene Symbol: IREB2
  Gene Name: iron-responsive element binding protein 2
  Uniprot ID: P48200
  ENSP ID: ENSP00000452938
MDAPKAGYAFEYLIETLNDSSHKKFFDVSKLGTKYDVLPYSIRVLLEAAVRNCDGFLMKKEDVMNILDWKTKQSNVEVPFFPARVLLQDFTGIPAMVDFAAMREAVKTLGGDPEKVHPACPTDLTVDHSLQIDFSKCAIQNAPNPGGGDLQKAGKLSPLKVQPKKLPCRGQTTCRGSCDSGELGRNSGTFSSQIENTPILCPFHLQPVPEPETVLKNQEVEFGRNRERLQFFKWSSRVFKNVAVIPPGTGMAHQINLEYLSRVVFEEKDLLFPDSVVGTDSHITMVNGLGILGWGVGGIETEAVMLGLPVSLTLPEVVGCELTGSSNPFVTSIDVVLGITKVS

SEQ ID NO: 42037 - protein, 51 aa, Homo sapiens
  Payload ID: 8547
  Gene Symbol: IREB2
  Gene Name: iron-responsive element binding protein 2
  ENSP ID: ENSP00000453058
MDAPKAGYAFEYLIETLNDSSHKKFFDVSKLGTKCSALLNTGLVGSCCTKL

SEQ ID NO: 42038 - protein, 38 aa, Homo sapiens
  Payload ID: 8547
  Gene Symbol: IREB2
  Gene Name: iron-responsive element binding protein 2
  ENSP ID: ENSP00000453172
MKKEDVMNILDWKTKQSNVEVPFFPARVLLQDFTGIPA

SEQ ID NO: 42039 - protein, 46 aa, Homo sapiens
  Payload ID: 8547
  Gene Symbol: IREB2
  Gene Name: iron-responsive element binding protein 2
  ENSP ID: ENSP00000453532
MDAPKAGYAFEYLIETLNDSSHKKFFDVSKLGTKYVEYQQWWILLL

SEQ ID NO: 42040 - protein, 89 aa, Homo sapiens
  Payload ID: 8547
  Gene Symbol: IREB2
  Gene Name: iron-responsive element binding protein 2
  ENSP ID: ENSP00000453863
  MOD_RES (1)..(1): Any amino acid
XKYGSGNSRDWAAKGPYLLGVKAVLAESYEKIHKDHLIGIGIAPLQFLPGENADSLGLSGRETFSLTFPEELSPGITLNIQVSLNFSNI

SEQ ID NO: 42041 - protein, 220 aa, Homo sapiens
  Payload ID: 8547
  Gene Symbol: IREB2
  Gene Name: iron-responsive element binding protein 2
  ENSP ID: ENSP00000454063
MDAPKAGYAFEYLIETLNDSSHKKFFDVSKLGTKYDVLPYSIRVLLEAAVRNCDGFLMKKEDVMNILDWKTKQSNVEVPFFPARVLLQDFTGIPAMVDFAAMREAVKTLGGDPEKVHPACPTDLTVDHSLQIDFSKCAIQNAPNPGGGDLQKAGKLSPLKVQPKKLPCRGQTTCRGSCDSGELGRNSGTFSSQIENTPILCPFHLQPVPDGVQEFLRMWQ

SEQ ID NO: 42042 - protein, 31 aa, Homo sapiens
  Payload ID: 8548
  Gene Symbol: ISCA1
  Gene Name: iron-sulfur cluster assembly 1
  ENSP ID: ENSP00000339003
MDYVEDKLSSEFVFNNPNIKGTCGCGESFNI

SEQ ID NO: 42043 - protein, 86 aa, Homo sapiens
  Payload ID: 8548
  Gene Symbol: ISCA1
  Gene Name: iron-sulfur cluster assembly 1
  ENSP ID: ENSP00000365157
MSASLVRATVRAVSKRKLQPTRAALTLTPSAVNKIKQLLKDKPEHVGVKVGVRTRGCNGLSYTLEYTKTKGDSDEEVIQDGWSAVV

SEQ ID NO: 42044 - protein, 129 aa, Homo sapiens
  Payload ID: 8548
  Gene Symbol: ISCA1
  Gene Name: iron-sulfur cluster assembly 1
  Uniprot ID: Q9BUE6
  ENSP ID: ENSP00000365159
MSASLVRATVRAVSKRKLQPTRAALTLTPSAVNKIKQLLKDKPEHVGVKVGVRTRGCNGLSYTLEYTKTKGDSDEEVIQDGVRVFIEKKAQLTLLGTEMDYVEDKLSSEFVFNNPNIKGTCGCGESFNI

SEQ ID NO: 42045 - protein, 108 aa, Homo sapiens
  Payload ID: 8549
  Gene Symbol: ISCA2
  Gene Name: iron-sulfur cluster assembly 2
  ENSP ID: ENSP00000298818
MAAAWGSSLTAATQRAVTPWPRGRLLTASLGPQARREASSSSPEAGEGQIRLTDSCVQRLLEITEGSEFLRLQVEGGGCSGFQYKFSLDTVINPDDRQGGRGWGKSGG

SEQ ID NO: 42046 - protein, 60 aa, Homo sapiens
  Payload ID: 8549
  Gene Symbol: ISCA2
  Gene Name: iron-sulfur cluster assembly 2
  Uniprot ID: Q86U28
  ENSP ID: ENSP00000450523
MAAAWGSSLTAATQRAVTPWPRGRLLTASLGPQARREASSSSPEAGEGQIRLTDSCVQGI

SEQ ID NO: 42047 - protein, 154 aa, Homo sapiens
  Payload ID: 8549
  Gene Symbol: ISCA2
  Gene Name: iron-sulfur cluster assembly 2
  Uniprot ID: Q86U28
  ENSP ID: ENSP00000452007
MAAAWGSSLTAATQRAVTPWPRGRLLTASLGPQARREASSSSPEAGEGQIRLTDSCVQRLLEITEGSEFLRLQVEGGGCSGFQYKFSLDTVINPDDRVFEQGGARVVVDSDSLAFVKGAQVDFSQELIRSSFQVLNNPQAQQGCSCGSSFSIKL

SEQ ID NO: 42048 - protein, 167 aa, Homo sapiens
  Payload ID: 8550
  Gene Symbol: ISCU
  Gene Name: iron-sulfur cluster assembly enzyme
  Uniprot ID: Q9H1K1
  ENSP ID: ENSP00000310623
MAAAGAFRLRRAASALLLRSPRLPARELSAPARLYHKKVVDHYENPRNVGSLDKTSKNVGTGLVGAPACGDVMKLQIQVDEKGKIVDARFKTFGCGSAIASSSLATEWVKGKTVEEALTIKNTDIAKELCLPPVKLHCSMLAEDAIKAALADYKLKQEPKKGEAEKK

SEQ ID NO: 42049 - protein, 142 aa, Homo sapiens
  Payload ID: 8550
  Gene Symbol: ISCU
  Gene Name: iron-sulfur cluster assembly enzyme
  Uniprot ID: Q9H1K1
  ENSP ID: ENSP00000376554
MVLIDMSVDLSTQVVDHYENPRNVGSLDKTSKNVGTGLVGAPACGDVMKLQIQVDEKGKIVDARFKTFGCGSAIASSSLATEWVKGKTVEEALTIKNTDIAKELCLPPVKLHCSMLAEDAIKAALADYKLKQEPKKGEAEKK

SEQ ID NO: 42050 - protein, 156 aa, Homo sapiens
  Payload ID: 8550
  Gene Symbol: ISCU
  Gene Name: iron-sulfur cluster assembly enzyme
  ENSP ID: ENSP00000411108
MAAAGAFRLRRAASALLLRSPRLPARELSAPARLYHKKVVDHYENPRNVGSLDKTSKNVGTGLVGAPACGDVMKLQIQVDEKGKIVDARFKTFGCGSAIASSSLATEWVKGKTVEEALTIKNTDIAKELCLPPVKLHCSRKEGMRNISLNASMEVY

SEQ ID NO: 42051 - protein, 46 aa, Homo sapiens
  Payload ID: 8550
  Gene Symbol: ISCU
  Gene Name: iron-sulfur cluster assembly enzyme
  ENSP ID: ENSP00000437854
MAAAGAFRLRRAASALLLRSPRLPARELSAPARLYHKKVSQICEVL

SEQ ID NO: 42052 - protein, 154 aa, Homo sapiens
  Payload ID: 8550
  Gene Symbol: ISCU
  Gene Name: iron-sulfur cluster assembly enzyme
  ENSP ID: ENSP00000443272
MAAAGAFRLRRAASALLLRSPRLPARELSAPARLYHKKVVDHYENPRNVGSLDKTSKNVGTGLVGAPACGDVMKLQIQVDEKGKIVDARFKTFGCGSAIASSSLATEWVKGKTVEEALTIKNTDIAKELCLPPVKLHCSSKSLLSIPVSWDIWQ

SEQ ID NO: 42053 - protein, 154 aa, Homo sapiens
  Payload ID: 8550
  Gene Symbol: ISCU
  Gene Name: iron-sulfur cluster assembly enzyme
  ENSP ID: ENSP00000445598
MAAAGAFRLRRAASALLLRSPRLPARELSAPARLYHKKVVDHYENPRNVGSLDKTSKNVGTGLVGAPACGDVMKLQIQVDEKGKIVDARFKTFGCGSAIASSSLATEWVKGKTVEEALTIKNTDIAKELCLPPVKLHCSKSVLFPAEEKTQLSP

SEQ ID NO: 42054 - protein, 154 aa, Homo sapiens; identical to SEQ ID NO: 42053
  Payload ID: 8550
  Gene Symbol: ISCU
  Gene Name: iron-sulfur cluster assembly enzyme
  ENSP ID: ENSP00000446606

SEQ ID NO: 42055 - protein, 480 aa, Homo sapiens
  Payload ID: 8551
  Gene Symbol: IRX1
  Gene Name: iroquois homeobox 1
  Uniprot ID: P78414
  ENSP ID: ENSP00000305244
MSFPQLGYPQYLSAAGPGAYGGERPGVLAAAAAAAAAASSGRPGAAELGGGAGAAAVTSVLGMYAAAGPYAGAPNYSAFLPYAADLSLFSQMGSQYELKDNPGVHPATFAAHTAPAYYPYGQFQYGDPGRPKNATRESTSTLKAWLNEHRKNPYPTKGEKIMLAIITKMTLTQVSTWFANARRRLKKENKVTWGARSKDQEDGALFGSDTEGDPEKAEDDEEIDLESIDIDKIDEHDGDQSNEDDEDKAEAPHAPAAPSALARDQGSPLAAADVLKPQDSPLGLAKEAPEPGSTRLLSPGAAAGGLQGAPHGKPKIWSLAETATSPDGAPKASPPPPAGHPGAHGPSAGAPLQHPAFLPSHGLYTCHIGKFSNWTNSAFLAQGSLLNMRSFLGVGAPHAAPHGPHLPAPPPPQPPVAIAPGALNGDKASVRSSPTLPERDLVPRPDSPAQQLKSPFQPVRDNSLAPQEGTPRILAALPSA

SEQ ID NO: 42056 - protein, 471 aa, Homo sapiens
  Payload ID: 8552
  Gene Symbol: IRX2
  Gene Name: iroquois homeobox 2
  Uniprot ID: Q9BZI1
  ENSP ID: ENSP00000307006
MSYPQGYLYQAPGSLALYSCPAYGASALAAPRSEELARSASGSAFSPYPGSAAFTAQAATGFGSPLQYSADAAAAAAGFPSYMGAPYDAHTTGMTGAISYHPYGSAAYPYQLNDPAYRKNATRDATATLKAWLNEHRKNPYPTKGEKIMLAIITKMTLTQVSTWFANARRRLKKENKMTWAPRNKSEDEDEDEGDATRSKDESPDKAQEGTETSAEDEGISLHVDSLTDHSCSAESDGEKLPCRAGDPLCESGSECKDKYDDLEDDEDDDEEGERGLAPPKPVTSSPLTGLEAPLLSPPPEAAPRGGRKTPQGSRTSPGAPPPASKPKLWSLAEIATSDLKQPSLGPGCGPPGLPAAAAPASTGAPPGGSPYPASPLLGRPLYYTSPFYGNYTNYGNLNAALQGQGLLRYNSAAAAPGEALHTAPKAASDAGKAGAHPLESHYRSPGGGYEPKKDASEGCTVVGGGVQPYL

SEQ ID NO: 42057 - protein, 471 aa, Homo sapiens; identical to SEQ ID NO: 42056
  Payload ID: 8552
  Gene Symbol: IRX2
  Gene Name: iroquois homeobox 2
  Uniprot ID: Q9BZI1
  ENSP ID: ENSP00000372056

SEQ ID NO: 42058 - protein, 501 aa, Homo sapiens
  Payload ID: 8553
  Gene Symbol: IRX3
  Gene Name: iroquois homeobox 3
  Uniprot ID: P78415
  ENSP ID: ENSP00000331608
MSFPQLGYQYIRPLYPSERPGAAGGSGGSAGARGGLGAGASELNASGSLSNVLSSVYGAPYAAAAAAAAAQGYGAFLPYAAELPIFPQLGAQYELKDSPGVQHPAAAAAFPHPHPAFYPYGQYQFGDPSRPKNATRESTSTLKAWLNEHRKNPYPTKGEKIMLAIITKMTLTQVSTWFANARRRLKKENKMTWAPRSRTDEEGNAYGSEREEEDEEEDEEDGKRELELEEEELGGEEEDTGGEGLADDDEDEEIDLENLDGAATEPELSLAGAARRDGDLGLGPISDSKNSDSEDSSEGLEDRPLPVLSLAPAPPPVAVASPSLPSPPVSLDPCAPAPAPASALQKPKIWSLAETATSPDNPRRSPPGAGGSPPGAAVAPSALQLSPAAAAAAAHRLVSAPLGKFPAWTNRPFPGPPPGPRLHPLSLLGSAPPHLLGLPGAAGHPAAAAAFARPAEPEGGTDRCSALEVEKKLLKTAFQPVPRRPQNHLDAALVLSALSSS

SEQ ID NO: 42059 - protein, 84 aa, Homo sapiens
  Payload ID: 8553
  Gene Symbol: IRX3
  Gene Name: iroquois homeobox 3
  ENSP ID: ENSP00000463991
AAAAAQGYGAFLPYAAELPIFPQLIAVVPWKWRKSYSRQLSSPCPGGPRTIWTPPWSYRLSPHPSSLKKTKKQKKLFLIVVIIV

SEQ ID NO: 42060 - protein, 519 aa, Homo sapiens
  Payload ID: 8554
  Gene Symbol: IRX4
  Gene Name: iroquois homeobox 4
  Uniprot ID: P78413
  ENSP ID: ENSP00000231357
MSYPQFGYPYSSAPQFLMATNSLSTCCESGGRTLADSGPAASAQAPVYCPVYESRLLATARHELNSAAALGVYGGPYGGSQGYGNYVTYGSEASAFYSLNSFDSKDGSGSAHGGLAPAAAAYYPYEPALGQYPYDRYGTMDSGTRRKNATRETTSTLKAWLQEHRKNPYPTKGEKIMLAIITKMTLTQVSTWFANARRRLKKENKMTWPPRNKCADEKRPYAEGEEEEGGEEEAREEPLKSSKNAEPVGKEEKELELSDLDDFDPLEAEPPACELKPPFHSLDGGLERVPAAPDGPVKEASGALRMSLAAGGGAALDEDLERARSCLRSAAAGPEPLPGAEGGPQVCEAKLGFVPAGASAGLEAKPRIWSLAHTATAAAAAATSLSQTEFPSCMLKRQGPAAPAAVSSAPATSPSVALPHSGALDRHQDSPVTSLRNWVDGVFHDPILRHSTLNQAWATAKGALLDPGPLGRSLGAGANVLTAPLARAFPPAVPQDAPAAGAARELLALPKAGGKPFCA

SEQ ID NO: 42061 - protein, 216 aa, Homo sapiens
  Payload ID: 8554
  Gene Symbol: IRX4
  Gene Name: iroquois homeobox 4
  ENSP ID: ENSP00000421772
MSYPQFGYPYSSAPQFLMATNSLSTCCESGGRTLADSGPAASAQAPVYCPVYESRLLATARHELNSAAALGVYGGPYGGSQGYGNYVTYGSEASAFYSLNSFDSKDGSGSAHGGLAPAAAAYYPYEPALGQYPYDRIKRLGGHPHKGIGLDLSGLGRSPGSLYGTMDSGTRRKNATRETTSTLKAWLQEHRKNPYPTKGEKIMLAIITKMTLTQVS

SEQ ID NO: 42062 - protein, 196 aa, Homo sapiens
  Payload ID: 8554
  Gene Symbol: IRX4
  Gene Name: iroquois homeobox 4
  ENSP ID: ENSP00000422462
MSYPQFGYPYSSAPQFLMATNSLSTCCESGGRTLADSGPAASAQAPVYCPVYESRLLATARHELNSAAALGVYGGPYGGSQGYGNYVTYGSEASAFYSLNSFDSKDGSGSAHGGLAPAAAAYYPYEPALGQYPYDRGPSLSPLQSLSPGMEPWTAARGARTPRARPPARSRPGCRSTARTPTPPRARRSCWPSSPR

SEQ ID NO: 42063 - protein, 519 aa, Homo sapiens; identical to SEQ ID NO: 42060
  Payload ID: 8554
  Gene Symbol: IRX4
  Gene Name: iroquois homeobox 4
  Uniprot ID: P78413
  ENSP ID: ENSP00000423161

SEQ ID NO: 42064 - protein, 519 aa, Homo sapiens; identical to SEQ ID NO: 42060
  Payload ID: 8554
  Gene Symbol: IRX4
  Gene Name: iroquois homeobox 4
  Uniprot ID: P78413
  ENSP ID: ENSP00000424235

SEQ ID NO: 42065 - protein, 545 aa, Homo sapiens
  Payload ID: 8554
  Gene Symbol: IRX4
  Gene Name: iroquois homeobox 4
  Uniprot ID: P78413
  ENSP ID: ENSP00000481396
MSYPQFGYPYSSAPQFLMATNSLSTCCESGGRTLADSGPAASAQAPVYCPVYESRLLATARHELNSAAALGVYGGPYGGSQGYGNYVTYGSEASAFYSLNSFDSKDGSGSAHGGLAPAAAAYYPYEPALGQYPYDRIKRLGGHPHKGIGLDLSGLGRSPGSLYGTMDSGTRRKNATRETTSTLKAWLQEHRKNPYPTKGEKIMLAIITKMTLTQVSTWFANARRRLKKENKMTWPPRNKCADEKRPYAEGEEEEGGEEEAREEPLKSSKNAEPVGKEEKELELSDLDDFDPLEAEPPACELKPPFHSLDGGLERVPAAPDGPVKEASGALRMSLAAGGGAALDEDLERARSCLRSAAAGPEPLPGAEGGPQVCEAKLGFVPAGASAGLEAKPRIWSLAHTATAAAAAATSLSQTEFPSCMLKRQGPAAPAAVSSAPATSPSVALPHSGALDRHQDSPVTSLRNWVDGVFHDPILRHSTLNQAWATAKGALLDPGPLGRSLGAGANVLTAPLARAFPPAVPQDAPAAGAARELLALPKAGGKPFCA

SEQ ID NO: 42066 - protein, 545 aa, Homo sapiens; identical to SEQ ID NO: 42065
  Payload ID: 8554
  Gene Symbol: IRX4
  Gene Name: iroquois homeobox 4
  Uniprot ID: P78413
  ENSP ID: ENSP00000482393

SEQ ID NO: 42067 - protein, 482 aa, Homo sapiens
  Payload ID: 8555
  Gene Symbol: IRX5
  Gene Name: iroquois homeobox 5
  Uniprot ID: P78411
  ENSP ID: ENSP00000316250
MSYPQGYLYQPSASLALYSCPAYSTSVISGPRTDELGRSSSGSAFSPYAGSTAFTAPSPGYNSHLQYGADPAAAAAAAFSSYVGSPYDHTPGMAGSLGYHPYAAPLGSYPYGDPAYRKNATRDATATLKAWLNEHRKNPYPTKGEKIMLAIITKMTLTQVSTWFANARRRLKKENKMTWTPRNRSEDEEEEENIDLEKNDEDEPQKPEDKGDPEGPEAGAEQKAASGCERLQGPPTPAGKETEGSLSDSDFKEPPSEGRLDALQGPPRTGGPSPAGPAAARLAEDPAPHYPAGAPAPGPHPAAGEVPPGPGGPSVIHSPPPPPPPAVLAKPKLWSLAEIATSSDKVKDGGGGNEGSPCPPCPGPIAGQALGGSRASPAPAPSRSPSAQCPFPGGTVLSRPLYYTAPFYPGYTNYGSFGHLHGHPGPGPGPTTGPGSHFNGLNQTVLNRADALAKDPKMLRSQSQLDLCKDSPYELKKGMSDI

SEQ ID NO: 42068 - protein, 483 aa, Homo sapiens
  Payload ID: 8555
  Gene Symbol: IRX5
  Gene Name: iroquois homeobox 5
  Uniprot ID: P78411
  ENSP ID: ENSP00000378132
MSYPQGYLYQPSASLALYSCPAYSTSVISGPRTDELGRSSSGSAFSPYAGSTAFTAPSPGYNSHLQYGADPAAAAAAAFSSYVGSPYDHTPGMAGSLGYHPYAAPLGSYPYGDPAYRKNATRDATATLKAWLNEHRKNPYPTKGEKIMLAIITKMTLTQVSTWFANARRRLKKENKMTWTPRNRSEDEEEEENIDLEKNDEDEPQKPEDKGDPEGPEAGGAEQKAASGCERLQGPPTPAGKETEGSLSDSDFKEPPSEGRLDALQGPPRTGGPSPAGPAAARLAEDPAPHYPAGAPAPGPHPAAGEVPPGPGGPSVIHSPPPPPPPAVLAKPKLWSLAEIATSSDKVKDGGGGNEGSPCPPCPGPIAGQALGGSRASPAPAPSRSPSAQCPFPGGTVLSRPLYYTAPFYPGYTNYGSFGHLHGHPGPGPGPTTGPGSHFNGLNQTVLNRADALAKDPKMLRSQSQLDLCKDSPYELKKGMSDI

SEQ ID NO: 42069 - protein, 263 aa, Homo sapiens
  Payload ID: 8555
  Gene Symbol: IRX5
  Gene Name: iroquois homeobox 5
  ENSP ID: ENSP00000453660
MSYPQGYLYQPSASLALYSCPAYSTSVISGPRTDELGRSSSGSAFSPYAGSTAFTAPSPGYNSHLQYGADPAAAAAAAFSSYVLLKKEKKSLDFPCFPPLRPTCVRSPAERGVASVAQASICMEGRAAVARSAHGGSPCPPCPGPIAGQALGGSRASPAPAPSRSPSAQCPFPGGTVLSRPLYYTAPFYPGYTNYGSFGHLHGHPGPGPGPTTGPGSHFNGLNQTVLNRADALAKDPKMLRSQSQLDLCKDSPYELKKGMSDI

SEQ ID NO: 42070 - protein, 417 aa, Homo sapiens
  Payload ID: 8555
  Gene Symbol: IRX5
  Gene Name: iroquois homeobox 5
  Uniprot ID: P78411
  ENSP ID: ENSP00000453725
MAVETTVHTHLSASPPQGSPYDHTPGMAGSLGYHPYAAPLGSYPYGDPAYRKNATRDATATLKAWLNEHRKNPYPTKGEKIMLAIITKMTLTQVSTWFANARRRLKKENKMTWTPRNRSEDEEEEENIDLEKNDEDEPQKPEDKGDPEGPEAGGAEQKAASGCERLQGPPTPAGKETEGSLSDSDFKEPPSEGRLDALQGPPRTGGPSPAGPAAARLAEDPAPHYPAGAPAPGPHPAAGEVPPGPGGPSVIHSPPPPPPPAVLAKPKLWSLAEIATSSDKVKDGGGGNEGSPCPPCPGPIAGQALGGSRASPAPAPSRSPSAQCPFPGGTVLSRPLYYTAPFYPGYTNYGSFGHLHGHPGPGPGPTTGPGSHFNGLNQTVLNRADALAKDPKMLRSQSQLDLCKDSPYELKKGMSDI

SEQ ID NO: 42071 - protein, 146 aa, Homo sapiens [sequence omitted]

SEQ ID NO: 42072 - protein, 446 aa, Homo sapiens
  Payload ID: 8556
  Gene Symbol: IRX6
  Gene Name: iroquois homeobox 6
  Uniprot ID: P78412
  ENSP ID: ENSP00000290552
MSFPHFGHPYRGASQFLASASSSTTCCESTQRSVSDVASGSTPAPALCCAPYDSRLLGSARPELGAALGIYGAPYAAAAAAQSYPGYLPYSPEPPSLYGALNPQYEFKEAAGSFTSSLAQPGAYYPYERTLGQYQYERYGAVELSGAGRRKNATRETTSTLKAWLNEHRKNPYPTKGEKIMLAIITKMTLTQVSTWFANARRRLKKENKMTWAPKNKGGEERKAEGGEEDSLGCLTADTKEVTASQEARGLRLSDLEDLEEEEEEEEEAEDEEVVATAGDRLTEFRKGAQSLPGPCAAAREGRLERRECGLAAPRFSFNDPSGSEEADFLSAETGSPRLTMHYPCLEKPRIWSLAHTATASAVEGAPPARPRPRSPECRMIPGQPPASARRLSVPRDSACDESSCIPKAFGNPKFALQGLPLNCAPCPRRSEPVVQCQYPSGAEAG

SEQ ID NO: 42073 - protein, 165 aa, Homo sapiens
  Payload ID: 8557
  Gene Symbol: ISG15
  Gene Name: ISG15 ubiquitin-like modifier
  Uniprot ID: P05161
  ENSP ID: ENSP00000368699
MGWDLTVKMLAGNEFQVSLSSSMSVSELKAQITQKIGVHAFQQRLAVHPSGVALQDRVPLASQGLGPGSTVLLVVDKCDEPLSILVRNNKGRSSTYEVRLTQTVAHLKQQVSGLEGVQDDLFWLTFEGKPLEDQLPLGEYGLKPLSTVFMNLRLRGGGTEPGGRS

SEQ ID NO: 42074 - protein, 143 aa, Homo sapiens
  Payload ID: 8557
  Gene Symbol: ISG15
  Gene Name: ISG15 ubiquitin-like modifier
  ENSP ID: ENSP00000485313
MLAGNEFQVSLSSSMSVSELKAQITQKIGVHAFQQRLAVHPSGVALQDRVPLASQGLGPGSTVLLVVDKCDEPLSILVRNNKGRSSTYEVRLTQTVAHLKQQVSGLEGVQDDLFWLTFEGKPLEDQLPLGEYGLKPLSTVFMN

SEQ ID NO: 42075 - protein, 157 aa, Homo sapiens
  Payload ID: 8557
  Gene Symbol: ISG15
  Gene Name: ISG15 ubiquitin-like modifier
  ENSP ID: ENSP00000485643
MLAGNEFQVSLSSSMSVSELKAQITQKIGVHAFQQRLAVHPSGVALQDRVPLASQGLGPGSTVLLVVDKCDEPLSILVRNNKGRSSTYEVRLTQTVAHLKQQVSGLEGVQDDLFWLTFEGKPLEDQLPLGEYGLKPLSTVFMNLRLRGGGTEPGGRS

SEQ ID NO: 42076 - protein, 349 aa, Homo sapiens
  Payload ID: 8558
  Gene Symbol: ISL1
  Gene Name: ISL LIM homeobox 1
  Uniprot ID: P61371
  ENSP ID: ENSP00000230658
MGDMGDPPKKKRLISLCVGCGNQIHDQYILRVSPDLEWHAACLKCAECNQYLDESCTCFVRDGKTYCKRDYIRLYGIKCAKCSIGFSKNDFVMRARSKVYHIECFRCVACSRQLIPGDEFALREDGLFCRADHDVVERASLGAGDPLSPLHPARPLQMAAEPISARQPALRPHVHKQPEKTTRVRTVLNEKQLHTLRTCYAANPRPDALMKEQLVEMTGLSPRVIRVWFQNKRCKDKKRSIMMKQLQQQQPNDKTNIQGMTGTPMVAASPERHDGGLQANPVEVQSYQPPWKVLSDFALQSDIDQPAFQQLVNFSEGGPGSNSTGSEVASMSSQLPDTPNSMVASPIEA

SEQ ID NO: 42077 - protein, 326 aa, Homo sapiens
  Payload ID: 8558
  Gene Symbol: ISL1
  Gene Name: ISL LIM homeobox 1
  ENSP ID: ENSP00000422676
MGDMGDPPKKKRLISLCVGCGNQIHDQYILRVSPDLEWHAACLKCAECNQYLDESCTCFVRDGKTYCKRDYIRLYGIKCAKCSIGFSKNDFVMRARSKVYHIECFRCVACSRQLIPGDEFALREDGLFCRADHDVVERASLGAGDPLSPLHPARPLQMAAEPISARQPALRPHVHKQPEKTTRVRTVLNEKQLHTLRTCYAANPRPDALMKEQLVEMTGLSPRVIRVWFQNKRCKDKKRSIMMKQLQQQQPNDKTANPVEVQSYQPPWKVLSDFALQSDIDQPAFQQLVNFSEGGPGSNSTGSEVASMSSQLPDTPNSMVASPIEA

SEQ ID NO: 42078 - protein, 359 aa, Homo sapiens
  Payload ID: 8559
  Gene Symbol: ISL2
  Gene Name: ISL LIM homeobox 2
  Uniprot ID: Q96A47
  ENSP ID: ENSP00000290759
MVDIIFHYPFLGAMGDHSKKKPGTAMCVGCGSQIHDQFILRVSPDLEWHAACLKCAECSQYLDETCTCFVRDGKTYCKRDYVRLFGIKCAKCQVGFSSSDLVMRARDSVYHIECFRCSVCSRQLLPGDEFSLREHELLCRADHGLLLERAAAGSPRSPGPLPGARGLHLPDAGSGRQPALRPHVHKQTEKTTRVRTVLNEKQLHTLRTCYAANPRPDALMKEQLVEMTGLSPRVIRVWFQNKRCKDKKKSILMKQLQQQQHSDKTSLQGLTGTPLVAGSPIRHENAVQGSAVEVQTYQPPWKALSEFALQSDLDQPAFQQLVSFSESGSLGNSSGSDVTSLSSQLPDTPNSMVPSPVET

SEQ ID NO: 42079 - protein, 195 aa, Homo sapiens
  Payload ID: 8559
  Gene Symbol: ISL2
  Gene Name: ISL LIM homeobox 2
  ENSP ID: ENSP00000453837
MVDIIFHYPFLGAMGDHSKKKPGTAMCVGCGSQIHDQFILRVSPDLEWHAACLKCAECSQYLDETCTCFVRDGKTYCKRDYVRRWVGPAARVAPARAQADGEDDPRADCAEREAAAHSADLLRRQPAARRSHEGAAGGDDRPEPAGHPRLVPEQALQGQEEIHSHEAAAAAAAQRQDEPSGTDWDAPGGGQSHPP

SEQ ID NO: 42080 - protein, 89 aa, Homo sapiens
  Payload ID: 8560
  Gene Symbol: IAPP
  Gene Name: islet amyloid polypeptide
  Uniprot ID: P10997
  ENSP ID: ENSP00000240652
MGILKLQVFLIVLSVALNHLKATPIESHQVEKRKCNTATCATQRLANFLVHSSNNFGAILSSTNVGSNTYGKRNAVEVLKREPLNYLPL

SEQ ID NO: 42081 - protein, 89 aa, Homo sapiens; identical to SEQ ID NO: 42080
  Payload ID: 8560
  Gene Symbol: IAPP
  Gene Name: islet amyloid polypeptide
  Uniprot ID: P10997
  ENSP ID: ENSP00000437357

SEQ ID NO: 42082 - protein, 85 aa, Homo sapiens
  Payload ID: 8560
  Gene Symbol: IAPP
  Gene Name: islet amyloid polypeptide
  ENSP ID: ENSP00000437559
  MOD_RES (1)..(1): Any amino acid
XLKATPIERCLDQIPIFTVFQENHQVEKRKCNTATCATQRLANFLVHSSNNFGAILSSTNVGSNTYGKRNAVEVLKREPLNYLPL

SEQ ID NO: 42083 - protein, 79 aa, Homo sapiens
  Payload ID: 8560
  Gene Symbol: IAPP
  Gene Name: islet amyloid polypeptide
  ENSP ID: ENSP00000445711
MGILKLQVFLIVLSVALNHLKATPIERQEWIIPVLSRNILLELRGAKPEHEAGKKSKVIRWKSGNATLPHVQRSAWQIF

SEQ ID NO: 42084 - protein, 79 aa, Homo sapiens
  Payload ID: 8560
  Gene Symbol: IAPP
  Gene Name: islet amyloid polypeptide
  ENSP ID: ENSP00000445980
MGILKLQVFLIVLSVALNHLKATPIESHQVEKRKCNTATCATQRLANFLVHSSNNFGAILSSTNVGSNTYGKRNAVEVL

SEQ ID NO: 42085 - protein, 482 aa, Homo sapiens
  Payload ID: 8561
  Gene Symbol: ICA1
  Gene Name: islet cell autoantigen 1, 69kDa
  Uniprot ID: Q05084
  ENSP ID: ENSP00000265577
MSGHKCYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQTTLLHFWEKTSHTMAAIHESFKGYQPYEFTTLKSLQDPMKKLVEKEEKKKINQQESTDAAVQEPSQLISLEEENQRKESSSFKTEDGKSILSALDKGSTHTACSGPIDELLDMKSEEGACLGPVAGTPEPEGADKDDLLLLSEIFNASSLEEGEFSKEWAAVFGDGQVKEPVPTMALGEPDPKAQTGSGFLPSQLLDQNMKDLQASLQEPAKAASDLTAWFSLFADLDPLSNPDAVGKTDKEHELLNA

SEQ ID NO: 42086 - protein, 256 aa, Homo sapiens
  Payload ID: 8561
  Gene Symbol: ICA1
  Gene Name: islet cell autoantigen 1, 69kDa
  ENSP ID: ENSP00000316074
MDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQTTLLHFWEKTSHTMAAIHESFKGYQPYEFTTLK

SEQ ID NO: 42087 - protein, 257 aa, Homo sapiens
  Payload ID: 8561
  Gene Symbol: ICA1
  Gene Name: islet cell autoantigen 1, 69kDa
  ENSP ID: ENSP00000341603
MSGHKCSYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQLAWDQWQGPRNLKVLTKMTCCC

SEQ ID NO: 42088 - protein, 483 aa, Homo sapiens
  Payload ID: 8561
  Gene Symbol: ICA1
  Gene Name: islet cell autoantigen 1, 69kDa
  Uniprot ID: Q05084
  ENSP ID: ENSP00000379908
MSGHKCSYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQTTLLHFWEKTSHTMAAIHESFKGYQPYEFTTLKSLQDPMKKLVEKEEKKKINQQESTDAAVQEPSQLISLEEENQRKESSSFKTEDGKSILSALDKGSTHTACSGPIDELLDMKSEEGACLGPVAGTPEPEGADKDDLLLLSEIFNASSLEEGEFSKEWAAVFGDGQVKEPVPTMALGEPDPKAQTGSGFLPSQLLDQNMKDLQASLQEPAKAASDLTAWFSLFADLDPLSNPDAVGKTDKEHELLNA

SEQ ID NO: 42089 - protein, 471 aa, Homo sapiens
  Payload ID: 8561
  Gene Symbol: ICA1
  Gene Name: islet cell autoantigen 1, 69kDa
  ENSP ID: ENSP00000385305
MDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQTTLLHFWEKTSHTMAAIHESFKGYQPYEFTTLKSLQDPMKKLVEKEEKKKINQQESTDAAVQEPSQLISLEEENQRKESSSFKTEDGKSILSALDKGSTHTACSGPIDELLDMKSEEGACLGPVAGTPEPEGADKDDLLLLSEIFNASSLEEGEFSKEWAAVFGDGQVKEPVPTMALGEPDPKAQTGSGFLPSQLLDQNMKDLQASLQEPAKAASDLTAWFSLFADLDPLSNPDAVGKTDKEHELLNA

SEQ ID NO: 42090 - protein, 483 aa, Homo sapiens; identical to SEQ ID NO: 42088
  Payload ID: 8561
  Gene Symbol: ICA1
  Gene Name: islet cell autoantigen 1, 69kDa
  Uniprot ID: Q05084
  ENSP ID: ENSP00000385570

SEQ ID NO: 42091 - protein, 483 aa, Homo sapiens; identical to SEQ ID NO: 42088
  Payload ID: 8561
  Gene Symbol: ICA1
  Gene Name: islet cell autoantigen 1, 69kDa
  Uniprot ID: Q05084
  ENSP ID: ENSP00000385651

SEQ ID NO: 42092 - protein, 350 aa, Homo sapiens
  Payload ID: 8561
  Gene Symbol: ICA1
  Gene Name: islet cell autoantigen 1, 69kDa
  ENSP ID: ENSP00000386021
MSGHKCSYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQTTLLHFWEKTSHTMAAIHESFKGYQPYEFTTLKVWKLEGPLENLEKSKVLFISQAKSIAESIIIPGLRMLKRELCPQQSLFLSFFLSFFFFFFFFTASGFNTMRIYCNPKARIEP

SEQ ID NO: 42093 - protein, 85 aa, Homo sapiens
  Payload ID: 8561
  Gene Symbol: ICA1
  Gene Name: islet cell autoantigen 1, 69kDa
  ENSP ID: ENSP00000393314
MSGHKCSYPWDLQDRYAQDKSVVNKMQQKYWETKQAFIKATGKKEDEHVVASDADLDAKLELFHSIQRTCLDLSKAIVLYQKRIC

SEQ ID NO: 42094 - protein, 134 aa, Homo sapiens
  Payload ID: 8561
  Gene Symbol: ICA1
  Gene Name: islet cell autoantigen 1, 69kDa
  ENSP ID: ENSP00000397496
MSGHKCYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLC

SEQ ID NO: 42095 - protein, 162 aa, Homo sapiens
  Payload ID: 8561
  Gene Symbol: ICA1
  Gene Name: islet cell autoantigen 1, 69kDa
  ENSP ID: ENSP00000398435
MSGHKCSYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQC

SEQ ID NO: 42096 - protein, 512 aa, Homo sapiens
  Payload ID: 8561
  Gene Symbol: ICA1
  Gene Name: islet cell autoantigen 1, 69kDa
  Uniprot ID: Q05084
  ENSP ID: ENSP00000403982
MSGHKCSYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQTTLLHFWEKTSHTMAAIHESFKGYQPYEFTTLKSLQDPMKKLVEKEEKKKINQQESTDAAVQEPSQYLQNICLEMKANSDIKMLQKGKEGQQIGILISLEEENQRKESSSFKTEDGKSILSALDKGSTHTACSGPIDELLDMKSEEGACLGPVAGTPEPEGADKDDLLLLSEIFNASSLEEGEFSKEWAAVFGDGQVKEPVPTMALGEPDPKAQTGSGFLPSQLLDQNMKDLQASLQEPAKAASDLTAWFSLFADLDPLSNPDAVGKTDKEHELLNA

SEQ ID NO: 42097 - protein, 70 aa, Homo sapiens
  Payload ID: 8561
  Gene Symbol: ICA1
  Gene Name: islet cell autoantigen 1, 69kDa
  ENSP ID: ENSP00000406722
MSGHKCYPWDLQDRYAQDKSVVNKMQQKYWETKQAFIKATGKKEDEHVVASDADLDAKLELFHSIQRTCL

SEQ ID NO: 42098 - protein, 87 aa, Homo sapiens
  Payload ID: 8561
  Gene Symbol: ICA1
  Gene Name: islet cell autoantigen 1, 69kDa
  ENSP ID: ENSP00000410341
MSGHKCSYPWDLQDRYAQDKSVVNKMQQKYWETKQAFIKATGKKEDEHVVASDADLDAKLELFHSIQRTCLDLSKAIVLYQKRICSF

SEQ ID NO: 42099 - protein, 482 aa, Homo sapiens
  Payload ID: 8562
  Gene Symbol: ICA1L
  Gene Name: islet cell autoantigen 1,69kDa-like
  Uniprot ID: Q8NDH6
  ENSP ID: ENSP00000351047
MDSFGQPRPEDNQSVVRRMQKKYWKTKQVFIKATGKKEDEHLVASDAELDAKLEVFHSVQETCTELLKIIEKYQLRLNVISEEENELGLFLKFQAERDATQAGKMMDATGKALCSSAKQRLALCTPLSRLKQEVATFSQRAVSDTLMTINRMEQARTEYRGALLWMKDVSQELDPDTLKQMEKFRKVQMQVRNSKASFDKLKMDVCQKVDLLGASRCNMLSHSLTTYQRTLLGFWKKTARMMSQIHEACIGFHPYDFVALKQLQDTPSKISEDNKDEQIGGFLTEQLNKLVLSDEEASFESEQANKDHNEKHSQMREFGAPQFSNSENVAKDLPVDSLEGEDFEKEFSFLNNLLSSGSSSTSEFTQECQTAFGSPSASLTSQEPSMGSEPLAHSSRFLPSQLFDLGFHVAGAFNNWVSQEESELCLSHTDNQPVPSQSPKKLTRSPNNGNQDMSAWFNLFADLDPLSNPDAIGHSDDELLNA

SEQ ID NO: 42100 - protein, 482 aa, Homo sapiens; identical to SEQ ID NO: 42099
  Payload ID: 8562
  Gene Symbol: ICA1L
  Gene Name: islet cell autoantigen 1,69kDa-like
  Uniprot ID: Q8NDH6
  ENSP ID: ENSP00000376070

SEQ ID NO: 42101 - protein, 119 aa, Homo sapiens
  Payload ID: 8562
  Gene Symbol: ICA1L
  Gene Name: islet cell autoantigen 1,69kDa-like
  ENSP ID: ENSP00000387382
MDSFGQPRPEDNQSVVRRMQKKYWKTKQVFIKATGKKEDEHLVASDAELDAKLEVFHSVQETCTELLKIIEKYQLRLNVISEEENELGLFLKFQAERDATQAGKMMDATGKALCSSAKQ

SEQ ID NO: 42102 - protein, 98 aa, Homo sapiens
  Payload ID: 8562
  Gene Symbol: ICA1L
  Gene Name: islet cell autoantigen 1,69kDa-like
  ENSP ID: ENSP00000392609
MDSFGQPRPEDNQSVVRRMQKKYWKTKQVFIKATGKKEDEHLVASDAELDAKLEVFHSVQETCTELLKIIEKYQLRLNVISEEENELGLFLKFQAERD

SEQ ID NO: 42103 - protein, 99 aa, Homo sapiens
  Payload ID: 8562
  Gene Symbol: ICA1L
  Gene Name: islet cell autoantigen 1,69kDa-like
  ENSP ID: ENSP00000397827
MDSFGQPRPEDNQSVVRRMQKKYWKTKQVFIKATGKKEDEHLVASDAELDAKLEVFHSVQETCTELLKIIEKYQLRLNVISEEENELGLFLKFQAERDA

SEQ ID NO: 42104 - protein, 60 aa, Homo sapiens
  Payload ID: 8562
  Gene Symbol: ICA1L
  Gene Name: islet cell autoantigen 1,69kDa-like
  ENSP ID: ENSP00000398420
MDSFGQPRPEDNQSVVRRMQKKYWKTKQVFIKATGKKEDEHLVASDAELDAKLERHALNF

SEQ ID NO: 42105 - protein, 439 aa, Homo sapiens
  Payload ID: 8562
  Gene Symbol: ICA1L
  Gene Name: islet cell autoantigen 1,69kDa-like
  ENSP ID: ENSP00000398916
MDSFGQPRPEDNQSVVRRMQKKYWKTKQVFIKATGKKEDEHLVASDAELDAKLEVFHSVQETCTELLKIIEKYQLRLNVISEEENELGLFLKFQAERDATQAGKMMDATGKALCSSAKQRLALCTPLSRLKQEVATFSQRAVSDTLMTINRMEQARTEYRGALLWMKDVSQELDPDTLKQMEKFRKVQMQVRNSKASFDKLKMDVCQKVDLLGASRCNMLSHSLTTYQRTLLGFWKKTARMMSQIHEACIGFHPYDFVALKQLQDTPSKISEDNKDEQIGGFLTEQLNKLVLSDEEASFESEQANKDHNEKHSQMREFGAPQFSNSENVAKDLPVDSLEGEDFEKEFSFLNNLLSSGSSSTSEFTQECQTAFGSPSASLTSQEPSMGSEPLAHSSRFLPSQLFDLGFHVAGAFNNNAAKKKKSCMYFFLQLNYFLKKNC

SEQ ID NO: 42106 - protein, 111 aa, Homo sapiens
  Payload ID: 8562
  Gene Symbol: ICA1L
  Gene Name: islet cell autoantigen 1,69kDa-like
  ENSP ID: ENSP00000400249
MDSFGQPRPEDNQSVVRRMQKKYWKTKQVFIKATGKKEDEHLVASDAELDAKLEVFHSVQETCTELLKIIEKYQLRLNVAKDLPVDSLEGEDFEKEFSFLNNLLSSGSSST

SEQ ID NO: 42107 - protein, 187 aa, Homo sapiens
  Payload ID: 8562
  Gene Symbol: ICA1L
  Gene Name: islet cell autoantigen 1,69kDa-like
  Uniprot ID: Q8NDH6
  ENSP ID: ENSP00000404189
MDSFGQPRPEDNQSVVRRMQKKYWKTKQVFIKATGKKEDEHLVASDAELDAKLEVFHSVQETCTELLKIIEKYQLRLNVISEEENELGLFLKFQAERDATQAGKMMDATGKALCSSAKQRLALCTPLSRLKQEVATFSQRAVSDTLMTINRMEQARTEYRGALLWMKDVSQELDPDTLKQMEKFRKV

SEQ ID NO: 42108 - protein, 119 aa, Homo sapiens; identical to SEQ ID NO: 42101
  Payload ID: 8562
  Gene Symbol: ICA1L
  Gene Name: islet cell autoantigen 1,69kDa-like
  ENSP ID: ENSP00000404618

SEQ ID NO: 42109 - protein, 100 aa, Homo sapiens
  Payload ID: 8562
  Gene Symbol: ICA1L
  Gene Name: islet cell autoantigen 1,69kDa-like
  ENSP ID: ENSP00000404707
MDSFGQPRPEDNQSVVRRMQKKYWKTKQVFIKATGKKEDEHLVASDAELDAKLEVFHSVQETCTELLKIIEKYQLRLNVISEEENELGLFLKFQAERDAT

SEQ ID NO: 42110 - protein, 134 aa, Homo sapiens
  Payload ID: 8562
  Gene Symbol: ICA1L
  Gene Name: islet cell autoantigen 1,69kDa-like
  ENSP ID: ENSP00000405592
MDSFGQPRPEDNQSVVRRMQKKYWKTKQVFIKATGKKEDEHLVASDAELDAKLEVFHSVQETCTELLKIIEKYQLRLNVISEEENELGLFLKFQAERDATQAGKMMDATGKALCSSAKQRLALCTPLSRLKQEV

SEQ ID NO: 42111 - protein, 78 aa, Homo sapiens
  Payload ID: 8562
  Gene Symbol: ICA1L
  Gene Name: islet cell autoantigen 1,69kDa-like
  ENSP ID: ENSP00000409741
MDSFGQPRPEDNQSVVRRMQKKYWKTKQVFIKATGKKEDEHLVASDAELDAKLEVFHSVQETCTELLKIIEKYQLRLN

SEQ ID NO: 42112 - protein, 124 aa, Homo sapiens
  Payload ID: 8562
  Gene Symbol: ICA1L
  Gene Name: islet cell autoantigen 1,69kDa-like
  ENSP ID: ENSP00000410135
MDSFGQPRPEDNQSVVRRMQKKYWKTKQVFIKATGKKEDEHLVASDAELDAKLEVFHSVQETCTELLKIIEKYQLRLNVISEEENELGLFLKFQAERDATQAGKMMDATGKALCSSAKQRLALC

SEQ ID NO: 42113 - protein, 150 aa, Homo sapiens
  Payload ID: 8562
  Gene Symbol: ICA1L
  Gene Name: islet cell autoantigen 1,69kDa-like
  ENSP ID: ENSP00000410747
MDSFGQPRPEDNQSVVRRMQKKYWKTKQVFIKATGKKEDEHLVASDAELDAKLEVFHSVQETCTELLKIIEKYQLRLNVISEEENELGLFLKFQAERDATQAGKMMDATGKALCSSAKQRLALCTPLSRLKQEVATFSQRAVSDTLMTIN

SEQ ID NO: 42114 - protein, 77 aa, Homo sapiens
  Payload ID: 8562
  Gene Symbol: ICA1L
  Gene Name: islet cell autoantigen 1,69kDa-like
  ENSP ID: ENSP00000412158
MDSFGQPRPEDNQSVVRRMQKKYWKTKQVFIKATGKKEDEHLVASDAELDAKLEIGPVYSSVSSEARSSNIQSKGSI

SEQ ID NO: 42115 - protein, 42 aa, Homo sapiens
  Payload ID: 8562
  Gene Symbol: ICA1L
  Gene Name: islet cell autoantigen 1,69kDa-like
  ENSP ID: ENSP00000414916
MDSFGQPRPEDNQSVVRRMQKKYWKTKQVFIKATGKKEDEHL

SEQ ID NO: 42116 - protein, 96 aa, Homo sapiens
  Payload ID: 8562
  Gene Symbol: ICA1L
  Gene Name: islet cell autoantigen 1,69kDa-like
  ENSP ID: ENSP00000416726
MDSFGQPRPEDNQSVVRRMQKKYWKTKQVFIKATGKKEDEHLVASDAELDAKLEVFHSVQETCTELLKIIEKYQLRLNVISEEENELGLFLKFQAE

SEQ ID NO: 42117 - protein, 482 aa, Homo sapiens; identical to SEQ ID NO: 42099
  Payload ID: 8562
  Gene Symbol: ICA1L
  Gene Name: islet cell autoantigen 1,69kDa-like
  Uniprot ID: Q8NDH6
  ENSP ID: ENSP00000478645

SEQ ID NO: 42118 - protein, 75 aa, Homo sapiens
  Payload ID: 8563
  Gene Symbol: IAH1
  Gene Name: isoamyl acetate-hydrolyzing esterase 1 homolog
  ENSP ID: ENSP00000314400
  MOD_RES (1)..(1): Any amino acid
XEAAGCGSALLWPRLLLFGDSITQFSFQQGGWGASLADRLVRLQYQVGQNYPSKINQERKQFGHPSSSYNFLWGQ

SEQ ID NO: 42119 - protein, 248 aa, Homo sapiens
  Payload ID: 8563
  Gene Symbol: IAH1
  Gene Name: isoamyl acetate-hydrolyzing esterase 1 homolog
  Uniprot ID: Q2TAA2
  ENSP ID: ENSP00000417580
MALCEAAGCGSALLWPRLLLFGDSITQFSFQQGGWGASLADRLVRKCDVLNRGFSGYNTRWAKIILPRLIRKGNSLDIPVAVTIFFGANDSALKDENPKQHIPLEEYAANLKSMVQYLKSVDIPENRVILITPTPLCETAWEEQCIIQGCKLNRLNSVVGEYANACLQVAQDCGTDVLDLWTLMQDSQDFSSYLSDGLHLSPKGNEFLFSHLWPLIEKKVSSLPLLLPYWRDVAEAKPELSLLGDGDH

SEQ ID NO: 42120 - protein, 74 aa, Homo sapiens
  Payload ID: 8563
  Gene Symbol: IAH1
  Gene Name: isoamyl acetate-hydrolyzing esterase 1 homolog
  ENSP ID: ENSP00000418492
MVQYLKSVDIPENRVILITPTPLCETAWEEQCIIQGCKLNRLNSVVGEYANACLQVAQDCGTDVLDLWTLMQDS

SEQ ID NO: 42121 - protein, 135 aa, Homo sapiens
  Payload ID: 8563
  Gene Symbol: IAH1
  Gene Name: isoamyl acetate-hydrolyzing esterase 1 homolog
  Uniprot ID: Q2TAA2
  ENSP ID: ENSP00000419110
MVQYLKSVDIPENRVILITPTPLCETAWEEQCIIQGCKLNRLNSVVGEYANACLQVAQDCGTDVLDLWTLMQDSQDFSSYLSDGLHLSPKGNEFLFSHLWPLIEKKVSSLPLLLPYWRDVAEAKPELSLLGDGDH

SEQ ID NO: 42122 - protein, 135 aa, Homo sapiens; identical to SEQ ID NO: 42121
  Payload ID: 8563
  Gene Symbol: IAH1
  Gene Name: isoamyl acetate-hydrolyzing esterase 1 homolog
  Uniprot ID: Q2TAA2
  ENSP ID: ENSP00000419224

SEQ ID NO: 42123 - protein, 40 aa, Homo sapiens
  Payload ID: 8563
  Gene Symbol: IAH1
  Gene Name: isoamyl acetate-hydrolyzing esterase 1 homolog
  ENSP ID: ENSP00000419368
MALCEAAGCGSALLWPRLLLFGDSITQVTIPGGPKLSFQD

SEQ ID NO: 42124 - protein, 228 aa, Homo sapiens
  Payload ID: 8563
  Gene Symbol: IAH1
  Gene Name: isoamyl acetate-hydrolyzing esterase 1 homolog
  ENSP ID: ENSP00000419807
  MOD_RES (1)..(1): Any amino acid
XARPRAAGVPCSGLACCSSGTPSPRKCDVLNRGFSGYNTRWAKIILPRLIRKGNSLDIPVAVTIFFGANDSALKDENPKQHIPLEEYAANLKSMVQYLKSVDIPENRVILITPTPLCETAWEEQCIIQGCKLNRLNSVVGEYANACLQVAQDCGTDVLDLWTLMQDSQDFSSYLSDGLHLSPKGNEFLFSHLWPLIEKKVSSLPLLLPYWRDVAEAKPELSLLGDGDH

SEQ ID NO: 42125 - protein, 160 aa, Homo sapiens
  Payload ID: 8563
  Gene Symbol: IAH1
  Gene Name: isoamyl acetate-hydrolyzing esterase 1 homolog
  ENSP ID: ENSP00000420532
MQFSFQQGGWGASLADRLVRKCDVLNRGFSGYNTRWAKIILPRLIRKGNSLDIPVAVTIFFGANDSALKDENPKQHIPLEEYAANLKSMVQYLKSVDIPENRVILITPTPLCETAWEEQCIIQGCKLNRLNSVVGEYANACLQVAQDCGTDVLDLWTLMQ

SEQ ID NO: 42126 - protein, 47 aa, Homo sapiens
  Payload ID: 8563
  Gene Symbol: IAH1
  Gene Name: isoamyl acetate-hydrolyzing esterase 1 homolog
  ENSP ID: ENSP00000420562
MVQYLKSVDIPENRVILITPTPLCETAWEEQCIIQGCKLNRLNSVVG

SEQ ID NO: 42127 - protein, 298 aa, Homo sapiens
  Payload ID: 8564
  Gene Symbol: ISOC1
  Gene Name: isochorismatase domain containing 1
  Uniprot ID: Q96CN7
  ENSP ID: ENSP00000173527
MAAAEPAVLALPNSGAGGAGAPSGTVPVLFCFSVFARPSSVPHGAGYELLIQKFLSLYGDQIDMHRKFVVQLFAEEWGQYVDLPKGFAVSERCKVRLVPLQIQLTTLGNLTPSSTVFFCCDMQERFRPAIKYFGDIISVGQRLLQGARILGIPVIVTEQYPKGLGSTVQEIDLTGVKLVLPKTKFSMVLPEVEAALAEIPGVRSVVLFGVETHVCIQQTALELVGRGVEVHIVADATSSRSMMDRMFALERLARTGIIVTTSEAVLLQLVADKDHPKFKEIQNLIKASAPESGLLSKV

SEQ ID NO: 42128 - protein, 188 aa, Homo sapiens
  Payload ID: 8564
  Gene Symbol: ISOC1
  Gene Name: isochorismatase domain containing 1
  ENSP ID: ENSP00000421273
MAAAEPAVLALPNSGAGGAGAPSGTVPVLFCFSVFARPSSVPHGAGYELLIQKFLSLYGDQIDMHRKFVVQLFAEEWGQYVDLPKGFAVSERCKLTTLGNLTPSSTVFFCCDMQERFRPAIKYFGDIISVGQRLLQGARILGIPVIVTEQYPKGLGSTVQEIDLTGVKLVLPKTKFSMVLPEVEAALA

SEQ ID NO: 42129 - protein, 221 aa, Homo sapiens
  Payload ID: 8565
  Gene Symbol: ISOC2
  Gene Name: isochorismatase domain containing 2
  Uniprot ID: Q96AB3
  ENSP ID: ENSP00000085068
MAAARPSLGRVLPGSSVLFLCDMQEKFRHNIAYFPQIVSVAARMLKVARLLEVPVMLTEQYPQGLGPTVPELGTEGLRPLAKTCFSMVPALQQELDSRPQLRSVLLCGIEAQACILDPRSYPGLALTSLYPQNTTLDLLDRGLQVHVVVDACSSRSQVDRLVALARMRQSGAFLSTSEGLILQLVGDAVHPQFKEIQKLIKEPAPDSGLLGLFQGQNSLLH

SEQ ID NO: 42130 - protein, 205 aa, Homo sapiens
  Payload ID: 8565
  Gene Symbol: ISOC2
  Gene Name: isochorismatase domain containing 2
  Uniprot ID: Q96AB3
  ENSP ID: ENSP00000401726
MAAARPSLGRVLPGSSVLFLCDMQEKFRHNIAYFPQIVSVAARMLKVARLLEVPVMLTEQYPQGLGPTVPELGTEGLRPLAKTCFSMVPALQQELDSRPQLRSVLLCGIEAQACILNTTLDLLDRGLQVHVVVDACSSRSQVDRLVALARMRQSGAFLSTSEGLILQLVGDAVHPQFKEIQKLIKEPAPDSGLLGLFQGQNSLLH

SEQ ID NO: 42131 - protein, 135 aa, Homo sapiens
  Payload ID: 8565
  Gene Symbol: ISOC2
  Gene Name: isochorismatase domain containing 2
  Uniprot ID: Q96AB3
  ENSP ID: ENSP00000406364
MAAARPSLGRVLPGSSVLFLCDMQEKFRHNIAYFPQIVSVAARMLKNTTLDLLDRGLQVHVVVDACSSRSQVDRLVALARMRQSGAFLSTSEGLILQLVGDAVHPQFKEIQKLIKEPAPDSGLLGLFQGQNSLLH

SEQ ID NO: 42132 - protein, 178 aa, Homo sapiens
  Payload ID: 8565
  Gene Symbol: ISOC2
  Gene Name: isochorismatase domain containing 2
  ENSP ID: ENSP00000465814
MAAARPSLGRVLPGSSVLFLCDMQEKFRHNIAYFPQIVSVAARMLKVARLLEVPVMLTEQYPQGLGPTVPELGTEGLRPLAKTCFSMVPALQQELDSRPQLRSVLLCGIEAQACILNTTLDLLDRGLQVHVVVDACSSRSQVDRLVALARMRQSGAFLSTSEGLILQLVGDAVHPQFK

SEQ ID NO: 42133 - protein, 174 aa, Homo sapiens
  Payload ID: 8565
  Gene Symbol: ISOC2
  Gene Name: isochorismatase domain containing 2
  ENSP ID: ENSP00000467111
MAAARPSLGRVLPGSSVLFLCDMQEKFRHNIAYFPQIVSVAARMLKVARLLEVPVMLTEQYPQGLGPTVPELGTEGLRPLAKTCFSMVPALQQELDSRPQLRSVLLCGIEAQACILNTTLDLLDRGLQVHVVVDACSSRSQVDRLVALARMRQSGAFLSTSEGLILQLVGDAVH

SEQ ID NO: 42134 - protein, 414 aa, Homo sapiens
  Payload ID: 8566
  Gene Symbol: IDH1
  Gene Name: isocitrate dehydrogenase 1 (NADP+), soluble
  Uniprot ID: O75874
  ENSP ID: ENSP00000260985
MSKKISGGSVVEMQGDEMTRIIWELIKEKLIFPYVELDLHSYDLGIENRDATNDQVTKDAAEAIKKHNVGVKCATITPDEKRVEEFKLKQMWKSPNGTIRNILGGTVFREAIICKNIPRLVSGWVKPIIIGRHAYGDQYRATDFVVPGPGKVEITYTPSDGTQKVTYLVHNFEEGGGVAMGMYNQDKSIEDFAHSSFQMALSKGWPLYLSTKNTILKKYDGRFKDIFQEIYDKQYKSQFEAQKIWYEHRLIDDMVAQAMKSEGGFIWACKNYDGDVQSDSVAQGYGSLGMMTSVLVCPDGKTVEAEAAHGTVTRHYRMYQKGQETSTNPIASIFAWTRGLAHRAKLDNNKELAFFANALEEVSIETIEAGFMTKDLAACIKGLPNVQRSDYLNTFEFMDKLGENLKIKLAQAKL

SEQ ID NO: 42135 - protein, 414 aa, Homo sapiens; identical to SEQ ID NO: 42134
  Payload ID: 8566
  Gene Symbol: IDH1
  Gene Name: isocitrate dehydrogenase 1 (NADP+), soluble
  Uniprot ID: O75874
  ENSP ID: ENSP00000390265

SEQ ID NO: 42136 - protein, 157 aa, Homo sapiens
  Payload ID: 8566
  Gene Symbol: IDH1
  Gene Name: isocitrate dehydrogenase 1 (NADP+), soluble
  ENSP ID: ENSP00000391075
MSKKISGGSVVEMQGDEMTRIIWELIKEKLIFPYVELDLHSYDLGIENRDATNDQVTKDAAEAIKKHNVGVKCATITPDEKRVEEFKLKQMWKSPNGTIRNILGGTVFREAIICKNIPRLVSGWVKPIIIGRHAYGDQYRATDFVVPGPGKVEITYT

SEQ ID NO: 42137 - protein, 62 aa, Homo sapiens
  Payload ID: 8566
  Gene Symbol: IDH1
  Gene Name: isocitrate dehydrogenase 1 (NADP+), soluble
  ENSP ID: ENSP00000396787
MSKKISGGSVVEMQGDEMTRIIWELIKEKLIFPYVELDLHSYDLGIENRDATNDQVTKDAAE

SEQ ID NO: 42138 - protein, 73 aa, Homo sapiens
  Payload ID: 8566
  Gene Symbol: IDH1
  Gene Name: isocitrate dehydrogenase 1 (NADP+), soluble
  ENSP ID: ENSP00000409045
MSKKISGGSVVEMQGDEMTRIIWELIKEKLIFPYVELDLHSYDLGIENRDATNDQVTKDAAEAIKKHNVGVKC

SEQ ID NO: 42139 - protein, 414 aa, Homo sapiens; identical to SEQ ID NO: 42134
  Payload ID: 8566
  Gene Symbol: IDH1
  Gene Name: isocitrate dehydrogenase 1 (NADP+), soluble
  Uniprot ID: O75874
  ENSP ID: ENSP00000410513

SEQ ID NO: 42140 - protein, 452 aa, Homo sapiens
  Payload ID: 8567
  Gene Symbol: IDH2
  Gene Name: isocitrate dehydrogenase 2 (NADP+), mitochondrial
  Uniprot ID: P48735
  ENSP ID: ENSP00000331897
MAGYLRVVRSLCRASGSRPAWAPAALTAPTSQEQPRRHYADKRIKVAKPVVEMDGDEMTRIIWQFIKEKLILPHVDIQLKYFDLGLPNRDQTDDQVTIDSALATQKYSVAVKCATITPDEARVEEFKLKKMWKSPNGTIRNILGGTVFREPIICKNIPRLVPGWTKPITIGRHAHGDQYKATDFVADRAGTFKMVFTPKDGSGVKEWEVYNFPAGGVGMGMYNTDESISGFAHSCFQYAIQKKWPLYMSTKNTILKAYDGRFKDIFQEIFDKHYKTDFDKNKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQMLEKVCVETVESGAMTKDLAGCIHGLSNVKLNEHFLNTTDFLDTIKSNLDRALGRQ

SEQ ID NO: 42141 - protein, 400 aa, Homo sapiens
  Payload ID: 8567
  Gene Symbol: IDH2
  Gene Name: isocitrate dehydrogenase 2 (NADP+), mitochondrial
  Uniprot ID: P48735
  ENSP ID: ENSP00000446147
MDGDEMTRIIWQFIKEKLILPHVDIQLKYFDLGLPNRDQTDDQVTIDSALATQKYSVAVKCATITPDEARVEEFKLKKMWKSPNGTIRNILGGTVFREPIICKNIPRLVPGWTKPITIGRHAHGDQYKATDFVADRAGTFKMVFTPKDGSGVKEWEVYNFPAGGVGMGMYNTDESISGFAHSCFQYAIQKKWPLYMSTKNTILKAYDGRFKDIFQEIFDKHYKTDFDKNKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQMLEKVCVETVESGAMTKDLAGCIHGLSNVKLNEHFLNTTDFLDTIKSNLDRALGRQ

SEQ ID NO: 42142 - protein, 312 aa, Homo sapiens
  Payload ID: 8567
  Gene Symbol: IDH2
  Gene Name: isocitrate dehydrogenase 2 (NADP+), mitochondrial
  ENSP ID: ENSP00000453016
MAGYLRVVRSLCRASGSRPAWAPAALTAPTSQEQPRRHYADKRIKVAKPVVEMDGDEMTRIIWQFIKEKYKATDFVADRAGTFKMVFTPKDGSGVKEWEVYNFPAGGVGMGMYNTDESISGFAHSCFQYAIQKKWPLYMSTKNTILKAYDGRFKDIFQEIFDKHYKTDFDKNKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLISVKLNEHFLNTTDFLDTIKSNLDRALGRQ

SEQ ID NO: 42143 - protein, 38 aa, Homo sapiens
  Payload ID: 8567
  Gene Symbol: IDH2
  Gene Name: isocitrate dehydrogenase 2 (NADP+), mitochondrial
  ENSP ID: ENSP00000453254
MAGYLRVVRSLCRASGSRPAWAPAALTAPTSQEQPRRH

SEQ ID NO: 42144 - protein, 366 aa, Homo sapiens
  Payload ID: 8568
  Gene Symbol: IDH3A
  Gene Name: isocitrate dehydrogenase 3 (NAD+) alpha
  Uniprot ID: P50213
  ENSP ID: ENSP00000299518
MAGPAWISKVSRLLGAFHNPKQVTRGFTGGVQTVTLIPGDGIGPEISAAVMKIFDAAKAPIQWEERNVTAIQGPGGKWMIPSEAKESMDKNKMGLKGPLKTPIAAGHPSMNLLLRKTFDLYANVRPCVSIEGYKTPYTDVNIVTIRENTEGEYSGIEHVIVDGVVQSIKLITEGASKRIAEFAFEYARNNHRSNVTAVHKANIMRMSDGLFLQKCREVAESCKDIKFNEMYLDTVCLNMVQDPSQFDVLVMPNLYGDILSDLCAGLIGGLGVTPSGNIGANGVAIFESVHGTAPDIAGKDMANPTALLLSAVMMLRHMGLFDHAARIEAACFATIKDGKSLTKDLGGNAKCSDFTEEICRRVKDLD

SEQ ID NO: 42145 - protein, 60 aa, Homo sapiens
  Payload ID: 8568
  Gene Symbol: IDH3A
  Gene Name: isocitrate dehydrogenase 3 (NAD+) alpha
  ENSP ID: ENSP00000452620
MAGPAWISKVSRLLGAFHNPKQVTRGFTGGVQTVTLIPGDGIGPEISAAVMKIFDAAKAL

SEQ ID NO: 42146 - protein, 109 aa, Homo sapiens
  Payload ID: 8568
  Gene Symbol: IDH3A
  Gene Name: isocitrate dehydrogenase 3 (NAD+) alpha
  ENSP ID: ENSP00000452754
MKIFDAAKAPIQWEERNVTAIQGPGGKWMIPSEAKESMDKNKMGLKGPLKTPIAAGHPSMNLLLRKTFDLYANVRPCVSIEGYKTPYTDVNIVTIRENTEGEYSGIEHV

SEQ ID NO: 42147 - protein, 36 aa, Homo sapiens
  Payload ID: 8568
  Gene Symbol: IDH3A
  Gene Name: isocitrate dehydrogenase 3 (NAD+) alpha
  ENSP ID: ENSP00000453008
  MOD_RES (1)..(1): Any amino acid
XGPAWISKVSRLLGAFHNPKQVTRGFTGGINFAKLM

SEQ ID NO: 42148 - protein, 37 aa, Homo sapiens
  Payload ID: 8568
  Gene Symbol: IDH3A
  Gene Name: isocitrate dehydrogenase 3 (NAD+) alpha
  ENSP ID: ENSP00000453033
MAGPAWISKVSRLLGAFHNPKQVTRGFTGGINFAKLM

SEQ ID NO: 42149 - protein, 331 aa, Homo sapiens
  Payload ID: 8568
  Gene Symbol: IDH3A
  Gene Name: isocitrate dehydrogenase 3 (NAD+) alpha
  ENSP ID: ENSP00000453084
MAGPAWISKVSRLLGAFHNPKQVTRGFTGGVQTVTLIPGDGIGPEISAAVMKIFDAAKAPIQWEERNVTAIQGPGGKWMIPSEAKESMDKNKMGLKGYKTPYTDVNIVTIRENTEGEYSGIEHVIVDGVVQSIKLITEGASKRIAEFAFEYARNNHRSNVTAVHKANIMRMSDGLFLQKCREVAESCKDIKFNEMYLDTVCLNMVQDPSQFDVLVMPNLYGDILSDLCAGLIGGLGVTPSGNIGANGVAIFESVHGTAPDIAGKDMANPTALLLSAVMMLRHMGLFDHAARIEAACFATIKDGKSLTKDLGGNAKCSDFTEEICRRVKDLD

SEQ ID NO: 42150 - protein, 42 aa, Homo sapiens
  Payload ID: 8568
  Gene Symbol: IDH3A
  Gene Name: isocitrate dehydrogenase 3 (NAD+) alpha
  ENSP ID: ENSP00000453192
MAGPAWISKVSRLLGAFHNPKQVTRGFTGGEMVLAQKFQLQL

SEQ ID NO: 42151 - protein, 134 aa, Homo sapiens
  Payload ID: 8568
  Gene Symbol: IDH3A
  Gene Name: isocitrate dehydrogenase 3 (NAD+) alpha
  ENSP ID: ENSP00000453222
MKIFDAAKAPIQWEERNVTAIQGPGGKWMIPSEAKESMDKNKMGLKGPLKTPIAAGHPSMNLLLRKTFDLYANVRPCVSIEGYKTPYTDVNIVTIRENTEGEYSGIEHVIVDGVVQSIKLITEGASKRIAEFAF

SEQ ID NO: 42152 - protein, 60 aa, Homo sapiens; identical to SEQ ID NO: 42145
  Payload ID: 8568
  Gene Symbol: IDH3A
  Gene Name: isocitrate dehydrogenase 3 (NAD+) alpha
  ENSP ID: ENSP00000453338

SEQ ID NO: 42153 - protein, 37 aa, Homo sapiens; identical to SEQ ID NO: 42148
  Payload ID: 8568
  Gene Symbol: IDH3A
  Gene Name: isocitrate dehydrogenase 3 (NAD+) alpha
  ENSP ID: ENSP00000453438

SEQ ID NO: 42154 - protein, 48 aa, Homo sapiens
  Payload ID: 8568
  Gene Symbol: IDH3A
  Gene Name: isocitrate dehydrogenase 3 (NAD+) alpha
  ENSP ID: ENSP00000453459
  MOD_RES (1)..(1): Any amino acid
XLFDHAARIEAACFATIKDGKSLTKDLGGNAKCSDFTEEICRRVKDLD

SEQ ID NO: 42155 - protein, 46 aa, Homo sapiens
  Payload ID: 8568
  Gene Symbol: IDH3A
  Gene Name: isocitrate dehydrogenase 3 (NAD+) alpha
  ENSP ID: ENSP00000453480
MKIFDAAKAPIQWEERNVTAIQGPGGKWMIPSEAKESMDKNKMGLK

SEQ ID NO: 42156 - protein, 175 aa, Homo sapiens
  Payload ID: 8568
  Gene Symbol: IDH3A
  Gene Name: isocitrate dehydrogenase 3 (NAD+) alpha
  ENSP ID: ENSP00000453747
MAGPAWISKVSRLLGAFHNPKQVTRGFTGGAPIQWEERNVTAIQGPGGKWMIPSEAKESMDKNKMGLKGPLKTPIAAGHPSMNLLLRKTFDLYANVRPCVSIEGYKTPYTDVNIVTIRENTEGEYSGIEHVIVDGVVQSIKLITEGASKRIAEFAFEYARNNHRSNVTAVHKANI

SEQ ID NO: 42157 - protein, 45 aa, Homo sapiens
  Payload ID: 8568
  Gene Symbol: IDH3A
  Gene Name: isocitrate dehydrogenase 3 (NAD+) alpha
  ENSP ID: ENSP00000453795
MVQDPSQFDVLVMPNLYGDILRFMGRLQTLQARTWRIPQPSCSVP

SEQ ID NO: 42158 - protein, 8 aa, Homo sapiens
  Payload ID: 8568
  Gene Symbol: IDH3A
  Gene Name: isocitrate dehydrogenase 3 (NAD+) alpha
  ENSP ID: ENSP00000453903
MKIFDAAK

SEQ ID NO: 42159 - protein, 87 aa, Homo sapiens
  Payload ID: 8568
  Gene Symbol: IDH3A
  Gene Name: isocitrate dehydrogenase 3 (NAD+) alpha
  ENSP ID: ENSP00000453989
MAGPAWISKVHGTAPDIAGKDMANPTALLLSAVMMLRHMGLFDHAARIEAACFATIKDGKSLTKDLGGNAKCSDFTEEICRRVKDLD

SEQ ID NO: 42160 - protein, 60 aa, Homo sapiens; identical to SEQ ID NO: 42145
  Payload ID: 8568
  Gene Symbol: IDH3A
  Gene Name: isocitrate dehydrogenase 3 (NAD+) alpha
  ENSP ID: ENSP00000453992

SEQ ID NO: 42161 - protein, 37 aa, Homo sapiens; identical to SEQ ID NO: 42148
  Payload ID: 8568
  Gene Symbol: IDH3A
  Gene Name: isocitrate dehydrogenase 3 (NAD+) alpha
  ENSP ID: ENSP00000485769

SEQ ID NO: 42162 - protein, 385 aa, Homo sapiens
  Payload ID: 8569
  Gene Symbol: IDH3B
  Gene Name: isocitrate dehydrogenase 3 (NAD+) beta
  Uniprot ID: O43837
  ENSP ID: ENSP00000370223
MAALSGVRWLTRALVSAGNPGAWRGLSTSAAAHAASRSQAEDVRVEGSFPVTMLPGDGVGPELMHAVKEVFKAAAVPVEFQEHHLSEVQNMASEEKLEQVLSSMKENKVAIIGKIHTPMEYKGELASYDMRLRRKLDLFANVVHVKSLPGYMTRHNNLDLVIIREQTEGEYSSLEHESARGVIECLKIVTRAKSQRIAKFAFDYATKKGRGKVTAVHKANIMKLGDGLFLQCCEEVAELYPKIKFETMIIDNCCMQLVQNPYQFDVLVMPNLYGNIIDNLAAGLVGGAGVVPGESYSAEYAVFETGARHPFAQAVGRNIANPTAMLLSASNMLRHLNLEYHSSMIADAVKKVIKVGKVRTRDMGGYSTTTDFIKSVIGHLQTKGS

SEQ ID NO: 42163 - protein, 383 aa, Homo sapiens
  Payload ID: 8569
  Gene Symbol: IDH3B
  Gene Name: isocitrate dehydrogenase 3 (NAD+) beta
  Uniprot ID: O43837
  ENSP ID: ENSP00000370232
MAALSGVRWLTRALVSAGNPGAWRGLSTSAAAHAASRSQAEDVRVEGSFPVTMLPGDGVGPELMHAVKEVFKAAAVPVEFQEHHLSEVQNMASEEKLEQVLSSMKENKVAIIGKIHTPMEYKGELASYDMRLRRKLDLFANVVHVKSLPGYMTRHNNLDLVIIREQTEGEYSSLEHESARGVIECLKIVTRAKSQRIAKFAFDYATKKGRGKVTAVHKANIMKLGDGLFLQCCEEVAELYPKIKFETMIIDNCCMQLVQNPYQFDVLVMPNLYGNIIDNLAAGLVGGAGVVPGESYSAEYAVFETGARHPFAQAVGRNIANPTAMLLSASNMLRHLNLEYHSSMIADAVKKVIKVGKVRTSDMGGYATCHDFTEAVIAALPHP

SEQ ID NO: 42164 - protein, 387 aa, Homo sapiens
  Payload ID: 8569
  Gene Symbol: IDH3B
  Gene Name: isocitrate dehydrogenase 3 (NAD+) beta
  ENSP ID: ENSP00000482773
MAALSGVRWLTRALVSAGNPGAWRGLSTSAAAHAASRSQAEDVRVEGSFPVTMLPGDGVGPELMHAVKEVFKAAAVPVEFQEHHLSEVQNMASEEKLEQVLSSMKENKVAIIGKIHTPMEYKGELASYDMRLRRKLDLFANVVHVKSLPGYMTRHNNLDLVIIREQTEGEYSSLEHESARGVIECLKIVTRAKSQRIAKFAFDYATKKGRGKVTAVHKANIMKLGDGLFLQCCEEVAELYPKIKFETMIIDNCCMQLVQNPYQFDVLVMPNLYGNIIDNLAAGLVGGAGVVPGESYSAEYAVFETGARHPFAQAVGRNIANPTAMLLSASNMLRHLNLEYHSSMIADAVKKVIKVGKVRTRDMGGYSTTTDFIKSVIGHLQTKGSNL

SEQ ID NO: 42165 - protein, 376 aa, Homo sapiens
  Payload ID: 8569
  Gene Symbol: IDH3B
  Gene Name: isocitrate dehydrogenase 3 (NAD+) beta
  ENSP ID: ENSP00000484922
MAALSGVRWLTRALVSAGNPGAWRGLSTSAAAHAASRSQAEDVRVEGSFPVTMLPGDGVGPELMHAVKEVFKAAAVPVEFQEHHLSEVQNMASEEKLEQVLSSMKENKVAIIGKIHTPMEYKGELASYDMRLRRKLDLFANVVHVKSLPGYMTRHNNLDLVIIREQTEGEYSSLEHESARGVIECLKIVTRAKSQRIAKFAFDYATKKGRGKVTAVHKANIMKLGDGLFLQCCEEVAELYPKIKFETMIIDNCCMQLVQNPYQFDVLVMPNLYGNIIDNLAAGLVGGAGVVPGESYSAEYAVFETGARHPFAQAVGRNIANPTAMLLSASNMLRHLNLEYHSSMIADAVKKVIKVGKIPSAVPSFLLHPLPFSWAI

SEQ ID NO: 42166 - protein, 83 aa, Homo sapiens
  Payload ID: 8569
  Gene Symbol: IDH3B
  Gene Name: isocitrate dehydrogenase 3 (NAD+) beta
  ENSP ID: ENSP00000485997
  MOD_RES (1)..(1): Any amino acid
XKIKFETMIIDNCCMQLVQNPYQFDVLVMPNLYGNIIDNLAAGLVGGAGVVPGCPAPICPGSGQEYSQSHGHAAVGFQHAAAS

SEQ ID NO: 42167 - protein, 145 aa, Homo sapiens
  Payload ID: 8569
  Gene Symbol: IDH3B
  Gene Name: isocitrate dehydrogenase 3 (NAD+) beta
  ENSP ID: ENSP00000487187
  MOD_RES (1)..(1): Any amino acid
XKIKFETMIIDNCCMQLVQNPYQFDVLVMPNLYGNIIDNLAAGLVGGAGVVPGESYSAEYAVFETGARHPFAQAVGRNIANPTAMLLSASNMLRHLNLEYHSSMIADAVKKVIKVGKVRTRDMGGYSTTTDFIKSVIGHLQTKGS

SEQ ID NO: 42168 - protein, 393 aa, Homo sapiens
  Payload ID: 8570
  Gene Symbol: IDH3G
  Gene Name: isocitrate dehydrogenase 3 (NAD+) gamma
  Uniprot ID: P51553
  ENSP ID: ENSP00000217901
MALKVATVAGSAAKAVLGPALLCRPWEVLGAHEVPSRNIFSEQTIPPSAKYGGRHTVTMIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFETATRNTGKSIANKNIANPTATLLASCMMLDHLKLHSYATSIRKAVLASMDNENMHTPDIGGQGTTSEAIQDVIRHIRVINGRAVEA

SEQ ID NO: 42169 - protein, 380 aa, Homo sapiens
  Payload ID: 8570
  Gene Symbol: IDH3G
  Gene Name: isocitrate dehydrogenase 3 (NAD+) gamma
  Uniprot ID: P51553
  ENSP ID: ENSP00000359110
MALKVATVAGSAAKAVLGPALLCRPWEVLGAHEVPSRNIFSEQTIPPSAKYGGRHTVTMIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFETATRNTGKSIANKNIANPTATLLASCMMLDHLKLHSYATSIRKAVLASMDNENVRFPSHPTLLPRPVSPCSLL

SEQ ID NO: 42170 - protein, 340 aa, Homo sapiens
  Payload ID: 8570
  Gene Symbol: IDH3G
  Gene Name: isocitrate dehydrogenase 3 (NAD+) gamma
  ENSP ID: ENSP00000359111
MALKVATVAGSAAKAVLGPALLCRPWEVLGAHEVPSRNIFSEQTIPPSAKYGGRHTVTMIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFETATRNTGKSIANKNIANPTATLLASCMMLDHLK

SEQ ID NO: 42171 - protein, 211 aa, Homo sapiens
  Payload ID: 8570
  Gene Symbol: IDH3G
  Gene Name: isocitrate dehydrogenase 3 (NAD+) gamma
  ENSP ID: ENSP00000400115
  MOD_RES (1)..(1): Any amino acid
XKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFETATRNTGKSIANKNIANPTATLLASCMMLDHLKLHSYATSIRKAVLASMDNENGLVCAEPACVLQMHTPDIGGQGTTSEAIQDVIRHIRVINGRAVEA

SEQ ID NO: 42172 - protein, 285 aa, Homo sapiens
  Payload ID: 8570
  Gene Symbol: IDH3G
  Gene Name: isocitrate dehydrogenase 3 (NAD+) gamma
  ENSP ID: ENSP00000401862
MALKVLGAHEVPSRNIFSEQTIPPSAKYGGRHTVTMIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFET

SEQ ID NO: 42173 - protein, 199 aa, Homo sapiens
  Payload ID: 8570
  Gene Symbol: IDH3G
  Gene Name: isocitrate dehydrogenase 3 (NAD+) gamma
  ENSP ID: ENSP00000402747
HVSSNADEEDIRNAIMAIRRNRVALKGLVWLERTLVLGDWVDASSGLFALRCWDSSNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQ

SEQ ID NO: 42174 - protein, 322 aa, Homo sapiens
  Payload ID: 8570
  Gene Symbol: IDH3G
  Gene Name: isocitrate dehydrogenase 3 (NAD+) gamma
  ENSP ID: ENSP00000408529
MIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFETATRNTGKSIANKNIANPTATLLASCMMLDHLKLHSYATSIRKAVLASMDNENVRFPSHPTLLPRPVSPCSLL

SEQ ID NO: 42175 - protein, 322 aa, Homo sapiens; identical to SEQ ID NO: 42174
  Payload ID: 8570
  Gene Symbol: IDH3G
  Gene Name: isocitrate dehydrogenase 3 (NAD+) gamma
  ENSP ID: ENSP00000482665

SEQ ID NO: 42176 - protein, 174 aa, Homo sapiens
  Payload ID: 8571
  Gene Symbol: IARS
  Gene Name: isoleucyl-tRNA synthetase
  ENSP ID: ENSP00000364778
MYTFDQATGGTAQFEAHSDAQALVLLDVTPDQSMVDEGMAREVINRIQKLRKKCNLVPTDEITVYYKAKSEGTYLNSVIESHTEFIFTTIKAPLKPYPVSPSDKVLIQEKTQLKGSELEITLTRGSSLPGPACAYVNLNICANGSEQGEMQWIIPEIYHFWKPRWSIAPGKSKR

SEQ ID NO: 42177 - protein, 1262 aa, Homo sapiens
  Payload ID: 8571
  Gene Symbol: IARS
  Gene Name: isoleucyl-tRNA synthetase
  Uniprot ID: P41252
  ENSP ID: ENSP00000364794
MLQQVPENINFPAEEEKILEFWTEFNCFQECLKQSKHKPKFTFYDGPPFATGLPHYGHILAGTIKDIVTRYAHQSGFHVDRRFGWDCHGLPVEYEIDKTLGIRGPEDVAKMGITEYNNQCRAIVMRYSAEWKSTVSRLGRWIDFDNDYKTLYPQFMESVWWVFKQLYDKGLVYRGVKVMPFSTACNTPLSNFESHQNYKDVQDPSVFVTFPLEEDETVSLVAWTTTPWTLPSNLAVCVNPEMQYVKIKDVARGRLLILMEARLSALYKLESDYEILERFPGAYLKGKKYRPLFDYFLKCKENGAFTVLVDNYVKEEEGTGVVHQAPYFGAEDYRVCMDFNIIRKDSLPVCPVDASGCFTTEVTDFAGQYVKDADKSIIRTLKEQGRLLVATTFTHSYPFCWRSDTPLIYKAVPSWFVRVENMVDQLLRNNDLCYWVPELVREKRFGNWLKDARDWTISRNRYWGTPIPLWVSDDFEEVVCIGSVAELEELSGAKISDLHRESVDHLTIPSRCGKGSLHRISEVFDCWFESGSMPYAQVHYPFENKREFEDAFPADFIAEGIDQTRGWFYTLLVLATALFGQPPFKNVIVNGLVLASDGQKMSKRKKNYPDPVSIIQKYGADALRLYLINSPVVRAENLRFKEEGVRDVLKDVLLPWYNAYRFLIQNVLRLQKEEEIEFLYNENTVRESPNITDRWILSFMQSLIGFFETEMAAYRLYTVVPRLVKFVDILTNWYVRMNRRRLKGENGMEDCVMALETLFSVLLSLCRLMAPYTPFLTELMYQNLKVLIDPVSVQDKDTLSIHYLMLPRVREELIDKKTESAVSQMQSVIELGRVIRDRKTIPIKYPLKEIVVIHQDPEALKDIKSLEKYIIEELNVRKVTLSTDKNKYGIRLRAEPDHMVLGKRLKGAFKAVMTSIKQLSSEELEQFQKTGTIVVEGHELHDEDIRLMYTFDQATGGTAQFEAHSDAQALVLLDVTPDQSMVDEGMAREVINRIQKLRKKCNLVPTDEITVYYKAKSEGTYLNSVIESHTEFIFTTIKAPLKPYPVSPSDKVLIQEKTQLKGSELEITLTRGSSLPGPACAYVNLNICANGSEQGGVLLLENPKGDNRLDLLKLKSVVTSIFGVKNTELAVFHDETEIQNQTDLLSLSGKTLCVTAGSAPSLINSSSTLLCQYINLQLLNAKPQECLMGTVGTLLLENPLGQNGLTHQGLLYEAAKVFGLRSRKLKLFLNETQTQEITEDIPVKTLNMKTVYVSVLPTTADF

SEQ ID NO: 42178 - protein, 330 aa, Homo sapiens
  Payload ID: 8571
  Gene Symbol: IARS
  Gene Name: isoleucyl-tRNA synthetase
  ENSP ID: ENSP00000378922
MLQQVPENINFPAEEEKILEFWTEFNCFQECLKQSKHKPKFTFYDGPPFATGLPHYGHILAGTIKDIVTRYAHQSGFHVDRRFGWDCHGLPVEYEIDKTLGIRGPEDVAKMGITEYNNQCRAIVMRYSAEWKSTVSRLGRWIDFDNDYKTLYPQFMESVWWVFKQLYDKGLVYRGVKVMPFSTACNTPLSNFESHQNYKDVQDPSVFVTFPLEEDETVSLVAWTTTPWTLPSNLAVCVNPEMQYVKIKDVARGRLLILMEARLSALYKLESDYEILERFPGAYLKGKKYRPLFDYFLKCKENGAFTVLVDNYVKEEEGTGVVHQAPYFGA

SEQ ID NO: 42179 - protein, 72 aa, Homo sapiens
  Payload ID: 8571
  Gene Symbol: IARS
  Gene Name: isoleucyl-tRNA synthetase
  ENSP ID: ENSP00000387603
MSNKMLQQVPENINFPAEEEKILEFWTEFNCFQECLKQSKHKPKNMKLIRHWESEDQRMWPKWGLQSITISA

SEQ ID NO: 42180 - protein, 1242 aa, Homo sapiens
  Payload ID: 8571
  Gene Symbol: IARS
  Gene Name: isoleucyl-tRNA synthetase
  ENSP ID: ENSP00000406448
MLQQVPENINFPAEEEKILEFWTEFNCFQECLKQSKHKPKFTFYDGPPFATGLPHYGHILAGTIKDIVTRYAHQSGFHVDRRFGWDCHGLPVEYEIDKTLGIRGPEDVAKMGITEYNNQCRAIVMRYSAEWKSTVSRLGRWIDFDNDYKTLYPQFMESVWWVFKQLYDKGLVYRGVKVMPFSTACNTPLSNFESHQNYKDVQDPSVFVTFPLEEDETVSLVAWTTTPWTLPSNLAVCVNPEMQYVKIKDVARGRLLILMEARLSALYKLESDYEILERFPGAYLKGKKYRPLFDYFLKCKENGAFTVLVDNYVKEEEGTGVVHQAPYFGAEDYRVCMDFNIIRKDSLPVCPVDASGCFTTEVTDFAGQYVKDADKSIIRTLKEQGRLLVATTFTHSYPFCWRSDTPLIYKAVPSWFVRVENMVDQLLRNNDLCYWVPELVREKRFGNWLKDARDWTISRNRYWGTPIPLWVSDDFEEVVCIGSVAELEELSGAKISDLHRESVDHLTIPSRCGKGSLHRISEVFDCWFESGSMPYAQVHYPFENKREFEDAFPADFIAEGIDQTRGWFYTLLVLATALFGQPPFKNVIVNGLVLASDGQKMSKRKKNYPDPVSIIQKYGADALRLYLINSPVVRAENLRFKEEGVRDVLKDVLLPWYNAYRFLIQNVLRLQKEEEIEFLYNENTVRESPNITDRWILSFMQSLIGFFETEMAAYRLYTVVPRLVKFVDILTNWYVRMNRRRLKGENGMEDCVMALETLFSVLLSLCRLMAPYTPFLTELMYQNLKVLIDPVSVQDKDTLSIHYLMLPRVREELIDKKTESAVSQMQSVIELGRVIRDRKTIPIKYPLKEIVVIHQDPEALKDIKSLEKYIIEELNVRKVTLSTDKNKYGIRLRAEPDHMVLGKRLKGAFKAVMTSIKQLSSEELEQFQKTGTIVVEGHELHDEDIRLMYTFDQATGGTAQFEAHSDAQALVLLDVTPDQSMVDEGMAREVINRIQKLRKKCNLVPTDEITVYYKAKSEGTYLNSVIESHTEFIFTTIKAPLKPYPVSPSDKVLIQEKTQLKGSELEITLTRGSSLPGPACAYVNLNICANGSEQGGVLLLENPKGDNRLDLLKLKSVVTSIFGVKNTELAVFHDETEIQNQTDLLSLSGKTLCVTAGSAPSLINSSSTLLCQYINLQLLNAKPQECLMGTVGTLLLENPLGQNGLTHQGLLYEAAKVFGLRSRKLKLFLNETQTQEITEDIP

SEQ ID NO: 42181 - protein, 1152 aa, Homo sapiens
  Payload ID: 8571
  Gene Symbol: IARS
  Gene Name: isoleucyl-tRNA synthetase
  ENSP ID: ENSP00000415020
MGITEYNNQCRAIVMRYSAEWKSTVSRLGRWIDFDNDYKTLYPQFMESVWWVFKQLYDKGLVYRGVKVMPFSTACNTPLSNFESHQNYKDVQDPSVFVTFPLEEDETVSLVAWTTTPWTLPSNLAVCVNPEMQYVKIKDVARGRLLILMEARLSALYKLESDYEILERFPGAYLKGKKYRPLFDYFLKCKENGAFTVLVDNYVKEEEGTGVVHQAPYFGAEDYRVCMDFNIIRKDSLPVCPVDASGCFTTEVTDFAGQYVKDADKSIIRTLKEQGRLLVATTFTHSYPFCWRSDTPLIYKAVPSWFVRVENMVDQLLRNNDLCYWVPELVREKRFGNWLKDARDWTISRNRYWGTPIPLWVSDDFEEVVCIGSVAELEELSGAKISDLHRESVDHLTIPSRCGKGSLHRISEVFDCWFESGSMPYAQVHYPFENKREFEDAFPADFIAEGIDQTRGWFYTLLVLATALFGQPPFKNVIVNGLVLASDGQKMSKRKKNYPDPVSIIQKYGADALRLYLINSPVVRAENLRFKEEGVRDVLKDVLLPWYNAYRFLIQNVLRLQKEEEIEFLYNENTVRESPNITDRWILSFMQSLIGFFETEMAAYRLYTVVPRLVKFVDILTNWYVRMNRRRLKGENGMEDCVMALETLFSVLLSLCRLMAPYTPFLTELMYQNLKVLIDPVSVQDKDTLSIHYLMLPRVREELIDKKTESAVSQMQSVIELGRVIRDRKTIPIKYPLKEIVVIHQDPEALKDIKSLEKYIIEELNVRKVTLSTDKNKYGIRLRAEPDHMVLGKRLKGAFKAVMTSIKQLSSEELEQFQKTGTIVVEGHELHDEDIRLMYTFDQATGGTAQFEAHSDAQALVLLDVTPDQSMVDEGMAREVINRIQKLRKKCNLVPTDEITVYYKAKSEGTYLNSVIESHTEFIFTTIKAPLKPYPVSPSDKVLIQEKTQLKGSELEITLTRGSSLPGPACAYVNLNICANGSEQGGVLLLENPKGDNRLDLLKLKSVVTSIFGVKNTELAVFHDETEIQNQTDLLSLSGKTLCVTAGSAPSLINSSSTLLCQYINLQLLNAKPQECLMGTVGTLLLENPLGQNGLTHQGLLYEAAKVFGLRSRKLKLFLNETQTQEITEDIPVKTLNMKTVYVSVLPTTADF

SEQ ID NO: 42182 - protein, 174 aa, Homo sapiens; identical to SEQ ID NO: 42176
  Payload ID: 8571
  Gene Symbol: IARS
  Gene Name: isoleucyl-tRNA synthetase
  ENSP ID: ENSP00000486469

SEQ ID NO: 42183 - protein, 1012 aa, Homo sapiens
  Payload ID: 8572
  Gene Symbol: IARS2
  Gene Name: isoleucyl-tRNA synthetase 2, mitochondrial
  Uniprot ID: Q9NSE4
  ENSP ID: ENSP00000355889
MRWGLRPRGPGAAALATARSLWGTPRLPCSPGWQGATKRLLVRSVSGASNHQPNSNSGRYRDTVLLPQTSFPMKLLGRQQPDTELEIQQKCGFSELYSWQRERKVKTEFCLHDGPPYANGDPHVGHALNKILKDIANRFHMMNGSKIHFVPGWDCHGLPIEIKVLSELGREAQNLSAMEIRKKARSFAKAAIEKQKSAFIRWGIMADWNNCYYTFDGKYEAKQLRTFYQMYDKGLVYRSYKPVFWSPSSRTALAEAELEYNPEHVSRSIYVKFPLLKPSPKLASLIDGSSPVSILVWTTQPWTIPANEAVCYMPESKYAVVKCSKSGDLYVLAADKVASVASTLETTFETISTLSGVDLENGTCSHPLIPDKASPLLPANHVTMAKGTGLVHTAPAHGMEDYGVASQHNLPMDCLVDEDGVFTDVAGPELQNKAVLEEGTDVVIKMLQTAKNLLKEEKLVHSYPYDWRTKKPVVIRASKQWFINITDIKTAAKELLKKVKFIPGSALNGMVEMMDRRPYWCISRQRVWGVPIPVFHHKTKDEYLINSQTTEHIVKLVEQHGSDIWWTLPPEQLLPKEVLSEVGGPDALEYVPGQDILDIWFDSGTSWSYVLPGPDQRADLYLEGKDQLGGWFQSSLLTSVAARKRAPYKTVIVHGFTLGEKGEKMSKSLGNVIHPDVVVNGGQDQSKEPPYGADVLRWWVADSNVFTEVAIGPSVLNAARDDISKLRNTLRFLLGNVADFNPETDSIPVNDMYVIDQYMLHLLQDLANKITELYKQYDFGKVVRLLRTFYTRELSNFYFSIIKDRLYCEKENDPKRRSCQTALVEILDVIVRSFAPILPHLAEEVFQHIPYIKEPKSVFRTGWISTSSIWKKPGLEEAVESACAMRDSFLGSIPGKNAAEYKVITVIEPGLLFEIIEMLQSEETSSTSQLNELMMASESTLLAQEPREMTADVIELKGKFLINLEGGDIREESSYKVIVMPTTKEKCPRCWKYTAESSDTLCPRCAEVVSGK

SEQ ID NO: 42184 - protein, 284 aa, Homo sapiens
  Payload ID: 8573
  Gene Symbol: IDI1
  Gene Name: isopentenyl-diphosphate delta isomerase 1
  Uniprot ID: Q13907
  ENSP ID: ENSP00000370748
MWRGLALARAIGCAARGRGQWAVRAADCAQSGRHPGPAVVCGRRLISVLEQIRHFVMMPEINTNHLDKQQVQLLAEMCILIDENDNKIGAETKKNCHLNENIEKGLLHRAFSVFLFNTENKLLLQQRSDAKITFPGCFTNTCCSHPLSNPAELEESDALGVRRAAQRRLKAELGIPLEEVPPEEINYLTRIHYKAQSDGIWGEHEIDYILLVRKNVTLNPDPNEIKSYCYVSKEELKELLKKAASGEIKITPWFKIIAATFLFKWWDNLNHLNQFVDHEKIYRM

SEQ ID NO: 42185 - protein, 122 aa, Homo sapiens
  Payload ID: 8573
  Gene Symbol: IDI1
  Gene Name: isopentenyl-diphosphate delta isomerase 1
  ENSP ID: ENSP00000401879
MPEINTNHLDKQQVQLLAEMCILIDENDNKIGAETKKNCHLNENIEKGLLHRAFSVFLFNTENKLLLQQRSDAKITFPGCFTNTCCSHPLSNPAELEESDALGVRRAAQRRLKAELGIPLEE

SEQ ID NO: 42186 - protein, 120 aa, Homo sapiens
  Payload ID: 8573
  Gene Symbol: IDI1
  Gene Name: isopentenyl-diphosphate delta isomerase 1
  ENSP ID: ENSP00000404771
MELDLFLGLDDVFPRLLHGLLHRAFSVFLFNTENKLLLQQRSDAKITFPGCFTNTCCSHPLSNPAELEESDALGVRRAAQRRLKAELGIPLEEVTSSPTQPYKLKPKHTIKRFLIKFLNS

SEQ ID NO: 42187 - protein, 227 aa, Homo sapiens
  Payload ID: 8574
  Gene Symbol: IDI2
  Gene Name: isopentenyl-diphosphate delta isomerase 2
  Uniprot ID: Q9BXS1
  ENSP ID: ENSP00000277517
MSDINLDWVDRRQLQRLEEMLIVVDENDKVIGADTKRNCHLNENIEKGLLHRAFSVVLFNTKNRILIQQRSDTKVTFPGYFTDSCSSHPLYNPAELEEKDAIGVRRAAQRRLQAELGIPGEQISPEDIVFMTIYHHKAKSDRIWGEHEICYLLLVRKNVTLNPDPSETKSILYLSQEELWELLEREARGEVKVTPWLRTIAERFLYRWWPHLDDVTPFVELHKIHRV

SEQ ID NO: 42188 - protein, 401 aa, Homo sapiens
  Payload ID: 8575
  Gene Symbol: ISPD
  Gene Name: isoprenoid synthase domain containing
  Uniprot ID: A4D126
  ENSP ID: ENSP00000382249
MEAGPPGSARPAEPGPCLSGQRGADHTASASLQSVAGTEPGRHPQAVAAVLPAGGCGERMGVPTPKQFCPILERPLISYTLQALERVCWIKDIVVAVTGENMEVMKSIIQKYQHKRISLVEAGVTRHRSIFNGLKALAEDQINSKLSKPEVVIIHDAVRPFVEEGVLLKVVTAAKEHGCSDYDLEFGTECLQLALKYCCTKAKLVEGSPDLWKVTYKRDLYAAESIIKERISQEICVVMDTEEDNKHVGHLLEEVLKSELNHVKVTSEALGHAGRHLQQIILDQCYNFVCVNVTTSDFQETQKLLSMLEESSLCILYPVVVVSVHFLDFKLVPPSQKMENLMQIREFAKEVKERNILLYGLLISYPQDDQKLQESLRQGAIIIASLIKERNSGLIGQLLIA

SEQ ID NO: 42189 - protein, 451 aa, Homo sapiens
  Payload ID: 8575
  Gene Symbol: ISPD
  Gene Name: isoprenoid synthase domain containing
  Uniprot ID: A4D126
  ENSP ID: ENSP00000385478
MEAGPPGSARPAEPGPCLSGQRGADHTASASLQSVAGTEPGRHPQAVAAVLPAGGCGERMGVPTPKQFCPILERPLISYTLQALERVCWIKDIVVAVTGENMEVMKSIIQKYQHKRISLVEAGVTRHRSIFNGLKALAEDQINSKLSKPEVVIIHDAVRPFVEEGVLLKVVTAAKEHGAAGAIRPLVSTVVSPSADGCLDYSLERARHRASEMPQAFLFDVIYEAYQQCSDYDLEFGTECLQLALKYCCTKAKLVEGSPDLWKVTYKRDLYAAESIIKERISQEICVVMDTEEDNKHVGHLLEEVLKSELNHVKVTSEALGHAGRHLQQIILDQCYNFVCVNVTTSDFQETQKLLSMLEESSLCILYPVVVVSVHFLDFKLVPPSQKMENLMQIREFAKEVKERNILLYGLLISYPQDDQKLQESLRQGAIIIASLIKERNSGLIGQLLIA

SEQ ID NO: 42190 - protein, 284 aa, Homo sapiens
  Payload ID: 8576
  Gene Symbol: ICMT
  Gene Name: isoprenylcysteine carboxyl methyltransferase
  Uniprot ID: O60725
  ENSP ID: ENSP00000343552
MAGCAARAPPGSEARLSLATFLLGASVLALPLLTRAGLQGRTGLALYVAGLNALLLLLYRPPRYQIAIRACFLGFVFGCGTLLSFSQSSWSHFGWYMCSLSLFHYSEYLVTAVNNPKSLSLDSFLLNHSLEYTVAALSSWLEFTLENIFWPELKQITWLSVTGLLMVVFGECLRKAAMFTAGSNFNHVVQNEKSDTHTLVTSGVYAWFRHPSYVGWFYWSIGTQVMLCNPICGVSYALTVWRFFRDRTEEEEISLIHFFGEEYLEYKKRVPTGLPFIKGVKVDL

SEQ ID NO: 42191 - protein, 116 aa, Homo sapiens
  Payload ID: 8576
  Gene Symbol: ICMT
  Gene Name: isoprenylcysteine carboxyl methyltransferase
  ENSP ID: ENSP00000466222
MAGCAARAPPGSEARLSLATFLLGASVLALPLLTRAGLQGRTGLALYVAGLNALLLLLYRPPRYQIAIRACFLGFVFGCGTLLSFSQSSWSHFGWSHLVHPHSHCRIFPYTMISVP

SEQ ID NO: 42192 - protein, 94 aa, Homo sapiens
  Payload ID: 8576
  Gene Symbol: ICMT
  Gene Name: isoprenylcysteine carboxyl methyltransferase
  ENSP ID: ENSP00000467999
MAGCAARAPPGSEARLSLATFLLGASVLALPLLTRAGLQGRTGLALYVAGLNALLLLLYRPPRYQIAIRACFLGFVFGCGTLLSFSQSSWSHFG

SEQ ID NO: 42193 - protein, 307 aa, Homo sapiens
  Payload ID: 8577
  Gene Symbol: IVD
  Gene Name: isovaleryl-CoA dehydrogenase
  ENSP ID: ENSP00000417256
  MOD_RES (1)..(1): Any amino acid
XKQLGNLGVLGITAPVQYGGSGLGYLEHVLVMEEISRASGAVGLSYGAHSNLCINQLVRNGNEAQKEKYLPKLISGEYIGALAMSEPNAGSDVVSMKLKAEKKGNHYILNGNKFWITNGPDADVLIVYAKTDLAAVPASRGITAFIVEKGMPGFSTSKKLDKLGMRGSNTCELIFEDCKIPAANILGHENKGVYVLMSGLDLERLVLAGGPLGLMQAVLDHTIPYLHVREAFGQKIGHFQPGSMDLGVCSVNICSWGNNEGQTFSAQHPPGREGETRGQTSLEQVSTARELRCKILLPELTPRVLLP

SEQ ID NO: 42194 - protein, 396 aa, Homo sapiens
  Payload ID: 8577
  Gene Symbol: IVD
  Gene Name: isovaleryl-CoA dehydrogenase
  Uniprot ID: P26440
  ENSP ID: ENSP00000417990
MAEMATATRLLGWRVASWRLRPPLAGFVSQRAHSLLPVDDAINGLSEEQRQEFWKQLGNLGVLGITAPVQYGGSGLGYLEHVLVMEEISRASGAVGLSYGAHSNLCINQLVRNGNEAQKEKYLPKLISGEYIGALAMSEPNAGSDVVSMKLKAEKKGNHYILNGNKFWITNGPDADVLIVYAKTDLAAVPASRGITAFIVEKGMPGFSTSKKLDKLGMRGSNTCELIFEDCKIPAANILGHENKGVYVLMSGLDLERLVLAGGPLGLMQAVLDHTIPYLHVREAFGQKIGHFQLMQGKMADMYTRLMACRQYVYNVAKACDEGHCTAKDCAGVILYSAECATQVALDGIQCFGGNGYINDFPMGRFLRDAKLYEIGAGTSEVRRLVIGRAFNADFH

SEQ ID NO: 42195 - protein, 426 aa, Homo sapiens
  Payload ID: 8577
  Gene Symbol: IVD
  Gene Name: isovaleryl-CoA dehydrogenase
  ENSP ID: ENSP00000418397
MAEMATATRLLGWRVASWRLRPPLAGFVSQRAHSLLPVDDAINGLSEEQRQLRQTMAKFLQEHLAPKAQEIDRSNEFKNLREFWKQLGNLGVLGITAPVQYGGSGLGYLEHVLVMEEISRASGAVGLSYGAHSNLCINQLVRNGNEAQKEKYLPKLISGEYIGALAMSEPNAGSDVVSMKLKAEKKGNHYILNGNKFWITNGPDADVLIVYAKTDLAAVPASRGITAFIVEKGMPGFSTSKKLDKLGMRGSNTCELIFEDCKIPAANILGHENKGVYVLMSGLDLERLVLAGGPLGLMQAVLDHTIPYLHVREAFGQKIGHFQLMQGKMADMYTRLMACRQYVYNVAKACDEGHCTAKDCAGVILYSAECATQVALDGIQCFGGNGYINDFPMGRFLRDAKLYEIGAGTSEVRRLVIGRAFNADFH

SEQ ID NO: 42196 - protein, 145 aa, Homo sapiens
  Payload ID: 8577
  Gene Symbol: IVD
  Gene Name: isovaleryl-CoA dehydrogenase
  ENSP ID: ENSP00000452949
  MOD_RES (1)..(1): Any amino acid
XCINQLVRNGNEAQKEKYLPKLISGEYIGALAMSEPNAGSDVVSMKLKAEKKGNHYILNGNKFWITNGPDADVLIVYAKTDLAAVPASRGITAFIVEKGMPGFSTSKKLDKLGMRGSNTCELIFEDCKIPGSCKRSWTTPFPTCT

SEQ ID NO: 42197 - protein, 243 aa, Homo sapiens
  Payload ID: 8577
  Gene Symbol: IVD
  Gene Name: isovaleryl-CoA dehydrogenase
  ENSP ID: ENSP00000453146
ADVLIVYAKTDLAAVPASRGITAFIVEKGMPGFSTSKKLDKLGMRGSNTCELIFEDCKIPAANILGHENKGVYVLMSGLDLERLVLAGGPLGLMQAVLDHTIPYLHVREAFGQKIGHFQLMQGKMADMYTRLMACRQYVYNVAKACDEGHCTAKDCAGVILYSAECATQVALDGIQCFGHAPQPFLYTEPVNYQAPRKFFSGSQHLADLFRPTPTWEGGRDPRSDVPGAGEHCEGTEMQDPPA

SEQ ID NO: 42198 - protein, 212 aa, Homo sapiens
  Payload ID: 8577
  Gene Symbol: IVD
  Gene Name: isovaleryl-CoA dehydrogenase
  ENSP ID: ENSP00000453821
MVFWWRIGQATYRLWHKGPQSVCSSLTPEQAELRQTMAKFLQEHLAPKAQEIDRSNEFKNLREFWKQLGNLGVLGITAPVQYGGSGLGYLEHVLVMEEISRASGAVGLSYGAHSNLCINQLVRNGNEAQKEKYLPKLISGEYIGALAMSEPNAGSDVVSMKLKAEKKGNHYILNGNKFWITNGPDADVLIVYAKTDLAAVPASRGITAFIVE

SEQ ID NO: 42199 - protein, 41 aa, Homo sapiens
  Payload ID: 8577
  Gene Symbol: IVD
  Gene Name: isovaleryl-CoA dehydrogenase
  ENSP ID: ENSP00000453929
  MOD_RES (1)..(1): Any amino acid
XCDEGHCTAKDCAGVILYSAECATQVALDGIQCFVSRGISS

SEQ ID NO: 42200 - protein, 58 aa, Homo sapiens
  Payload ID: 8577
  Gene Symbol: IVD
  Gene Name: isovaleryl-CoA dehydrogenase
  ENSP ID: ENSP00000454145
  MOD_RES (1)..(1): Any amino acid
XHCTAKDCAGVILYSAECATQVALDGIQCFGHAPQPFLYTEPVNYQAPRKFFSGSQHL

SEQ ID NO: 42201 - protein, 214 aa, Homo sapiens
  Payload ID: 8577
  Gene Symbol: IVD
  Gene Name: isovaleryl-CoA dehydrogenase
  ENSP ID: ENSP00000479359
MAEMATATRLLGWRVASWRLRPPLAGFVSQRAHSLLPVDDAINGLSEEQRQLRQTMAKFLQEHLAPKAQEIDRSNEFKNLRVSWEVRAVGGSQGVGLSCTAAWKSSHSFLEFWKQLGNLGVLGITAPVQYGGSGLGYLEHVLVMEEISRASGAVGLSYGAHSNLCINQLVRNGNEAQKEKYLPKLISGEYIGALAMSEPNAGSDVVSMKLKAEK

SEQ ID NO: 42202 - protein, 464 aa, Homo sapiens
  Payload ID: 8578
  Gene Symbol: ISM1
  Gene Name: isthmin 1, angiogenesis inhibitor
  Uniprot ID: B1AKI9
  ENSP ID: ENSP00000262487
MVRLAAELLLLLGLLLLTLHITVLRGSGAADGPDAAAGNASQAQLQNNLNVGSDTTSETSFSLSKEAPREHLDHQAAHQPFPRPRFRQETGHPSLQRDFPRSFLLDLPNFPDLSKADINGQNPNIQVTIEVVDGPDSEADKDQHPENKPSWSVPSPDWRAWWQRSLSLARANSGDQDYKYDSTSDDSNFLNPPRGWDHTAPGHRTFETKDQPEYDSTDGEGDWSLWSVCSVTCGNGNQKRTRSCGYACTATESRTCDRPNCPGIEDTFRTAATEVSLLAGSEEFNATKLFEVDTDSCERWMSCKSEFLKKYMHKVMNDLPSCPCSYPTEVAYSTADIFDRIKRKDFRWKDASGPKEKLEIYKPTARYCIRSMLSLESTTLAAQHCCYGDNMQLITRGKGAGTPNLISTEFSAELHYKVDVLPWIICKGDWSRYNEARPPNNGQKCTESPSDEDYIKQFQEAREY

SEQ ID NO: 42203 - protein, 76 aa, Homo sapiens
  Payload ID: 8579
  Gene Symbol: ISM2
  Gene Name: isthmin 2
  Uniprot ID: Q6H9L7
  ENSP ID: ENSP00000216481
MRALRDRAGLLLCVLLLAALLEAALGLPVKKPRLRGPRPGSLTRLAEPPFQVRASSERSPAGARNLALCGVAGQGR

SEQ ID NO: 42204 - protein, 571 aa, Homo sapiens
  Payload ID: 8579
  Gene Symbol: ISM2
  Gene Name: isthmin 2
  Uniprot ID: Q6H9L7
  ENSP ID: ENSP00000341490
MRALRDRAGLLLCVLLLAALLEAALGLPVKKPRLRGPRPGSLTRLAEVSASPDPRPLKEEEEAPLLPRTHLQAEPHQHGCWTVTEPAAMTPGNATPPRTPEVTPLRLELQKLPGLANTTLSTPNPDTQASASPDPRPLREEEEARLLPRTHLQAELHQHGCWTVTEPAALTPGNATPPRTQEVTPLLLELQKLPELVHATLSTPNPDNQVTIKVVEDPQAEVSIDLLAEPSNPPPQDTLSWLPALWSFLWGDYKGEEKDRAPGEKGEEKEEDEDYPSEDIEGEDQEDKEEDEEEQALWFNGTTDNWDQGWLAPGDWVFKDSVSYDYEPQKEWSPWSPCSGNCSTGKQQRTRPCGYGCTATETRTCDLPSCPGTEDKDTLGLPSEEWKLLARNATDMHDQDVDSCEKWLNCKSDFLIKYLSQMLRDLPSCPCAYPLEAMDSPVSLQDEHQGRSFRWRDASGPRERLDIYQPTARFCLRSMLSGESSTLAAQHCCYDEDSRLLTRGKGAGMPNLISTDFSPKLHFKFDTTPWILCKGDWSRLHAVLPPNNGRACTDNPLEEEYLAQLQEAKEY

SEQ ID NO: 42205 - protein, 73 aa, Homo sapiens
  Payload ID: 8579
  Gene Symbol: ISM2
  Gene Name: isthmin 2
  ENSP ID: ENSP00000417679
  MOD_RES (1)..(1): Any amino acid
XRLAEVSGGGTGLRSALSVPPPQPAGSSRAGSGTGTHTGSDPPMERGAGAGRKLPDTGRCPGAPDFGASTPRA

SEQ ID NO: 42206 - protein, 104 aa, Homo sapiens
  Payload ID: 8579
  Gene Symbol: ISM2
  Gene Name: isthmin 2
  ENSP ID: ENSP00000419434
  MOD_RES (1)..(1): Any amino acid
XCVLLLAALLEAALGLPVKKPRLRGPRPGSLTRLAEVSGGGTGLRSALSVPPPQPAGSSRAGSGTGTHTGSDPPMERGAGAGRKLPDTGRCPGAPDFGASTPRA

SEQ ID NO: 42207 - protein, 292 aa, Homo sapiens
  Payload ID: 8579
  Gene Symbol: ISM2
  Gene Name: isthmin 2
  Uniprot ID: Q6H9L7
  ENSP ID: ENSP00000420452
MRALRDRAGLLLCVLLLAALLEAALGLPVKKPRLRGPRPGSLTRLAEVSASPDPRPLKEEEEAPLLPRTHLQAEPHQHGCWTVTEPAAMTPGNATPPRTPEVTPLRLELQKLPGLANTTLSTPNPDTQASASPDPRPLREEEEARLLPRTHLQAELHQHGCWTVTEPAALTPGNATPPRTQEVTPLLLELQKLPELVHATLSTPNPDNQTMSLRRSGVPGLPAVGTAALASSRGLGPVAMAALPPRPVPVTCPPVLALRTRTPWASPVRSGSSWPAMLRTCMIKMWTAVRSG

SEQ ID NO: 42208 - protein, 185 aa, Homo sapiens
  Payload ID: 8579
  Gene Symbol: ISM2
  Gene Name: isthmin 2
  ENSP ID: ENSP00000450791
MRALRDRAGLLLCVLLLAALLEAALGLPVKKPRLRGPRPGSLTRLAEVSASPDPRPLKEEEEAPLLPRTHLQAEPHQHGCWTVTEPAAMTPGNATPPRTPEVTPLRLELQKLPGLANTTLSTPNPDTQVTIKVVEDPQAEVSIDLLAEPSNPPPQDTLSWLPALWSFLWGDYKGEEKDRAPGEKG

SEQ ID NO: 42209 - protein, 307 aa, Homo sapiens
  Payload ID: 8580
  Gene Symbol: ISY1
  Gene Name: ISY1 splicing factor homolog
  Uniprot ID: Q9ULR0
  ENSP ID: ENSP00000273541
MARNAEKAMTALARFRQAQLEEGKVKERRPFLASECTELPKAEKWRRQIIGEISKKVAQIQNAGLGEFRIRDLNDEINKLLREKGHWEVRIKELGGPDYGKVGPKMLDHEGKEVPGNRGYKYFGAAKDLPGVRELFEKERQVRWLMPVIPALWEAEAGGSQALPPPRKTRAELMKAIDFEYYGYLDEDDGVIVPLEQEYEKKLRAELVEKWKAEREARLARGEKEEEEEEEEEINIYAVTEEESDEEGSQEKGGDDSQQKFIAHVPVPSQQEIEEALVRRKKMELLQKYASETLQAQSEEARRLLGY

SEQ ID NO: 42210 - protein, 252 aa, Homo sapiens
  Payload ID: 8580
  Gene Symbol: ISY1
  Gene Name: ISY1 splicing factor homolog
  ENSP ID: ENSP00000376970
MARNAEKAMTALARFRQAQLEEGKVKERRPFLASECTELPKAEKWRRQIIGEISKKVAQIQNAGLGEFRIRDLNDEINKLLREKGHWEVRIKELGGPDYGKVGPKMLDHEGKEVPGNRGYKYFGAAKDLPGVRELFEKEPLPPPRKTRAELMKAIDFEYYGYLDEDDGVIVPLEQEYEKKRSQSRVSGKVESRERGSAGKRRKGRGGGRGGRDQHLCSHRGGVGRGRQPGERRGRQPAEVHCSRPCSLAARD

SEQ ID NO: 42211 - protein, 285 aa, Homo sapiens
  Payload ID: 8580
  Gene Symbol: ISY1
  Gene Name: ISY1 splicing factor homolog
  Uniprot ID: Q9ULR0
  ENSP ID: ENSP00000376973
MARNAEKAMTALARFRQAQLEEGKVKERRPFLASECTELPKAEKWRRQIIGEISKKVAQIQNAGLGEFRIRDLNDEINKLLREKGHWEVRIKELGGPDYGKVGPKMLDHEGKEVPGNRGYKYFGAAKDLPGVRELFEKEPLPPPRKTRAELMKAIDFEYYGYLDEDDGVIVPLEQEYEKKLRAELVEKWKAEREARLARGEKEEEEEEEEEINIYAVTEEESDEEGSQEKGGDDSQQKFIAHVPVPSQQEIEEALVRRKKMELLQKYASETLQAQSEEARRLLGY

SEQ ID NO: 42212 - protein, 124 aa, Homo sapiens
  Payload ID: 8580
  Gene Symbol: ISY1
  Gene Name: ISY1 splicing factor homolog
  ENSP ID: ENSP00000422403
MARNAEKAMTALARFRQAQLEEGKVKERRPFLASECTELPKAEKWRRQIIGEISKKVAQIQNAGLGEFRIRDLNDEINKLLREKGHWEVRIKELGGPDYGYMSCQSEPLPDLFSSCVVEILFFL

SEQ ID NO: 42213 - protein, 148 aa, Homo sapiens
  Payload ID: 8580
  Gene Symbol: ISY1
  Gene Name: ISY1 splicing factor homolog
  ENSP ID: ENSP00000426416
AGLGEFRIRDLNDEINKLLREKGHWEVRIKELGGPDYGKVGPKMLDHEGKEVPGNRGYKYFGAAKDLPGVRELFEKEPLPPPRKTRAELMKAIDFEYYGYLDEDDGVIVPLEQEYEKKLGRGRQPGERRGRQPAEVHCSRPCSLAARD

SEQ ID NO: 42214 - protein, 331 aa, Homo sapiens
  Payload ID: 8581
  Gene Symbol: ISY1-RAB43
  Gene Name: ISY1-RAB43 readthrough
  ENSP ID: ENSP00000411822
MARNAEKAMTALARFRQAQLEEGKVKERRPFLASECTELPKAEKWRRQIIGEISKKVAQIQNAGLGEFRIRDLNDEINKLLREKGHWEVRIKELGGPDYGKVGPKMLDHEGKEVPGNRGYKYFGAAKDLPGVRELFEKEPLPPPRKTRAELMKAIDFEYYGYLDEDDGVIVPLEQEYEKKLRAELVEKWKAEREARLARGEKEEEEEEEEEINIYAVTEEESDEEGSQEKGGDDSQQKFIAHVPVPSQQEIEEALVRRKKMELLQKYASETLQAQSEEARRLLGCRSGTRPARSGSAPSPRATTAVPMGPSLPTTSPRGAPSCRCLTGLRM

SEQ ID NO: 42215 - protein, 903 aa, Homo sapiens
  Payload ID: 8582
  Gene Symbol: ITCH
  Gene Name: itchy E3 ubiquitin protein ligase
  Uniprot ID: Q96J02
  ENSP ID: ENSP00000262650
MSDSGSQLGSMGSLTMKSQLQITVISAKLKENKKNWFGPSPYVEVTVDGQSKKTEKCNNTNSPKWKQPLTVIVTPVSKLHFRVWSHQTLKSDVLLGTAALDIYETLKSNNMKLEEVVVTLQLGGDKEPTETIGDLSICLDGLQLESEVVTNGETTCSENGVSLCLPRLECNSAISAHCNLCLPGLSDSPISASRVAGFTGASQNDDGSRSKDETRVSTNGSDDPEDAGAGENRRVSGNNSPSLSNGGFKPSRPPRPSRPPPPTPRRPASVNGSPSATSESDGSSTGSLPPTNTNTNTSEGATSGLIIPLTISGGSGPRPLNPVTQAPLPPGWEQRVDQHGRVYYVDHVEKRTTWDRPEPLPPGWERRVDNMGRIYYVDHFTRTTTWQRPTLESVRNYEQWQLQRSQLQGAMQQFNQRFIYGNQDLFATSQSKEFDPLGPLPPGWEKRTDSNGRVYFVNHNTRITQWEDPRSQGQLNEKPLPEGWEMRFTVDGIPYFVDHNRRTTTYIDPRTGKSALDNGPQIAYVRDFKAKVQYFRFWCQQLAMPQHIKITVTRKTLFEDSFQQIMSFSPQDLRRRLWVIFPGEEGLDYGGVAREWFFLLSHEVLNPMYCLFEYAGKDNYCLQINPASYINPDHLKYFRFIGRFIAMALFHGKFIDTGFSLPFYKRILNKPVGLKDLESIDPEFYNSLIWVKENNIEECDLEMYFSVDKEILGEIKSHDLKPNGGNILVTEENKEEYIRMVAEWRLSRGVEEQTQAFFEGFNEILPQQYLQYFDAKELEVLLCGMQEIDLNDWQRHAIYRHYARTSKQIMWFWQFVKEIDNEKRMRLLQFVTGTCRLPVGGFADLMGSNGPQKFCIEKVGKENWLPRSHTCFNRLDLPPYKSYEQLKEKLLFAIEETEGFGQE

SEQ ID NO: 42216 - protein, 862 aa, Homo sapiens
  Payload ID: 8582
  Gene Symbol: ITCH
  Gene Name: itchy E3 ubiquitin protein ligase
  Uniprot ID: Q96J02
  ENSP ID: ENSP00000363998
MSDSGSQLGSMGSLTMKSQLQITVISAKLKENKKNWFGPSPYVEVTVDGQSKKTEKCNNTNSPKWKQPLTVIVTPVSKLHFRVWSHQTLKSDVLLGTAALDIYETLKSNNMKLEEVVVTLQLGGDKEPTETIGDLSICLDGLQLESEVVTNGETTCSESASQNDDGSRSKDETRVSTNGSDDPEDAGAGENRRVSGNNSPSLSNGGFKPSRPPRPSRPPPPTPRRPASVNGSPSATSESDGSSTGSLPPTNTNTNTSEGATSGLIIPLTISGGSGPRPLNPVTQAPLPPGWEQRVDQHGRVYYVDHVEKRTTWDRPEPLPPGWERRVDNMGRIYYVDHFTRTTTWQRPTLESVRNYEQWQLQRSQLQGAMQQFNQRFIYGNQDLFATSQSKEFDPLGPLPPGWEKRTDSNGRVYFVNHNTRITQWEDPRSQGQLNEKPLPEGWEMRFTVDGIPYFVDHNRRTTTYIDPRTGKSALDNGPQIAYVRDFKAKVQYFRFWCQQLAMPQHIKITVTRKTLFEDSFQQIMSFSPQDLRRRLWVIFPGEEGLDYGGVAREWFFLLSHEVLNPMYCLFEYAGKDNYCLQINPASYINPDHLKYFRFIGRFIAMALFHGKFIDTGFSLPFYKRILNKPVGLKDLESIDPEFYNSLIWVKENNIEECDLEMYFSVDKEILGEIKSHDLKPNGGNILVTEENKEEYIRMVAEWRLSRGVEEQTQAFFEGFNEILPQQYLQYFDAKELEVLLCGMQEIDLNDWQRHAIYRHYARTSKQIMWFWQFVKEIDNEKRMRLLQFVTGTCRLPVGGFADLMGSNGPQKFCIEKVGKENWLPRSHTCFNRLDLPPYKSYEQLKEKLLFAIEETEGFGQE

SEQ ID NO: 42217 - protein, 752 aa, Homo sapiens
  Payload ID: 8582
  Gene Symbol: ITCH
  Gene Name: itchy E3 ubiquitin protein ligase
  Uniprot ID: Q96J02
  ENSP ID: ENSP00000445608
MKLEEVVVTLQLGGDKEPTETIGDLSICLDGLQLESEVVTNGETTCSESASQNDDGSRSKDETRVSTNGSDDPEDAGAGENRRVSGNNSPSLSNGGFKPSRPPRPSRPPPPTPRRPASVNGSPSATSESDGSSTGSLPPTNTNTNTSEGATSGLIIPLTISGGSGPRPLNPVTQAPLPPGWEQRVDQHGRVYYVDHVEKRTTWDRPEPLPPGWERRVDNMGRIYYVDHFTRTTTWQRPTLESVRNYEQWQLQRSQLQGAMQQFNQRFIYGNQDLFATSQSKEFDPLGPLPPGWEKRTDSNGRVYFVNHNTRITQWEDPRSQGQLNEKPLPEGWEMRFTVDGIPYFVDHNRRTTTYIDPRTGKSALDNGPQIAYVRDFKAKVQYFRFWCQQLAMPQHIKITVTRKTLFEDSFQQIMSFSPQDLRRRLWVIFPGEEGLDYGGVAREWFFLLSHEVLNPMYCLFEYAGKDNYCLQINPASYINPDHLKYFRFIGRFIAMALFHGKFIDTGFSLPFYKRILNKPVGLKDLESIDPEFYNSLIWVKENNIEECDLEMYFSVDKEILGEIKSHDLKPNGGNILVTEENKEEYIRMVAEWRLSRGVEEQTQAFFEGFNEILPQQYLQYFDAKELEVLLCGMQEIDLNDWQRHAIYRHYARTSKQIMWFWQFVKEIDNEKRMRLLQFVTGTCRLPVGGFADLMGSNGPQKFCIEKVGKENWLPRSHTCFNRLDLPPYKSYEQLKEKLLFAIEETEGFGQE

SEQ ID NO: 42218 - protein, 903 aa, Homo sapiens; identical to SEQ ID NO: 42215
  Payload ID: 8582
  Gene Symbol: ITCH
  Gene Name: itchy E3 ubiquitin protein ligase
  Uniprot ID: Q96J02
  ENSP ID: ENSP00000480499

SEQ ID NO: 42219 - protein, 862 aa, Homo sapiens; identical to SEQ ID NO: 42216
  Payload ID: 8582
  Gene Symbol: ITCH
  Gene Name: itchy E3 ubiquitin protein ligase
  Uniprot ID: Q96J02
  ENSP ID: ENSP00000484783

SEQ ID NO: 42220 - protein, 819 aa, Homo sapiens
  Payload ID: 8583
  Gene Symbol: IWS1
  Gene Name: IWS1 homolog (S. cerevisiae)
  Uniprot ID: Q96ST2
  ENSP ID: ENSP00000295321
MDSEYYSGDQSDDGGATPVQDERDSGSDGEDDVNEQHSGSDTGSVERHSENETSDREDGLPKGHHVTDSENDEPLNLNASDSESEELHRQKDSDSESEERAEPPASDSENEDVNQHGSDSESEETRKLPGSDSENEELLNGHASDSENEDVGKHPASDSEIEELQKSPASDSETEDALKPQISDSESEEPPRHQASDSENEEPPKPRMSDSESEELPKPQVSDSESEEPPRHQASDSENEELPKPRISDSESEDPPRHQASDSENEELPKPRISDSESEDPPRNQASDSENEELPKPRVSDSESEGPQKGPASDSETEDASRHKQKPESDDDSDRENKGEDTEMQNDSFHSDSHMDRKKFHSSDSEEEEHKKQKMDSDEDEKEGEEEKVAKRKAAVLSDSEDEEKASAKKSRVVSDADDSDSDAVSDKSGKREKTIASDSEEEAGKELSDKKNEEKDLFGSDSESGNEEENLIADIFGESGDEEEEEFTGFNQEDLEEEKGETQVKEAEDSDSDDNIKRGKHMDFLSDFEMMLQRKKSMSGKRRRNRDGGTFISDADDVVSAMIVKMNEAAEEDRQLNNQKKPALKKLTLLPAVVMHLKKQDLKETFIDSGVMSAIKEWLSPLPDRSLPALKIREELLKILQELPSVSQETLKHSGIGRAVMYLYKHPKESRSNKDMAGKLINEWSRPIFGLTSNYKGMTREEREQRDLEQMPQRRRMNSTGGQTPRRDLEKVLTGEEKALRPGDPGFCARARVPMPSNKDYVVRPKWNVEMESSRFQATSKKGISRLDKQMRKFTDIRKKSRSAHAVKISIEGNKMPL

SEQ ID NO: 42221 - protein, 292 aa, Homo sapiens
  Payload ID: 8583
  Gene Symbol: IWS1
  Gene Name: IWS1 homolog (S. cerevisiae)
  ENSP ID: ENSP00000387206
MITLLPRGSDQDPPEEDDGGATPVQDERDSGSDGEDDVNEQHSGSDTGSVERHSENETSDREDGLPKGHHVTDSENDEPLNLNASDSESEELHRQKDSDSESEERAEPPASDSENEDVNQHGSDSESEETRKLPGSDSENEELLNGHASDSENEDVGKHPASDSEIEELQKSPASDSETEDALKPQISDSESEEPPRHQASDSENEEPPKPRMSDSESEELPKPQVSDSESEEPPRHQASDSENEELPKPRISDSESEDPPRHQASDSENEELPKPRISDSESEDPPRNQAS

SEQ ID NO: 42222 - protein, 33 aa, Homo sapiens
  Payload ID: 8583
  Gene Symbol: IWS1
  Gene Name: IWS1 homolog (S. cerevisiae)
  ENSP ID: ENSP00000396710
PMPSNKDYVVRPKWNVEMESSRVLLLLLSVVTP

SEQ ID NO: 42223 - protein, 221 aa, Homo sapiens
  Payload ID: 8584
  Gene Symbol: IZUMO2
  Gene Name: IZUMO family member 2
  Uniprot ID: Q6UXV1
  ENSP ID: ENSP00000293405
MPLALTLLLLSGLGAPGGWGCLQCDPLVLEALGHLRSALIPSRFQLEQLQARAGAVLMGMEGPFFRDYALNVFVGKVETNQLDLVASFVKNQTQHLMGNSLKDEPLLEELVTLRANVIKEFKKVLISYELKACNPKLCRLLKEEVLDCLHCQRITPKCIHKKYCFVDRQPRVALQYQMDSKYPRNQALLGILISVSLAVFVFVVIVVSACTYRQNRKLLLQ

SEQ ID NO: 42224 - protein, 89 aa, Homo sapiens
  Payload ID: 8584
  Gene Symbol: IZUMO2
  Gene Name: IZUMO family member 2
  ENSP ID: ENSP00000469026
  MOD_RES (1)..(1): Any amino acid
XCDPLVLEALGHLRSALIPSRFQLEQLQARAGAVLMGMEGPFFRDYALNVFVGKVETNQLDLVASFVKNQTQHLMGNSLKAAGHGGSCL

SEQ ID NO: 42225 - protein, 93 aa, Homo sapiens
  Payload ID: 8584
  Gene Symbol: IZUMO2
  Gene Name: IZUMO family member 2
  ENSP ID: ENSP00000470525
  MOD_RES (1)..(1): Any amino acid
XTLLLLSGLGAPGGWGCLQCDPLVLEALGHLRSALIPSRFQLEQLQARAGAVLMGMEGPFFRDYALNVFVGKVDKSTGPCGVLCQEPNAALNG

SEQ ID NO: 42226 - protein, 234 aa, Homo sapiens
  Payload ID: 8584
  Gene Symbol: IZUMO2
  Gene Name: IZUMO family member 2
  ENSP ID: ENSP00000472657
  MOD_RES (1)..(1): Any amino acid
XGAPGGWGCLQCDPLVLEALGHLRSALIPSRFQLEQLQARAGAVLMGMEGPFFRDYALNVFVGKVETNQLDLVASFVKNQTQHLMGNSLKDEPLLEELVTLRANVIKEFKKVLISYELKACNPKLCRLLKEEVLDCLHCQRITPKCIHKKYCFVDRQPRVALQYQMDSKYPRNQALLGILISVSLAVFVFVVIVVSWSLALWPKLECNGAILRPWLTATAASQVQAILLPQPPE

SEQ ID NO: 42227 - protein, 127 aa, Homo sapiens
  Payload ID: 8585
  Gene Symbol: IZUMO3
  Gene Name: IZUMO family member 3
  ENSP ID: ENSP00000391107
SACVSSRLLYLLVFYTQNSGVFIYQGKLLDVCQNLESKLKELLKNFSEIVVVEGPILDCWTCLRMTNRCFKGEYCGDEDPRKAENREIALFLILLATAVILGSAVLLFHFCIFHRRKMKAIRRSLKE

SEQ ID NO: 42228 - protein, 239 aa, Homo sapiens
  Payload ID: 8585
  Gene Symbol: IZUMO3
  Gene Name: IZUMO family member 3
  Uniprot ID: Q5VZ72
  ENSP ID: ENSP00000438895
MGDLWLFLLLPLSAFHGVKGCLECDPKFIEDVGSLLGNLIPSEVPGRTQLLERQIKEMIHLSFKVSHSDKRLRVLAVQQVVKLRTWLKNEFYKLGNETWKGVFIYQGKLLDVCQNLESKLKELLKNFSEIACSEDCIVVEGPILDCWTCLRMTNRCFKGEYCGDEDPRKAENREIALFLILLATAVILGSAVLLFHFCIFHRRKMKAIRRSLKEYVEKKLEELMGKIDEKEEKDFRLRK

SEQ ID NO: 42229 - protein, 233 aa, Homo sapiens
  Payload ID: 8585
  Gene Symbol: IZUMO3
  Gene Name: IZUMO family member 3
  ENSP ID: ENSP00000474246
MGDLWLFLLLPLSAFHGVKGCLECDPKFIEDVGSLLGNLIPSEVPGRTQLLERQIKEMIHLSFKVSHSDKRLRVLAVQQVVKLRTWLKNEFYKLGNETWKGVFIYQGKLLDVCQNLESKLKELLKNFSEIVVVEGPILDCWTCLRMTNRCFKGEYCGDEDPRKAENREIALFLILLATAVILGSAVLLFHFCIFHRRKMKAIRRSLKEYVEKKLEELMGKIDEKEEKDFRLRK

SEQ ID NO: 42230 - protein, 208 aa, Homo sapiens
  Payload ID: 8586
  Gene Symbol: IZUMO4
  Gene Name: IZUMO family member 4
  ENSP ID: ENSP00000378709
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIESRIDCQHRCGIFQYETISCNNCTDSHVACFGYNCESSAQWKSAVQGLLNYINNWHNLVSPALRCLEPPHLANLTLEDAAECLKQH

SEQ ID NO: 42231 - protein, 232 aa, Homo sapiens
  Payload ID: 8586
  Gene Symbol: IZUMO4
  Gene Name: IZUMO family member 4
  Uniprot ID: Q1ZYL8
  ENSP ID: ENSP00000378712
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIESRIDCQHRCGIFQYETISCNNCTDSHVACFGYNCESSAQWKSAVQGLLNYINNWHKQDTSMRPRSSAFSWPGTHRATPAFLVSPALRCLEPPHLANLTLEDAAECLKQH

SEQ ID NO: 42232 - protein, 214 aa, Homo sapiens
  Payload ID: 8586
  Gene Symbol: IZUMO4
  Gene Name: IZUMO family member 4
  Uniprot ID: Q1ZYL8
  ENSP ID: ENSP00000378718
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIESRIDCQHRCGIFQYETISCNNCTDSHVACFGYNCESSAQWKSAVQGLLNYINNWHKQDTSMSLVSPALRCLEPPHLANLTLEDAAECLKQH

SEQ ID NO: 42233 - protein, 138 aa, Homo sapiens
  Payload ID: 8586
  Gene Symbol: IZUMO4
  Gene Name: IZUMO family member 4
  ENSP ID: ENSP00000481223
  MOD_RES (1)..(1): Any amino acid
XSALPQQLLQEVLLLPPPCELQVLVGGRHPRVRGAAHRLERRHDEGAAPGHPRQDHPGEAGPSGDSSVPDDGSAVPGEDVLPRVFPQRAAKHLPGAGAPHPERHHRKPHRLSAPLWHLPVRDHLLQQLHRLARRLLWL

SEQ ID NO: 42234 - protein, 152 aa, Homo sapiens
  Payload ID: 8586
  Gene Symbol: IZUMO4
  Gene Name: IZUMO family member 4
  ENSP ID: ENSP00000483922
VSGALLTDWSDDTMKELHLAIPAKITREKLDQVATAVYQMMDQLYQGKMYFPGYFPNELRNIFREQVHLIQNAIIESIFQYETISCNNCTDSHVACFGYNCESSAQWKSAVQGLLNYINNWHNLVSPALRCLEPPHLANLTLEDAAECLKQH

SEQ ID NO: 42235 - protein, 184 aa, Homo sapiens
  Payload ID: 8586
  Gene Symbol: IZUMO4
  Gene Name: IZUMO family member 4
  ENSP ID: ENSP00000484309
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGKGRETEAGPPHPGTPRPPPEPDLLLPRRLRVFPQRAAKHLPGAGAPHPERHHRKPHRLSAPLWSSAQWKSAVQGLLNYINNWHK

SEQ ID NO: 42236 - protein, 152 aa, Homo sapiens
  Payload ID: 8586
  Gene Symbol: IZUMO4
  Gene Name: IZUMO family member 4
  ENSP ID: ENSP00000484639
  MOD_RES (1)..(1): Any amino acid
XPQQLLQEVLLLPPPCELQVLVGGRHPRVRGAAHRLERRHDEGAAPGHPRQDHPGEAGPSGDSSVPDDGSAVPGEDVLPRVFPQRAAKHLPGAGAPHPERHHRKPHRLSAPLWSSAQWKSAVQGLLNYINNWHKPRSSAFSWPGTHRATPAL

SEQ ID NO: 42237 - protein, 350 aa, Homo sapiens
  Payload ID: 8587
  Gene Symbol: IZUMO1
  Gene Name: izumo sperm-egg fusion 1
  Uniprot ID: Q8IYV9
  ENSP ID: ENSP00000327786
MGPHFTLLCAALAGCLLPAEGCVICDPSVVLALKSLEKDYLPGHLDAKHHKAMMERVENAVKDFQELSLNEDAYMGVVDEATLQKGSWSLLKDLKRITDSDVKGDLFVKELFWMLHLQKETFATYVARFQKEAYCPNKCGVMLQTLIWCKNCKKEVHACRKSYDCGERNVEVPQMEDMILDCELNWHQASEGLTDYSFYRVWGNNTETLVSKGKEATLTKPMVGPEDAGSYRCELGSVNSSPATIINFHVTVLPKMIKEEKPSPNIVTPGEATTESSISLQPLQPEKMLASRLLGLLICGSLALITGLTFAIFRRRKVIDFIKSSLFGLGSGAAEQTQVPKEKATDSRQQ

SEQ ID NO: 42238 - protein, 194 aa, Homo sapiens
  Payload ID: 8587
  Gene Symbol: IZUMO1
  Gene Name: izumo sperm-egg fusion 1
  Uniprot ID: Q8IYV9
  ENSP ID: ENSP00000470144
MGPHFTLLCAALAGCLLPAEGCVICDPSVVLALKSLEKDYLPGHLDAKHHKAMMERVENAVKDFQELSLNEDAYMGVVDEATLQKGSWSLLKDLKRITDSDVKGDLFVKELFWMLHLQKETFATYVARFQKEAYCPNKCGVMLQTLIWCKNCKKEVHACRKSYDCGGERTGPSRRNWCRAECGSSSNGRHDPGL

SEQ ID NO: 42239 - protein, 15 aa, Homo sapiens
  Payload ID: 8587
  Gene Symbol: IZUMO1
  Gene Name: izumo sperm-egg fusion 1
  ENSP ID: ENSP00000471134
MLHLQKETFATYVAR

SEQ ID NO: 42240 - protein, 68 aa, Homo sapiens
  Payload ID: 8587
  Gene Symbol: IZUMO1
  Gene Name: izumo sperm-egg fusion 1
  Uniprot ID: Q8IYV9
  ENSP ID: ENSP00000471815
MGPHFTLLCAALAGCLLPAEGCVICDPSVVLALKSLEKDYLPGHLDAKHHKAMMERMRPHCKRGPGVC

SEQ ID NO: 42241 - protein, 194 aa, Homo sapiens
  Payload ID: 8588
  Gene Symbol: IZUMO1R
  Gene Name: IZUMO1 receptor, JUNO
  ENSP ID: ENSP00000332963
  MOD_RES (1)..(1): Any amino acid
XLLELWTVMPTWAGDELLNICMNAKHHKRVPSPEDKLYEECIPWKDNACCTLTTSWEAHLDVSPLYNFSLFHCGLLMPGCRKHFIQAICFYECSPNLGPWIQPVGSLGWEVAPSGQGERVVNVPLCQEDCEEWWEDCRMSYTCKSNWRGGWDWSQGKNRCPKGAQCLPFSHYFPTPADLCEKTWSNSFKASPER

SEQ ID NO: 42242 - protein, 243 aa, Homo sapiens
  Payload ID: 8588
  Gene Symbol: IZUMO1R
  Gene Name: IZUMO1 receptor, JUNO
  Uniprot ID: A6ND01
  ENSP ID: ENSP00000416935
MACWWPLLLELWTVMPTWAGDELLNICMNAKHHKRVPSPEDKLYEECIPWKDNACCTLTTSWEAHLDVSPLYNFSLFHCGLLMPGCRKHFIQAICFYECSPNLGPWIQPVAPSGQGERVVNVPLCQEDCEEWWEDCRMSYTCKSNWRGGWDWSQGKNRCPKGAQCLPFSHYFPTPADLCEKTWSNSFKASPERRNSGRCLQKWFEPAQGNPNVAVARLFASSAPSWELSYTIMVCSLFLPFLS

SEQ ID NO: 42243 - protein, 842 aa, Homo sapiens
  Payload ID: 8589
  Gene Symbol: JADE1
  Gene Name: jade family PHD finger 1
  Uniprot ID: Q6IE81
  ENSP ID: ENSP00000226319
MKRGRLPSSSEDSDDNGSLSTTWSQNSRSQHRRSSCSRHEDRKPSEVFRTDLITAMKLHDSYQLNPDEYYVLADPWRQEWEKGVQVPVSPGTIPQPVARVVSEEKSLMFIRPKKYIVSSGSEPPELGYVDIRTLADSVCRYDLNDMDAAWLELTNEEFKEMGMPELDEYTMERVLEEFEQRCYDNMNHAIETEEGLGIEYDEDVVCDVCQSPDGEDGNEMVFCDKCNICVHQACYGILKVPEGSWLCRTCALGVQPKCLLCPKKGGAMKPTRSGTKWVHVSCALWIPEVSIGSPEKMEPITKVSHIPSSRWALVCSLCNEKFGASIQCSVKNCRTAFHVTCAFDRGLEMKTILAENDEVKFKSYCPKHSSHRKPEESLGKGAAQENGAPECSPRNPLEPFASLEQNREEAHRVSVRKQKLQQLEDEFYTFVNLLDVARALRLPEEVVDFLYQYWKLKRKVNFNKPLITPKKDEEDNLAKREQDVLFRRLQLFTHLRQDLERVRNLTYMVTRREKIKRSVCKVQEQIFNLYTKLLEQERVSGVPSSCSSSSLENMLLFNSPSVGPDAPKIEDLKWHSAFFRKQMGTSLVHSLKKPHKRDPLQNSPGSEGKTLLKQPDLCGRREGMVVPESFLGLEKTFAEARLISAQQKNGVVMPDHGKRRDNRFHCDLIKGDLKDKSFKQSHKPLRSTDVSQRHLDNTRAATSPGVGQSAPGTRKEIVPKCNGSLIKVNYNQTAVKVPTTPASPVKNWGGFRIPKKGERQQQGEAHDGACHQHSDYPYLGLGRVPAKERAKSKLKSDNENDGYVPDVEMSDSESEASEKKCIHTSSTISRRTDIIRRSILAS

SEQ ID NO: 42244 - protein, 830 aa, Homo sapiens
  Payload ID: 8589
  Gene Symbol: JADE1
  Gene Name: jade family PHD finger 1
  Uniprot ID: Q6IE81
  ENSP ID: ENSP00000388015
MKRGRLPSSSEDSDDNGSLSTTWSQNSRSQHRRSSCSRHEDRKPSEVFRTDLITAMKLHDSYQLNPDEYYVLADPWRQEWEKGVQVPVSPGTIPQPVARPKKYIVSSGSEPPELGYVDIRTLADSVCRYDLNDMDAAWLELTNEEFKEMGMPELDEYTMERVLEEFEQRCYDNMNHAIETEEGLGIEYDEDVVCDVCQSPDGEDGNEMVFCDKCNICVHQACYGILKVPEGSWLCRTCALGVQPKCLLCPKKGGAMKPTRSGTKWVHVSCALWIPEVSIGSPEKMEPITKVSHIPSSRWALVCSLCNEKFGASIQCSVKNCRTAFHVTCAFDRGLEMKTILAENDEVKFKSYCPKHSSHRKPEESLGKGAAQENGAPECSPRNPLEPFASLEQNREEAHRVSVRKQKLQQLEDEFYTFVNLLDVARALRLPEEVVDFLYQYWKLKRKVNFNKPLITPKKDEEDNLAKREQDVLFRRLQLFTHLRQDLERVRNLTYMVTRREKIKRSVCKVQEQIFNLYTKLLEQERVSGVPSSCSSSSLENMLLFNSPSVGPDAPKIEDLKWHSAFFRKQMGTSLVHSLKKPHKRDPLQNSPGSEGKTLLKQPDLCGRREGMVVPESFLGLEKTFAEARLISAQQKNGVVMPDHGKRRDNRFHCDLIKGDLKDKSFKQSHKPLRSTDVSQRHLDNTRAATSPGVGQSAPGTRKEIVPKCNGSLIKVNYNQTAVKVPTTPASPVKNWGGFRIPKKGERQQQGEAHDGACHQHSDYPYLGLGRVPAKERAKSKLKSDNENDGYVPDVEMSDSESEASEKKCIHTSSTISRRTDIIRRSILAS

SEQ ID NO: 42245 - protein, 509 aa, Homo sapiens
  Payload ID: 8589
  Gene Symbol: JADE1
  Gene Name: jade family PHD finger 1
  Uniprot ID: Q6IE81
  ENSP ID: ENSP00000404211
MKRGRLPSSSEDSDDNGSLSTTWSQNSRSQHRRSSCSRHEDRKPSEVFRTDLITAMKLHDSYQLNPDEYYVLADPWRQEWEKGVQVPVSPGTIPQPVARVVSEEKSLMFIRPKKYIVSSGSEPPELGYVDIRTLADSVCRYDLNDMDAAWLELTNEEFKEMGMPELDEYTMERVLEEFEQRCYDNMNHAIETEEGLGIEYDEDVVCDVCQSPDGEDGNEMVFCDKCNICVHQACYGILKVPEGSWLCRTCALGVQPKCLLCPKKGGAMKPTRSGTKWVHVSCALWIPEVSIGSPEKMEPITKVSHIPSSRWALVCSLCNEKFGASIQCSVKNCRTAFHVTCAFDRGLEMKTILAENDEVKFKSYCPKHSSHRKPEESLGKGAAQENGAPECSPRNPLEPFASLEQNREEAHRVSVRKQKLQQLEDEFYTFVNLLDVARALRLPEEVVDFLYQYWKLKRKVNFNKPLITPKKDEEDNLAKREQDVLFRRLQLFTHLRQDLERVMIDTDTL

SEQ ID NO: 42246 - protein, 143 aa, Homo sapiens
  Payload ID: 8589
  Gene Symbol: JADE1
  Gene Name: jade family PHD finger 1
  ENSP ID: ENSP00000421265
MKRGRLPSSSEDSDDNGSLSTTWSQNSRSQHRRSSCSRHEDRKPSEVFRTDLITAMKLHDSYQLNPDEYYVLADPWRQEWEKGVQVPVSPGTIPQPVARVVSEEKSLMFIRPKKYIVSSGSEPPELGYVDIRTLADSVCRYDL

SEQ ID NO: 42247 - protein, 49 aa, Homo sapiens
  Payload ID: 8589
  Gene Symbol: JADE1
  Gene Name: jade family PHD finger 1
  ENSP ID: ENSP00000421778
MKRGRLPSSSEDSDDNGSLSTTWSQNSRSQHRRSSCSRHEDRKPSEGCV

SEQ ID NO: 42248 - protein, 129 aa, Homo sapiens
  Payload ID: 8589
  Gene Symbol: JADE1
  Gene Name: jade family PHD finger 1
  ENSP ID: ENSP00000422445
MKRGRLPSSSEDSDDNGSLSTTWSQNSRSQHRRSSCSRHEDRKPSEVFRTDLITAMKLHDSYQLNPDEYYVLADPWRQEWEKGVQVPVSPGTIPQPVARVVSEEKSLMFIRPKKYIVSSGSEPPELGYV

SEQ ID NO: 42249 - protein, 509 aa, Homo sapiens; identical to SEQ ID NO: 42245
  Payload ID: 8589
  Gene Symbol: JADE1
  Gene Name: jade family PHD finger 1
  Uniprot ID: Q6IE81
  ENSP ID: ENSP00000423737

SEQ ID NO: 42250 - protein, 131 aa, Homo sapiens
  Payload ID: 8589
  Gene Symbol: JADE1
  Gene Name: jade family PHD finger 1
  ENSP ID: ENSP00000424280
MKRGRLPSSSEDSDDNGSLSTTWSQNSRSQHRRSSCSRHEDRKPSEVFRTDLITAMKLHDSYQLNPDEYYVLADPWRQEWEKGVQVPVSPGTIPQPVARVVSEEKSLMFIRPKKYIVSSGSEPPELGYVDI

SEQ ID NO: 42251 - protein, 119 aa, Homo sapiens
  Payload ID: 8589
  Gene Symbol: JADE1
  Gene Name: jade family PHD finger 1
  ENSP ID: ENSP00000425535
MKRGRLPSSSEDSDDNGSLSTTWSQNSRSQHRRSSCSRHEDRKPSEVFRTDLITAMKLHDSYQLNPDEYYVLADPWRQEWEKGVQVPVSPGTIPQPVARVVSEEKSLMFIRPKKYIVSS

SEQ ID NO: 42252 - protein, 842 aa, Homo sapiens; identical to SEQ ID NO: 42243
  Payload ID: 8589
  Gene Symbol: JADE1
  Gene Name: jade family PHD finger 1
  Uniprot ID: Q6IE81
  ENSP ID: ENSP00000425730

SEQ ID NO: 42253 - protein, 136 aa, Homo sapiens
  Payload ID: 8589
  Gene Symbol: JADE1
  Gene Name: jade family PHD finger 1
  ENSP ID: ENSP00000426590
MKRGRLPSSSEDSDDNGSLSTTWSQNSRSQHRRSSCSRHEDRKPSEVFRTDLITAMKLHDSYQLNPDEYYVLADPWRQEWEKGVQVPVSPGTIPQPVARVVSEEKSLMFIRPKKYIVSSGSEPPELGYVDIRTLAD

SEQ ID NO: 42254 - protein, 17 aa, Homo sapiens
  Payload ID: 8589
  Gene Symbol: JADE1
  Gene Name: jade family PHD finger 1
  ENSP ID: ENSP00000426920
MKRGRLPSSSEDSDDNG

SEQ ID NO: 42255 - protein, 842 aa, Homo sapiens; identical to SEQ ID NO: 42243
  Payload ID: 8589
  Gene Symbol: JADE1
  Gene Name: jade family PHD finger 1
  Uniprot ID: Q6IE81
  ENSP ID: ENSP00000482212

SEQ ID NO: 42256 - protein, 842 aa, Homo sapiens; identical to SEQ ID NO: 42243
  Payload ID: 8589
  Gene Symbol: JADE1
  Gene Name: jade family PHD finger 1
  Uniprot ID: Q6IE81
  ENSP ID: ENSP00000483219

SEQ ID NO: 42257 - protein, 834 aa, Homo sapiens
  Payload ID: 8590
  Gene Symbol: JADE2
  Gene Name: jade family PHD finger 2
  ENSP ID: ENSP00000282605
MEEKRRKYSISSDNSDTTDSHATSTSASRCSKLPSSTKSGWPRQNEKKPSEVFRTDLITAMKIPDSYQLSPDDYYILADPWRQEWEKGVQVPAGAEAIPEPVVRILPPLEGPPAQASPSSTMLGEGSQPDWPGGSRYDLDEIDAYWLELINSELKEMERPELDELTLERVLEELETLCHQNMARAIETQEGLGIEYDEDVVCDVCRSPEGEDGNEMVFCDKCNVCVHQACYGILKVPTGSWLCRTCALGVQPKCLLCPKRGGALKPTRSGTKWVHVSCALWIPEVSIGCPEKMEPITKISHIPASRWALSCSLCKECTGTCIQCSMPSCVTAFHVTCAFDHGLEMRTILADNDEVKFKSFCQEHSDGGPRNEPTSEPTEPSQAGEDLEKVTLRKQRLQQLEEDFYELVEPAEVAERLDLAEALVDFIYQYWKLKRKANANQPLLTPKTDEVDNLAQQEQDVLYRRLKLFTHLRQDLERVRNLCYMVTRRERTKHAICKLQEQIFHLQMKLIEQDLCRERSGRRAKGKKSDSKRKGCEGSKGSTEKKEKVKAGPDSVLGQLAGLSTSFPIDGTFFNSWLAQSVQITAENMAMSEWPLNNGHREDPAPGLLSEELLQDEETLLSFMRDPSLRPGDPARKARGRTRLPAKKKPPPPPPQDGPGSRTTPDKAPKKTWGQDAGSGKGGQGPPTRKPPRRTSSHLPSSPAAGDCPILATPESPPPLAPETPDEAASVAADSDVQVPGPAASPKPLGRLRPPRESKVTRRLPGARPDAGMGPPSAVAERPKVSLHFDTETDGYFSDGEMSDSDVEAEDGGVQRGPREAGAEEVVRMGVLAS

SEQ ID NO: 42258 - protein, 791 aa, Homo sapiens
  Payload ID: 8590
  Gene Symbol: JADE2
  Gene Name: jade family PHD finger 2
  ENSP ID: ENSP00000354425
MEEKRRKYSISSDNSDTTDSHATSTSASRCSKLPSSTKSGWPRQNEKKPSEVFRTDLITAMKIPDSYQLSPDDYYILADPWRQEWEKGVQVPAGAEAIPEPVVRILPPLEGPPAQASPSSTMLGEGSQPDWPGGSRYDLDEIDAYWLELINSELKEMERPELDELTLERVLEELETLCHQNMARAIETQEGLGIEYDEDVVCDVCRSPEGEDGNEMVFCDKCNVCVHQACYGILKVPTGSWLCRTCALGVQPKCLLCPKRGGALKPTRSGTKWVHVSCALWIPEVSIGCPEKMEPITKISHIPASRWALSCSLCKECTGTCIQCSMPSCVTAFHVTCAFDHGLEMRTILADNDEVKFKSFCQEHSDGGPRNEPTSEPTEPSQAGEDLEKVTLRKQRLQQLEEDFYELVEPAEVAERLDLAEALVDFIYQYWKLKRKANANQPLLTPKTDEVDNLAQQEQDVLYRRLKLFTHLRQDLERVRNLCYMVTRRERTKHAICKLQEQIFHLQMKLIEQDLCRAGLSTSFPIDGTFFNSWLAQSVQITAENMAMSEWPLNNGHREDPAPGLLSEELLQDEETLLSFMRDPSLRPGDPARKARGRTRLPAKKKPPPPPPQDGPGSRTTPDKAPKKTWGQDAGSGKGGQGPPTRKPPRRTSSHLPSSPAAGDCPILATPESPPPLAPETPDEAASVAADSDVQVPGPAASPKPLGRLRPPRESKVTRRLPGARPDAGMGPPSAVAERPKVSLHFDTETDGYFSDGEMSDSDVEAEDGGVQRGPREAGAEEVVRMGVLAS

SEQ ID NO: 42259 - protein, 790 aa, Homo sapiens
  Payload ID: 8590
  Gene Symbol: JADE2
  Gene Name: jade family PHD finger 2
  Uniprot ID: Q9NQC1
  ENSP ID: ENSP00000378451
MEEKRRKYSISSDNSDTTDSHATSTSASRCSKLPSSTKSGWPRQNEKKPSEVFRTDLITAMKIPDSYQLSPDDYYILADPWRQEWEKGVQVPAGAEAIPEPVVRILPPLEGPPAQASPSSTMLGEGSQPDWPGGSRYDLDEIDAYWLELINSELKEMERPELDELTLERVLEELETLCHQNMARAIETQEGLGIEYDEDVVCDVCRSPEGEDGNEMVFCDKCNVCVHQACYGILKVPTGSWLCRTCALGVQPKCLLCPKRGGALKPTRSGTKWVHVSCALWIPEVSIGCPEKMEPITKISHIPASRWALSCSLCKECTGTCIQCSMPSCVTAFHVTCAFDHGLEMRTILADNDEVKFKSFCQEHSDGGPRNEPTSEPTEPSQAGEDLEKVTLRKQRLQQLEEDFYELVEPAEVAERLDLAEALVDFIYQYWKLKRKANANQPLLTPKTDEVDNLAQQEQDVLYRRLKLFTHLRQDLERVRNLCYMVTRRERTKHAICKLQEQIFHLQMKLIEQDLCRGLSTSFPIDGTFFNSWLAQSVQITAENMAMSEWPLNNGHREDPAPGLLSEELLQDEETLLSFMRDPSLRPGDPARKARGRTRLPAKKKPPPPPPQDGPGSRTTPDKAPKKTWGQDAGSGKGGQGPPTRKPPRRTSSHLPSSPAAGDCPILATPESPPPLAPETPDEAASVAADSDVQVPGPAASPKPLGRLRPPRESKVTRRLPGARPDAGMGPPSAVAERPKVSLHFDTETDGYFSDGEMSDSDVEAEDGGVQRGPREAGAEEVVRMGVLAS

SEQ ID NO: 42260 - protein, 509 aa, Homo sapiens
  Payload ID: 8590
  Gene Symbol: JADE2
  Gene Name: jade family PHD finger 2
  ENSP ID: ENSP00000384671
MEEKRRKYSISSDNSDTTDSHATSTSASRCSKLPSSTKSGWPRQNEKKPSEVFRTDLITAMKIPDSYQLSPDDYYILADPWRQEWEKGVQVPAGAEAIPEPVVRILPPLEGPPAQASPSSTMLGEGSQPDWPGGSRYDLDEIDAYWLELINSELKEMERPELDELTLERVLEELETLCHQNMARAIETQEGLGIEYDEDVVCDVCRSPEGEDGNEMVFCDKCNVCVHQACYGILKVPTGSWLCRTCALGVQPKCLLCPKRGGALKPTRSGTKWVHVSCALWIPEVSIGCPEKMEPITKISHIPASRWALSCSLCKECTGTCIQCSMPSCVTAFHVTCAFDHGLEMRTILADNDEVKFKSFCQEHSDGGPRNEPTSEPTEPSQAGEDLEKVTLRKQRLQQLEEDFYELVEPAEVAERLDLAEALVDFIYQYWKLKRKANANQPLLTPKTDEVDNLAQQEQDVLYRRLKLFTHLRQDLERSGLGGEQRARRVTRRGRAARAPRAALRRKRK

SEQ ID NO: 42261 - protein, 47 aa, Homo sapiens
  Payload ID: 8590
  Gene Symbol: JADE2
  Gene Name: jade family PHD finger 2
  ENSP ID: ENSP00000396026
  MOD_RES (1)..(1): Any amino acid
XRERSGRRAKGKKSDSKRKGCEGSKGSTEKKEKVKAGPDSVLGQLGE

SEQ ID NO: 42262 - protein, 255 aa, Homo sapiens
  Payload ID: 8590
  Gene Symbol: JADE2
  Gene Name: jade family PHD finger 2
  ENSP ID: ENSP00000406189
MEEKRRKYSISSDNSDTTDSHATSTSASRCSKLPSSTKSGWPRQNEKKPSEVFRTDLITAMKIPDSYQLSPDDYYILADPWRQEWEKGVQVPAGAEAIPEPVVRILPPLEGPPAQASPSSTMLGEGSQPDWPGGSRYDLDEIDAYWLELINSELKEMERPELDELTLERVLEELETLCHQNMARAIETQEGLGIEYDEDVVCDVCRSPEGEDGNEMVFCDKCNVCVHQACYGILKVPTGSWLCRTCALGVQPKCL

SEQ ID NO: 42263 - protein, 149 aa, Homo sapiens
  Payload ID: 8590
  Gene Symbol: JADE2
  Gene Name: jade family PHD finger 2
  ENSP ID: ENSP00000422991
MEEKRRKYSISSDNSDTTDSHATSTSASRCSKLPSSTKSGWPRQNEKKPSEVFRTDLITAMKIPDSYQLSPDDYYILADPWRQEWEKGVQVPAGAEAIPEPVVRILPPLEGPPAQASPSSTMLGEGSQPDWPGGSRYDLDEIDAYWLEL

SEQ ID NO: 42264 - protein, 246 aa, Homo sapiens
  Payload ID: 8590
  Gene Symbol: JADE2
  Gene Name: jade family PHD finger 2
  ENSP ID: ENSP00000483173
MAMSEWPLNNGHREDPAPGLLSEELLQDEETLLSFMRDPSLRPGDPARKARGRTRLPAKKKPPPPPPQDGPGSRTTPDKAPKKTWGQDAGSGKGGQGPPTRKPPRRTSSHLPSSPAAGDCPILATPESPPPLAPETPDEAASVAADSDVQVPGPAASPKPLGRLRPPRESKVTRRLPGARPDAGMGPPSAVAERPKVSLHFDTETDGYFSDGEMSDSDVEAEDGGVQRGPREAGAEEVVRMGVLAS

SEQ ID NO: 42265 - protein, 186 aa, Homo sapiens
  Payload ID: 8591
  Gene Symbol: JADE3
  Gene Name: jade family PHD finger 3
  ENSP ID: ENSP00000391009
MKRHRPVSSSDSSDESPSTSFTSGSMYRIKSKIPNEHKKPAEVFRKDLISAMKLPDSHHINPDSYYLFADTWKEEWEKGVQVPASPDTVPQPSLRIIAEKVKDVLFIRPRKYIHCSSPDTTEPGYINIMELAASVCRYDLDDMDIFWLQELNEDLAEMGCGPVDENLMEKTVEVLERHCHENMNHA

SEQ ID NO: 42266 - protein, 114 aa, Homo sapiens
  Payload ID: 8591
  Gene Symbol: JADE3
  Gene Name: jade family PHD finger 3
  ENSP ID: ENSP00000400584
MKRHRPVSSSDSSDESPSTSFTSGSMYRIKSKIPNEHKKPAEVFRKDLISAMKLPDSHHINPDSYYLFADTWKEEWEKGVQVPASPDTVPQPSLRIIAEKVKDVLFIRPRKYIH

SEQ ID NO: 42267 - protein, 823 aa, Homo sapiens
  Payload ID: 8591
  Gene Symbol: JADE3
  Gene Name: jade family PHD finger 3
  Uniprot ID: Q92613
  ENSP ID: ENSP00000479377
MKRHRPVSSSDSSDESPSTSFTSGSMYRIKSKIPNEHKKPAEVFRKDLISAMKLPDSHHINPDSYYLFADTWKEEWEKGVQVPASPDTVPQPSLRIIAEKVKDVLFIRPRKYIHCSSPDTTEPGYINIMELAASVCRYDLDDMDIFWLQELNEDLAEMGCGPVDENLMEKTVEVLERHCHENMNHAIETEEGLGIEYDEDVICDVCRSPDSEEGNDMVFCDKCNVCVHQACYGILKVPEGSWLCRSCVLGIYPQCVLCPKKGGALKTTKTGTKWAHVSCALWIPEVSIACPERMEPITKISHIPPSRWALVCNLCKLKTGACIQCSIKSCITAFHVTCAFEHGLEMKTILDEGDEVKFKSYCLKHSQNRQKLGEAEYPHHRAKEQSQAKSEKTSLRAQKLRELEEEFYSLVRVEDVAAELGMPTLAVDFIYNYWKLKRKSNFNKPLFPPKEDEENGLVQPKEESIHTRMRMFMHLRQDLERVRNLCYMISRREKLKLSHNKIQEQIFGLQVQLLNQEIDAGLPLTNALENSLFYPPPRITLKLKMPKSTPEDHRNSSTETDQQPHSPDSSSSVHSIRNMQVPQESLEMRTKSYPRYPLESKNNRLLASLSHSRSEAKESSPAWRTPSSECYHGQSLGKPLVLQAALHGQSSIGNGKSQPNSKFAKSNGLEGSWSGNVTQKDSSSEMFCDQEPVFSPHLVSQGSFRKSTVEHFSRSFKETTNRWVKNTEDLQCYVKPTKNMSPKEQFWGRQVLRRSAGRAPYQENDGYCPDLELSDSEAESDGNKEKVRVRKDSSDRENPPHDSRRDCHGKSKTHPLSHSSMQR

SEQ ID NO: 42268 - protein, 823 aa, Homo sapiens; identical to SEQ ID NO: 42267
  Payload ID: 8591
  Gene Symbol: JADE3
  Gene Name: jade family PHD finger 3
  Uniprot ID: Q92613
  ENSP ID: ENSP00000481850

SEQ ID NO: 42269 - protein, 1218 aa, Homo sapiens
  Payload ID: 8592
  Gene Symbol: JAG1
  Gene Name: jagged 1
  Uniprot ID: P78504
  ENSP ID: ENSP00000254958
MRSPRTRGRSGRPLSLLLALLCALRAKVCGASGQFELEILSMQNVNGELQNGNCCGGARNPGDRKCTRDECDTYFKVCLKEYQSRVTAGGPCSFGSGSTPVIGGNTFNLKASRGNDRNRIVLPFSFAWPRSYTLLVEAWDSSNDTVQPDSIIEKASHSGMINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQYGWQGLYCDKCIPHPGCVHGICNEPWQCLCETNWGGQLCDKDLNYCGTHQPCLNGGTCSNTGPDKYQCSCPEGYSGPNCEIAEHACLSDPCHNRGSCKETSLGFECECSPGWTGPTCSTNIDDCSPNNCSHGGTCQDLVNGFKCVCPPQWTGKTCQLDANECEAKPCVNAKSCKNLIASYYCDCLPGWMGQNCDININDCLGQCQNDASCRDLVNGYRCICPPGYAGDHCERDIDECASNPCLNGGHCQNEINRFQCLCPTGFSGNLCQLDIDYCEPNPCQNGAQCYNRASDYFCKCPEDYEGKNCSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYCETNINDCSQNPCHNGGTCRDLVNDFYCDCKNGWKGKTCHSRDSQCDEATCNNGGTCYDEGDAFKCMCPGGWEGTTCNIARNSSCLPNPCHNGGTCVVNGESFTCVCKEGWEGPICAQNTNDCSPHPCYNSGTCVDGDNWYRCECAPGFAGPDCRININECQSSPCAFGATCVDEINGYRCVCPPGHSGAKCQEVSGRPCITMGSVIPDGAKWDDDCNTCQCLNGRIACSKVWCGPRPCLLHKGHSECPSGQSCIPILDDQCFVHPCTGVGECRSSSLQPVKTKCTSDSYYQDNCANITFTFNKEMMSPGLTTEHICSELRNLNILKNVSAEYSIYIACEPSPSANNEIHVAISAEDIRDDGNPIKEITDKIIDLVSKRDGNSSLIAAVAEVRVQRRPLKNRTDFLVPLLSSVLTVAWICCLVTAFYWCLRKRRKPGSHTHSASEDNTTNNVREQLNQIKNPIEKHGANTVPIKDYENKNSKMSKIRTHNSEVEEDDMDKHQQKARFAKQPAYTLVDREEKPPNGTPTKHPNWTNKQDNRDLESAQSLNRMEYIV

SEQ ID NO: 42270 - protein, 172 aa, Homo sapiens
  Payload ID: 8592
  Gene Symbol: JAG1
  Gene Name: jagged 1
  ENSP ID: ENSP00000481034
  MOD_RES (1)..(1): Any amino acid
XPEDYEGKNCSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYCETSESATLWGALGCMGHVGGIPLQRGKTFFVLEISGSKTAVISALGQYHLCLICIYES

SEQ ID NO: 42271 - protein, 74 aa, Homo sapiens
  Payload ID: 8592
  Gene Symbol: JAG1
  Gene Name: jagged 1
  ENSP ID: ENSP00000484139
  MOD_RES (1)..(1): Any amino acid
XCQLDANECEAKPCVNAKSCKNLIASYYCDCLPGWMGQNCDININDCLGQCQNDASCRAITVRETSMNVPATPV

SEQ ID NO: 42272 - protein, 1238 aa, Homo sapiens
  Payload ID: 8593
  Gene Symbol: JAG2
  Gene Name: jagged 2
  Uniprot ID: Q9Y219
  ENSP ID: ENSP00000328169
MRAQGRGRLPRRLLLLLALWVQAARPMGYFELQLSALRNVNGELLSGACCDGDGRTTRAGGCGHDECDTYVRVCLKEYQAKVTPTGPCSYGHGATPVLGGNSFYLPPAGAAGDRARARARAGGDQDPGLVVIPFQFAWPRSFTLIVEAWDWDNDTTPNEELLIERVSHAGMINPEDRWKSLHFSGHVAHLELQIRVRCDENYYSATCNKFCRPRNDFFGHYTCDQYGNKACMDGWMGKECKEAVCKQGCNLLHGGCTVPGECRCSYGWQGRFCDECVPYPGCVHGSCVEPWQCNCETNWGGLLCDKDLNYCGSHHPCTNGGTCINAEPDQYRCTCPDGYSGRNCEKAEHACTSNPCANGGSCHEVPSGFECHCPSGWSGPTCALDIDECASNPCAAGGTCVDQVDGFECICPEQWVGATCQLDANECEGKPCLNAFSCKNLIGGYYCDCIPGWKGINCHINVNDCRGQCQHGGTCKDLVNGYQCVCPRGFGGRHCELERDECASSPCHSGGLCEDLADGFHCHCPQGFSGPLCEVDVDLCEPSPCRNGARCYNLEGDYYCACPDDFGGKNCSVPREPCPGGACRVIDGCGSDAGPGMPGTAASGVCGPHGRCVSQPGGNFSCICDSGFTGTYCHENIDDCLGQPCRNGGTCIDEVDAFRCFCPSGWEGELCDTNPNDCLPDPCHSRGRCYDLVNDFYCACDDGWKGKTCHSREFQCDAYTCSNGGTCYDSGDTFRCACPPGWKGSTCAVAKNSSCLPNPCVNGGTCVGSGASFSCICRDGWEGRTCTHNTNDCNPLPCYNGGICVDGVNWFRCECAPGFAGPDCRINIDECQSSPCAYGATCVDEINGYRCSCPPGRAGPRCQEVIGFGRSCWSRGTPFPHGSSWVEDCNSCRCLDGRRDCSKVWCGWKPCLLAGQPEALSAQCPLGQRCLEKAPGQCLRPPCEAWGECGAEEPPSTPCLPRSGHLDNNCARLTLHFNRDHVPQGTTVGAICSGIRSLPATRAVARDRLLVLLCDRASSGASAVEVAVSFSPARDLPDSSLIQGAAHAIVAAITQRGNSSLLLAVTEVKVETVVTGGSSTGLLVPVLCGAFSVLWLACVVLCVWWTRKRRKERERSRLPREESANNQWAPLNPIRNPIERPGGHKDVLYQCKNFTPPPRRADEALPGPAGHAAVREDEEDEDLGRGEEDSLEAEKFLSHKFTKDPGRSPGRPAHWASGPKVDNRAVRSINEARYAGKE

SEQ ID NO: 42273 - protein, 1200 aa, Homo sapiens
  Payload ID: 8593
  Gene Symbol: JAG2
  Gene Name: jagged 2
  Uniprot ID: Q9Y219
  ENSP ID: ENSP00000328566
MRAQGRGRLPRRLLLLLALWVQAARPMGYFELQLSALRNVNGELLSGACCDGDGRTTRAGGCGHDECDTYVRVCLKEYQAKVTPTGPCSYGHGATPVLGGNSFYLPPAGAAGDRARARARAGGDQDPGLVVIPFQFAWPRSFTLIVEAWDWDNDTTPNEELLIERVSHAGMINPEDRWKSLHFSGHVAHLELQIRVRCDENYYSATCNKFCRPRNDFFGHYTCDQYGNKACMDGWMGKECKEAVCKQGCNLLHGGCTVPGECRCSYGWQGRFCDECVPYPGCVHGSCVEPWQCNCETNWGGLLCDKDLNYCGSHHPCTNGGTCINAEPDQYRCTCPDGYSGRNCEKAEHACTSNPCANGGSCHEVPSGFECHCPSGWSGPTCALDIDECASNPCAAGGTCVDQVDGFECICPEQWVGATCQLDVNDCRGQCQHGGTCKDLVNGYQCVCPRGFGGRHCELERDECASSPCHSGGLCEDLADGFHCHCPQGFSGPLCEVDVDLCEPSPCRNGARCYNLEGDYYCACPDDFGGKNCSVPREPCPGGACRVIDGCGSDAGPGMPGTAASGVCGPHGRCVSQPGGNFSCICDSGFTGTYCHENIDDCLGQPCRNGGTCIDEVDAFRCFCPSGWEGELCDTNPNDCLPDPCHSRGRCYDLVNDFYCACDDGWKGKTCHSREFQCDAYTCSNGGTCYDSGDTFRCACPPGWKGSTCAVAKNSSCLPNPCVNGGTCVGSGASFSCICRDGWEGRTCTHNTNDCNPLPCYNGGICVDGVNWFRCECAPGFAGPDCRINIDECQSSPCAYGATCVDEINGYRCSCPPGRAGPRCQEVIGFGRSCWSRGTPFPHGSSWVEDCNSCRCLDGRRDCSKVWCGWKPCLLAGQPEALSAQCPLGQRCLEKAPGQCLRPPCEAWGECGAEEPPSTPCLPRSGHLDNNCARLTLHFNRDHVPQGTTVGAICSGIRSLPATRAVARDRLLVLLCDRASSGASAVEVAVSFSPARDLPDSSLIQGAAHAIVAAITQRGNSSLLLAVTEVKVETVVTGGSSTGLLVPVLCGAFSVLWLACVVLCVWWTRKRRKERERSRLPREESANNQWAPLNPIRNPIERPGGHKDVLYQCKNFTPPPRRADEALPGPAGHAAVREDEEDEDLGRGEEDSLEAEKFLSHKFTKDPGRSPGRPAHWASGPKVDNRAVRSINEARYAGKE

SEQ ID NO: 42274 - protein, 183 aa, Homo sapiens
  Payload ID: 8594
  Gene Symbol: JAGN1
  Gene Name: jagunal homolog 1
  Uniprot ID: Q8N5M9
  ENSP ID: ENSP00000306106
MASRAGPRAAGTDGSDFQHRERVAMHYQMSVTLKYEIKKLIYVHLVIWLLLVAKMSVGHLRLLSHDQVAMPYQWEYPYLLSILPSLLGLLSFPRNNISYLVLSMISMGLFSIAPLIYGSMEMFPAAQQLYRHGKAYRFLFGFSAVSIMYLVLVLAVQVHAWQLYYSKKLLDSWFTSTQEKKHK

SEQ ID NO: 42275 - protein, 181 aa, Homo sapiens
  Payload ID: 8594
  Gene Symbol: JAGN1
  Gene Name: jagunal homolog 1
  ENSP ID: ENSP00000481606
MASRAGPRAAGTDGSDFQHRERVAMHYQMSVTLKYEIKKLIYVHLVIWLLLVAKMSVGHLRLLSHDQVAMPYQWEYPYLLSILPSLLGLLSFPRNNISYLVLSMISMGLFHRSTHLWQHGDVPCCTAATAMARPTVSSLVFLPFPMYLVLVLAVQVHAWQLYYSKKLLDSWFTSTQEKKHK

SEQ ID NO: 42276 - protein, 1154 aa, Homo sapiens
  Payload ID: 8595
  Gene Symbol: JAK1
  Gene Name: Janus kinase 1
  Uniprot ID: P23458
  ENSP ID: ENSP00000343204
MQYLNIKEDCNAMAFCAKMRSSKKTEVNLEAPEPGVEVIFYLSDREPLRLGSGEYTAEELCIRAAQACRISPLCHNLFALYDENTKLWYAPNRTITVDDKMSLRLHYRMRFYFTNWHGTNDNEQSVWRHSPKKQKNGYEKKKIPDATPLLDASSLEYLFAQGQYDLVKCLAPIRDPKTEQDGHDIENECLGMAVLAISHYAMMKKMQLPELPKDISYKRYIPETLNKSIRQRNLLTRMRINNVFKDFLKEFNNKTICDSSVSTHDLKVKYLATLETLTKHYGAEIFETSMLLISSENEMNWFHSNDGGNVLYYEVMVTGNLGIQWRHKPNVVSVEKEKNKLKRKKLENKHKKDEEKNKIREEWNNFSYFPEITHIVIKESVVSINKQDNKKMELKLSSHEEALSFVSLVDGYFRLTADAHHYLCTDVAPPLIVHNIQNGCHGPICTEYAINKLRQEGSEEGMYVLRWSCTDFDNILMTVTCFEKSEQVQGAQKQFKNFQIEVQKGRYSLHGSDRSFPSLGDLMSHLKKQILRTDNISFMLKRCCQPKPREISNLLVATKKAQEWQPVYPMSQLSFDRILKKDLVQGEHLGRGTRTHIYSGTLMDYKDDEGTSEEKKIKVILKVLDPSHRDISLAFFEAASMMRQVSHKHIVYLYGVCVRDVENIMVEEFVEGGPLDLFMHRKSDVLTTPWKFKVAKQLASALSYLEDKDLVHGNVCTKNLLLAREGIDSECGPFIKLSDPGIPITVLSRQECIERIPWIAPECVEDSKNLSVAADKWSFGTTLWEICYNGEIPLKDKTLIEKERFYESRCRPVTPSCKELADLMTRCMNYDPNQRPFFRAIMRDINKLEEQNPDIVSEKKPATEVDPTHFEKRFLKRIRDLGEGHFGKVELCRYDPEGDNTGEQVAVKSLKPESGGNHIADLKKEIEILRNLYHENIVKYKGICTEDGGNGIKLIMEFLPSGSLKEYLPKNKNKINLKQQLKYAVQICKGMDYLGSRQYVHRDLAARNVLVESEHQVKIGDFGLTKAIETDKEYYTVKDDRDSPVFWYAPECLMQSKFYIASDVWSFGVTLHELLTYCDSDSSPMALFLKMIGPTHGQMTVTRLVNTLKEGKRLPCPPNCPDEVYQLMRKCWEFQPSNRTSFQNLIEGFEALLK

SEQ ID NO: 42277 - protein, 1132 aa, Homo sapiens
  Payload ID: 8596
  Gene Symbol: JAK2
  Gene Name: Janus kinase 2
  Uniprot ID: O60674
  ENSP ID: ENSP00000371067
MGMACLTMTEMEGTSTSSIYQNGDISGNANSMKQIDPVLQVYLYHSLGKSEADYLTFPSGEYVAEEICIAASKACGITPVYHNMFALMSETERIWYPPNHVFHIDESTRHNVLYRIRFYFPRWYCSGSNRAYRHGISRGAEAPLLDDFVMSYLFAQWRHDFVHGWIKVPVTHETQEECLGMAVLDMMRIAKENDQTPLAIYNSISYKTFLPKCIRAKIQDYHILTRKRIRYRFRRFIQQFSQCKATARNLKLKYLINLETLQSAFYTEKFEVKEPGSGPSGEEIFATIIITGNGGIQWSRGKHKESETLTEQDLQLYCDFPNIIDVSIKQANQEGSNESRVVTIHKQDGKNLEIELSSLREALSFVSLIDGYYRLTADAHHYLCKEVAPPAVLENIQSNCHGPISMDFAISKLKKAGNQTGLYVLRCSPKDFNKYFLTFAVERENVIEYKHCLITKNENEEYNLSGTKKNFSSLKDLLNCYQMETVRSDNIIFQFTKCCPPKPKDKSNLLVFRTNGVSDVPTSPTLQRPTHMNQMVFHKIRNEDLIFNESLGQGTFTKIFKGVRREVGDYGQLHETEVLLKVLDKAHRNYSESFFEAASMMSKLSHKHLVLNYGVCVCGDENILVQEFVKFGSLDTYLKKNKNCINILWKLEVAKQLAWAMHFLEENTLIHGNVCAKNILLIREEDRKTGNPPFIKLSDPGISITVLPKDILQERIPWVPPECIENPKNLNLATDKWSFGTTLWEICSGGDKPLSALDSQRKLQFYEDRHQLPAPKWAELANLINNCMDYEPDFRPSFRAIIRDLNSLFTPDYELLTENDMLPNMRIGALGFSGAFEDRDPTQFEERHLKFLQQLGKGNFGSVEMCRYDPLQDNTGEVVAVKKLQHSTEEHLRDFEREIEILKSLQHDNIVKYKGVCYSAGRRNLKLIMEYLPYGSLRDYLQKHKERIDHIKLLQYTSQICKGMEYLGTKRYIHRDLATRNILVENENRVKIGDFGLTKVLPQDKEYYKVKEPGESPIFWYAPESLTESKFSVASDVWSFGVVLYELFTYIEKSKSPPAEFMRMIGNDKQGQMIVFHLIELLKNNGRLPRPDGCPDEIYMIMTECWNNNVNQRPSFRDLALRVDQIRDNMAG

SEQ ID NO: 42278 - protein, 1124 aa, Homo sapiens
  Payload ID: 8597
  Gene Symbol: JAK3
  Gene Name: Janus kinase 3
  Uniprot ID: P52333
  ENSP ID: ENSP00000391676
MAPPSEETPLIPQRSCSLLSTEAGALHVLLPARGPGPPQRLSFSFGDHLAEDLCVQAAKASGILPVYHSLFALATEDLSCWFPPSHIFSVEDASTQVLLYRIRFYFPNWFGLEKCHRFGLRKDLASAILDLPVLEHLFAQHRSDLVSGRLPVGLSLKEQGECLSLAVLDLARMAREQAQRPGELLKTVSYKACLPPSLRDLIQGLSFVTRRRIRRTVRRALRRVAACQADRHSLMAKYIMDLERLDPAGAAETFHVGLPGALGGHDGLGLLRVAGDGGIAWTQGEQEVLQPFCDFPEIVDISIKQAPRVGPAGEHRLVTVTRTDNQILEAEFPGLPEALSFVALVDGYFRLTTDSQHFFCKEVAPPRLLEEVAEQCHGPITLDFAINKLKTGGSRPGSYVLRRSPQDFDSFLLTVCVQNPLGPDYKGCLIRRSPTGTFLLVGLSRPHSSLRELLATCWDGGLHVDGVAVTLTSCCIPRPKEKSNLIVVQRGHSPPTSSLVQPQSQYQLSQMTFHKIPADSLEWHENLGHGSFTKIYRGCRHEVVDGEARKTEVLLKVMDAKHKNCMESFLEAASLMSQVSYRHLVLLHGVCMAGDSTMVQEFVHLGAIDMYLRKRGHLVPASWKLQVVKQLAYALNYLEDKGLPHGNVSARKVLLAREGADGSPPFIKLSDPGVSPAVLSLEMLTDRIPWVAPECLREAQTLSLEADKWGFGATVWEVFSGVTMPISALDPAKKLQFYEDRQQLPAPKWTELALLIQQCMAYEPVQRPSFRAVIRDLNSLISSDYELLSDPTPGALAPRDGLWNGAQLYACQDPTIFEERHLKYISQLGKGNFGSVELCRYDPLGDNTGALVAVKQLQHSGPDQQRDFQREIQILKALHSDFIVKYRGVSYGPGRQSLRLVMEYLPSGCLRDFLQRHRARLDASRLLLYSSQICKGMEYLGSRRCVHRDLAARNILVESEAHVKIADFGLAKLLPLDKDYYVVREPGQSPIFWYAPESLSDNIFSRQSDVWSFGVVLYELFTYCDKSCSPSAEFLRMMGCERDVPALCRLLELLEEGQRLPAPPACPAEVHELMKLCWAPSPQDRPSFSALGPQLDMLWSGSRGCETHAFTAHPEGKHHSLSFS

SEQ ID NO: 42279 - protein, 1124 aa, Homo sapiens; identical to SEQ ID NO: 42278
  Payload ID: 8597
  Gene Symbol: JAK3
  Gene Name: Janus kinase 3
  Uniprot ID: P52333
  ENSP ID: ENSP00000432511

SEQ ID NO: 42280 - protein, 1094 aa, Homo sapiens
  Payload ID: 8597
  Gene Symbol: JAK3
  Gene Name: Janus kinase 3
  Uniprot ID: P52333
  ENSP ID: ENSP00000436421
MAPPSEETPLIPQRSCSLLSTEAGALHVLLPARGPGPPQRLSFSFGDHLAEDLCVQAAKASGILPVYHSLFALATEDLSCWFPPSHIFSVEDASTQVLLYRIRFYFPNWFGLEKCHRFGLRKDLASAILDLPVLEHLFAQHRSDLVSGRLPVGLSLKEQGECLSLAVLDLARMAREQAQRPGELLKTVSYKACLPPSLRDLIQGLSFVTRRRIRRTVRRALRRVAACQADRHSLMAKYIMDLERLDPAGAAETFHVGLPGALGGHDGLGLLRVAGDGGIAWTQGEQEVLQPFCDFPEIVDISIKQAPRVGPAGEHRLVTVTRTDNQILEAEFPGLPEALSFVALVDGYFRLTTDSQHFFCKEVAPPRLLEEVAEQCHGPITLDFAINKLKTGGSRPGSYVLRRSPQDFDSFLLTVCVQNPLGPDYKGCLIRRSPTGTFLLVGLSRPHSSLRELLATCWDGGLHVDGVAVTLTSCCIPRPKEKSNLIVVQRGHSPPTSSLVQPQSQYQLSQMTFHKIPADSLEWHENLGHGSFTKIYRGCRHEVVDGEARKTEVLLKVMDAKHKNCMESFLEAASLMSQVSYRHLVLLHGVCMAGDSTMVQEFVHLGAIDMYLRKRGHLVPASWKLQVVKQLAYALNYLEDKGLPHGNVSARKVLLAREGADGSPPFIKLSDPGVSPAVLSLEMLTDRIPWVAPECLREAQTLSLEADKWGFGATVWEVFSGVTMPISALDPAKKLQFYEDRQQLPAPKWTELALLIQQCMAYEPVQRPSFRAVIRDLNSLISSDYELLSDPTPGALAPRDGLWNGAQLYACQDPTIFEERHLKYISQLGKGNFGSVELCRYDPLGDNTGALVAVKQLQHSGPDQQRDFQREIQILKALHSDFIVKYRGVSYGPGRQSLRLVMEYLPSGCLRDFLQRHRARLDASRLLLYSSQICKGMEYLGSRRCVHRDLAARNILVESEAHVKIADFGLAKLLPLDKDYYVVREPGQSPIFWYAPESLSDNIFSRQSDVWSFGVVLYELFTYCDKSCSPSAEFLRMMGCERDVPALCRLLELLEEGQRLPAPPACPAEVSAAGLASVSQSVDWAGVSGKPAGA

SEQ ID NO: 42281 - protein, 626 aa, Homo sapiens
  Payload ID: 8598
  Gene Symbol: JAKMIP1
  Gene Name: janus kinase and microtubule interacting protein 1
  Uniprot ID: Q96N16
  ENSP ID: ENSP00000282924
MSKKGRSKGEKPEMETDAVQMANEELRAKLTSIQIEFQQEKSKVGKLRERLQEAKLEREQEQRRHTAYISELKAKLHEEKTKELQALREGLIRQHEQEAARTAKIKEGELQRLQATLNVLRDGAADKVKTALLTEAREEARRAFDGERLRLQQEILELKAARKQAEEALSNCMQADKTKAADLRAAYQAHQDEVHRIKRECERDIRRLMDEIKGKDRVILALEKELGVQAGQTQKLLLQKEALDEQLVQVKEAERHHSSPKRELPPGIGDMVELMGVQDQHMDERDVRRFQLKIAELNSVIRKLEDRNTLLADERNELLKRSRETEVQLKPLVEKNKRMNKKNEDLLQSIQRMEEKIKNLTRENVEMKEKLSAQASLKRHTSLNDLSLTRDEQEIEFLRLQVLEQQHVIDDLSLERERLLRSKRHRGKSLKPPKKHVVETFFGFDEESVDSETLSETSYNTDRTDRTPATPEEDLDDATAREEADLRFCQLTREYQALQRAYALLQEQVGGTLDAEREARTREQLQADLLRCQAKIEDLEKLLVEKGQDSKWVEEKQLLIRTNQDLLEKIYRLEMEENQLKNEMQDAKDQNELLEFRVLELEVRDSICCKLSNGADILFEPKLKFM

SEQ ID NO: 42282 - protein, 831 aa, Homo sapiens
  Payload ID: 8598
  Gene Symbol: JAKMIP1
  Gene Name: janus kinase and microtubule interacting protein 1
  Uniprot ID: Q96N16
  ENSP ID: ENSP00000386711
MSKKGRSKGEKPEMETDAVQMANEELRAKLTSIQIEFQQEKSKVGKLRERLQEAKLEREQEQRRHTAYISELKAKLHEEKTKELQALREGLIRQHEQEAARTAKIKEGELQRLQATLNVLRDGAADKVKTALLTEAREEARRAFDGERLRLQQEILELKAARKQAEEALSNCMQADKTKAADLRAAYQAHQDEVHRIKRECERDIRRLMDEIKGKDRVILALEKELGVQAGQTQKLLLQKEALDEQLVQVKEAERHHSSPKRELPPGIGDMVELMGVQDQHMDERDVRRFQLKIAELNSVIRKLEDRNTLLADERNELLKRSRETEVQLKPLVEKNKRMNKKNEDLLQSIQRMEEKIKNLTRENVEMKEKLSAQASLKRHTSLNDLSLTRDEQEIEFLRLQVLEQQHVIDDLSLERERLLRSKRHRGKSLKPPKKHVVETFFGFDEESVDSETLSETSYNTDRTDRTPATPEEDLDDATAREEADLRFCQLTREYQALQRAYALLQEQVGGTLDAEREARTREQLQADLLRCQAKIEDLEKLLVEKGQDSKWVEEKQLLIRTNQDLLEKIYRLEMEENQLKNEMQDAKDQNELLEFRVLELEERERRSPAFNLQITTFPENHSSALQLFCHQEGVKDVNVSELMKKLDILGDNGNLRNEEQVAIIQAGTVLALCEKWLKQIEGTEAALTQKMLDLEKEKDLFSRQKGYLEEELDYRKQALDQAYLKIQDLEATLYTALQQEPGRRAGEALSEGQREDLQAAVEKVRRQILRQSREFDSQILRERMELLQQAQQRIRELEDKLEFQKRHLKELEEKFLFLFLFFSLAFILWP

SEQ ID NO: 42283 - protein, 461 aa, Homo sapiens
  Payload ID: 8598
  Gene Symbol: JAKMIP1
  Gene Name: janus kinase and microtubule interacting protein 1
  Uniprot ID: Q96N16
  ENSP ID: ENSP00000386745
MSKKGRSKGEKPEMETDAVQMANEELRAKLTSIQIEFQQEKSKMDEIKGKDRVILALEKELGVQAGQTQKLLLQKEALDEQLVQVKEAERHHSSPKRELPPGIGDMVELMGVQDQHMDERDVRRFQLKIAELNSVIRKLEDRNTLLADERNELLKRSRETEVQLKPLVEKNKRMNKKNEDLLQSIQRMEEKIKNLTRENVEMKEKLSAQASLKRHTSLNDLSLTRDEQEIEFLRLQVLEQQHVIDDLSLERERLLRSKRHRGKSLKPPKKHVVETFFGFDEESVDSETLSETSYNTDRTDRTPATPEEDLDDATAREEADLRFCQLTREYQALQRAYALLQEQVGGTLDAEREARTREQLQADLLRCQAKIEDLEKLLVEKGQDSKWVEEKQLLIRTNQDLLEKIYRLEMEENQLKNEMQDAKDQNELLEFRVLELEVRDSICCKLSNGADILFEPKLKFM

SEQ ID NO: 42284 - protein, 626 aa, Homo sapiens; identical to SEQ ID NO: 42281
  Payload ID: 8598
  Gene Symbol: JAKMIP1
  Gene Name: janus kinase and microtubule interacting protein 1
  Uniprot ID: Q96N16
  ENSP ID: ENSP00000386925

SEQ ID NO: 42285 - protein, 646 aa, Homo sapiens
  Payload ID: 8598
  Gene Symbol: JAKMIP1
  Gene Name: janus kinase and microtubule interacting protein 1
  Uniprot ID: Q96N16
  ENSP ID: ENSP00000387042
MSKKGRSKGEKPEMETDAVQMANEELRAKLTSIQIEFQQEKSKMDEIKGKDRVILALEKELGVQAGQTQKLLLQKEALDEQLVQVKEAERHHSSPKRELPPGIGDMVELMGVQDQHMDERDVRRFQLKIAELNSVIRKLEDRNTLLADERNELLKRSRETEVQLKPLVEKNKRMNKKNEDLLQSIQRMEEKIKNLTRENVEMKEKLSAQASLKRHTSLNDLSLTRDEQEIEFLRLQVLEQQHVIDDLSLKHVVETFFGFDEESVDSETLSETSYNTDRTDRTPATPEEDLDDATAREEADLRFCQLTREYQALQRAYALLQEQVGGTLDAEREARTREQLQADLLRCQAKIEDLEKLLVEKGQDSKWVEEKQLLIRTNQDLLEKIYRLEMEENQLKNEMQDAKDQNELLEFRVLELEERERRSPAFNLQITTFPENHSSALQLFCHQEGVKDVNVSELMKKLDILGDNGNLRNEEQVAIIQAGTVLALCEKWLKQIEGTEAALTQKMLDLEKEKDLFSRQKGYLEEELDYRKQALDQAYLKIQDLEATLYTALQQEPGRRAGEALSEGQREDLQAAVEKVRRQILRQSREFDSQILRERMELLQQAQQRIRELEDKLEFQKRHLKELEEKFLFLFLFFSLAFILWP

SEQ ID NO: 42286 - protein, 569 aa, Homo sapiens
  Payload ID: 8598
  Gene Symbol: JAKMIP1
  Gene Name: janus kinase and microtubule interacting protein 1
  ENSP ID: ENSP00000422004
MSKKGRSKGEKPEMETDAVQMANEELRAKLTSIQIEFQQEKSKVGKLRERLQEAKLEREQEQRRHTAYISELKAKLHEEKTKELQALREGLIRQHEQEAARTAKIKEGELQRLQATLNVLRDGAADKVKTALLTEAREEARRAFDGERLRLQQEILELKAARKQAEEALSNCMQADKTKAADLRAAYQAHQDEVHRIKRECERDIRRLMDEIKGKDRVILALEKELGVQAGQTQKLLLQKEALDEQLVQVKEAERHHSSPKRELPPGIGDMVELMGVQDQHMDERDVRRFQLKIAELNSVIRKLEDRNTLLADERNELLKRSRETEVQLKPLVEKNKRMNKKNEDLLQSIQRMEEKIKNLTRENVEMKEKLSAQASLKRHTSLNDLSLTRDEQEIEFLRLQVLEQQHVIDDLSLERERLLRSKRHRGKSLKPPKKHVVETFFGFDEESVDSETLSETSYNTDRTDRTPATPEEDLDDATAREEADLRFCQLTREYQALQRAYALLQEQVGGTLDAEREARTREQLQADLLRCQAKIEDLEKLLVEKGQDSKWVEEKQLLIRTNQDLLEK

SEQ ID NO: 42287 - protein, 810 aa, Homo sapiens
  Payload ID: 8599
  Gene Symbol: JAKMIP2
  Gene Name: janus kinase and microtubule interacting protein 2
  Uniprot ID: Q96AA8
  ENSP ID: ENSP00000265272
MSKKGRNKGEKPEALIVALQAANEDLRTKLTDIQIELHQEKSKVSKLEREKTQEAKRIRELEQRKHTVLVTELKAKLHEEKMKELQAVRENLIKQHEQEMSRTVKVRDGEIQRLKSALCALRDGSSDKVRTALTIEAREEARKLFDTERLKLLQEIADLKTAKKQVDEALSNMIQADKIKAGDLRSEHQSHQEAISKIKWESERDIRRLMDEIKAKDRIIFSLEKELETQTGYVQKLQLQKEALDEQLFLVKEAECNMSSPKREIPGRAGDGSEHCSSPDLRRNQKRIAELNATIRKLEDRNTLLGDERNELLKRVRETEKQCKPLLERNKCLAKRNDELMVSLQRMEEKLKAVTKENSEMREKITSHPPLKKLKSLNDLDQANEEQETEFLKLQVIEQQNIIDELTRDREKLIRRRKHRRSSKPIKRPVLDPFIGYDEDSMDSETSSMASFRTDRTPATPDDDLDESLAAEESELRFRQLTKEYQALQRAYALLQEQTGGIIDAEREAKAQEQLQAEVLRYKAKIEDLEATLAQKGQDSHWVEDKQLFIKRNQELLEKIEKQEAENHRLQQELQDARDQNELLEFRNLELEERERRSPPFNLQIHPFSDGVSALQIYCMKEGVKDVNIPDLIKQLDILGDNGNLRNEEQVAIIQASTVLSLAEKWIQQIEGAEAALHQKMMELESDMEQFCKIKGYLEEELDYRKQALDQAYMRIQELEATLYNALQQETVIKFGELLSEKQQEELRTAVEKLRRQMLRKSREYDCQILQERMELLQQAHQRIRDLEDKTDIQKRQIKDLEEKSNRKHG

SEQ ID NO: 42288 - protein, 778 aa, Homo sapiens
  Payload ID: 8599
  Gene Symbol: JAKMIP2
  Gene Name: janus kinase and microtubule interacting protein 2
  Uniprot ID: Q96AA8
  ENSP ID: ENSP00000328989
MVSKLEREKTQEAKRIRELEQRKHTVLVTELKAKLHEEKMKELQAVRENLIKQHEQEMSRTVKVRDGEIQRLKSALCALRDGSSDKVRTALTIEAREEARKLFDTERLKLLQEIADLKTAKKQVDEALSNMIQADKIKAGDLRSEHQSHQEAISKIKWESERDIRRLMDEIKAKDRIIFSLEKELETQTGYVQKLQLQKEALDEQLFLVKEAECNMSSPKREIPGRAGDGSEHCSSPDLRRNQKRIAELNATIRKLEDRNTLLGDERNELLKRVRETEKQCKPLLERNKCLAKRNDELMVSLQRMEEKLKAVTKENSEMREKITSHPPLKKLKSLNDLDQANEEQETEFLKLQVIEQQNIIDELTRDREKLIRRRKHRRSSKPIKRPVLDPFIGYDEDSMDSETSSMASFRTDRTPATPDDDLDESLAAEESELRFRQLTKEYQALQRAYALLQEQTGGIIDAEREAKAQEQLQAEVLRYKAKIEDLEATLAQKGQDSHWVEDKQLFIKRNQELLEKIEKQEAENHRLQQELQDARDQNELLEFRNLELEERERRSPPFNLQIHPFSDGVSALQIYCMKEGVKDVNIPDLIKQLDILGDNGNLRNEEQVAIIQASTVLSLAEKWIQQIEGAEAALHQKMMELESDMEQFCKIKGYLEEELDYRKQALDQAYMRIQELEATLYNALQQETVIKFGELLSEKQQEELRTAVEKLRRQMLRKSREYDCQILQERMELLQQAHQRIRDLEDKTDIQKRQIKDLEEKFLFLFLFFSLAFILWP

SEQ ID NO: 42289 - protein, 799 aa, Homo sapiens
  Payload ID: 8599
  Gene Symbol: JAKMIP2
  Gene Name: janus kinase and microtubule interacting protein 2
  Uniprot ID: Q96AA8
  ENSP ID: ENSP00000421398
MSKKGRNKGEKPEALIVALQAANEDLRTKLTDIQIELHQEKSKVSKLEREKTQEAKRIRELEQRKHTVLVTELKAKLHEEKMKELQAVRENLIKQHEQEMSRTVKVRDGEIQRLKSALCALRDGSSDKVRTALTIEAREEARKLFDTERLKLLQEIADLKTAKKQVDEALSNMIQADKIKAGDLRSEHQSHQEAISKIKWESERDIRRLMDEIKAKDRIIFSLEKELETQTGYVQKLQLQKEALDEQLFLVKEAECNMSSPKREIPGRAGDGSEHCSSPDLRRNQKRIAELNATIRKLEDRNTLLGDERNELLKRVRETEKQCKPLLERNKCLAKRNDELMVSLQRMEEKLKAVTKENSEMREKITSHPPLKKLKSLNDLDQANEEQETEFLKLQVIEQQNIIDELTRDREKLIRRRKHRRSSKPIKRPVLDPFIGYDEDSMDSETSSMASFRTDRTPATPDDDLDESLAAEESELRFRQLTKEYQALQRAYALLQEQTGGIIDAEREAKAQEQLQAEVLRYKAKIEDLEATLAQKGQIEKQEAENHRLQQELQDARDQNELLEFRNLELEERERRSPPFNLQIHPFSDGVSALQIYCMKEGVKDVNIPDLIKQLDILGDNGNLRNEEQVAIIQASTVLSLAEKWIQQIEGAEAALHQKMMELESDMEQFCKIKGYLEEELDYRKQALDQAYMRIQELEATLYNALQQETVIKFGELLSEKQQEELRTAVEKLRRQMLRKSREYDCQILQERMELLQQAHQRIRDLEDKTDIQKRQIKDLEEKFLFLFLFFSLAFILWP

SEQ ID NO: 42290 - protein, 820 aa, Homo sapiens
  Payload ID: 8599
  Gene Symbol: JAKMIP2
  Gene Name: janus kinase and microtubule interacting protein 2
  Uniprot ID: Q96AA8
  ENSP ID: ENSP00000479248
MSKKGRNKGEKPEALIVALQAANEDLRTKLTDIQIELHQEKSKVSKLEREKTQEAKRIRELEQRKHTVLVTELKAKLHEEKMKELQAVRENLIKQHEQEMSRTVKVRDGEIQRLKSALCALRDGSSDKVRTALTIEAREEARKLFDTERLKLLQEIADLKTAKKQVDEALSNMIQADKIKAGDLRSEHQSHQEAISKIKWESERDIRRLMDEIKAKDRIIFSLEKELETQTGYVQKLQLQKEALDEQLFLVKEAECNMSSPKREIPGRAGDGSEHCSSPDLRRNQKRIAELNATIRKLEDRNTLLGDERNELLKRVRETEKQCKPLLERNKCLAKRNDELMVSLQRMEEKLKAVTKENSEMREKITSHPPLKKLKSLNDLDQANEEQETEFLKLQVIEQQNIIDELTRDREKLIRRRKHRRSSKPIKRPVLDPFIGYDEDSMDSETSSMASFRTDRTPATPDDDLDESLAAEESELRFRQLTKEYQALQRAYALLQEQTGGIIDAEREAKAQEQLQAEVLRYKAKIEDLEATLAQKGQDSHWVEDKQLFIKRNQELLEKIEKQEAENHRLQQELQDARDQNELLEFRNLELEERERRSPPFNLQIHPFSDGVSALQIYCMKEGVKDVNIPDLIKQLDILGDNGNLRNEEQVAIIQASTVLSLAEKWIQQIEGAEAALHQKMMELESDMEQFCKIKGYLEEELDYRKQALDQAYMRIQELEATLYNALQQETVIKFGELLSEKQQEELRTAVEKLRRQMLRKSREYDCQILQERMELLQQAHQRIRDLEDKTDIQKRQIKDLEEKFLFLFLFFSLAFILWP

SEQ ID NO: 42291 - protein, 844 aa, Homo sapiens
  Payload ID: 8600
  Gene Symbol: JAKMIP3
  Gene Name: Janus kinase and microtubule interacting protein 3
  Uniprot ID: Q5VZ66
  ENSP ID: ENSP00000298622
MSKRGMSSRAKGDKAEALAALQAANEDLRAKLTDIQIELQQEKSKVSKVEREKNQELRQVREHEQHKTAVLLTELKTKLHEEKMKELQAVRETLLRQHEAELLRVIKIKDNENQRLQALLSALRDGGPEKVKTVLLSEAKEEAKKGFEVEKVKMQQEISELKGAKRQVEEALTLVIQADKIKAAEIRSVYHLHQEEITRIKKECEREIRRLMEEIKFKDRAVFVLERELGVQAGHAQRLQLQKEALDEQLSQVREADRHPGSPRRELPHAAGAGDASDHSGSPEQQLDEKDARRFQLKIAELSAIIRKLEDRNALLSEERNELLKRVREAESQYKPLLDKNKRLSRKNEDLSHALRRMENKLKFVTQENIEMRQRAGIIRRPSSLNDLDQSQDEREVDFLKLQIVEQQNLIDELSKTLETAGYVKSVLERDKLLRFRKQRKKMAKLPKPVVVETFFGYDEEASLESDGSSVSYQTDRTDQTPCTPDDDLEEGMAKEETELRFRQLTMEYQALQRAYALLQEQVGGTLDAEREVKTREQLQAEVQRAQARIEDLEKALAEQGQDMKWIEEKQALYRRNQELVEKIKQMETEEARLRHEVQDARDQNELLEFRILELEERERKSPAISFHHTPFVDGKSPLQVYCEAEGVTDIVVAELMKKLDILGDNANLTNEEQVVVIQARTVLTLAEKWLQQIEETEAALQRKMVDLESEKELFSKQKGYLDEELDYRKQALDQANKHILELEAMLYDALQQEAGAKVAELLSEEEREKLKVAVEQWKRQVMSELRERDAQILRERMELLQLAQQRIKELEERIEAQKRQIKELEEKFLFLFLFFSLAFILWS

SEQ ID NO: 42292 - protein, 243 aa, Homo sapiens
  Payload ID: 8601
  Gene Symbol: JAZF1
  Gene Name: JAZF zinc finger 1
  Uniprot ID: Q86VZ6
  ENSP ID: ENSP00000283928
MTGIAAASFFSNTCRFGGCGLHFPTLADLIEHIEDNHIDTDPRVLEKQELQQPTYVALSYINRFMTDAARREQESLKKKIQPKLSLTLSSSVSRGNVSTPPRHSSGSLTPPVTPPITPSSSFRSSTPTGSEYDEEEVDYEESDSDESWTTESAISSEAILSSMCMNGGEEKPFACPVPGCKKRYKNVNGIKYHAKNGHRTQIRVRKPFKCRCGKSYKTAQGLRHHTINFHPPVSAEIIRKMQQ

SEQ ID NO: 42293 - protein, 173 aa, Homo sapiens
  Payload ID: 8601
  Gene Symbol: JAZF1
  Gene Name: JAZF zinc finger 1
  ENSP ID: ENSP00000387976
MWVANDTDPRVLEKQELQQPTYVALSYINRFMTDAARREQESLKKKIQPKLSLTLSSSVSRGNVSTPPRHSSGSLTPPVTPPITPSSSFRSSTPTGSEYDEEEVDYEESDSDESWTTESAISSEAILSSMCMNGGEEKPFACPVPGCKKRYKNVNGIKYHAKNGHRTQIRVRK

SEQ ID NO: 42294 - protein, 230 aa, Homo sapiens
  Payload ID: 8601
  Gene Symbol: JAZF1
  Gene Name: JAZF zinc finger 1
  ENSP ID: ENSP00000388302
  MOD_RES (1)..(1): Any amino acid
XYFVLGSLIYSDAKSKKNRNCVFITDTDPRVLEKQELQQPTYVALSYINRFMTDAARREQESLKKKIQPKLSLTLSSSVSRGNVSTPPRHSSGSLTPPVTPPITPSSSFRSSTPTGSEYDEEEVDYEESDSDESWTTESAISSEAILSSMCMNGGEEKPFACPVPGCKKRYKNVNGIKYHAKNGHRTQIRVRKPFKCRCGKSYKTAQGLRHHTINFHPPVSAEIIRKMQQ

SEQ ID NO: 42295 - protein, 66 aa, Homo sapiens
  Payload ID: 8601
  Gene Symbol: JAZF1
  Gene Name: JAZF zinc finger 1
  ENSP ID: ENSP00000399083
MTGIAAASFFSNTCRFGGCGLHFPTLADLIEHIEDNHIDTDPRVLEKQELQQPTYVALSYINRQRR

SEQ ID NO: 42296 - protein, 181 aa, Homo sapiens
  Payload ID: 8601
  Gene Symbol: JAZF1
  Gene Name: JAZF zinc finger 1
  ENSP ID: ENSP00000415096
MDILSLLMFGIPLKNTDPRVLEKQELQQPTYVALSYINRFMTDAARREQESLKKKIQPKLSLTLSSSVSRGNVSTPPRHSSGSLTPPVTPPITPSSSFRSSTPTGSEYDEEEVDYEESDSDESWTTESAISSEAILSSMCMNGGEEKPFACPVPGCKKRYKNVNGIKYHAKNGHRTQIRVR

SEQ ID NO: 42297 - protein, 80 aa, Homo sapiens
  Payload ID: 8601
  Gene Symbol: JAZF1
  Gene Name: JAZF zinc finger 1
  ENSP ID: ENSP00000415984
MTGIAAASFFSNTCRFGGCGLHFPTLADLIEHIEDNHIDTDPRVLEKQELQQPTYVALSYINRDIGHQMESRLNRSTVAS

SEQ ID NO: 42298 - protein, 893 aa, Homo sapiens
  Payload ID: 8602
  Gene Symbol: JMJD7-PLA2G4B
  Gene Name: JMJD7-PLA2G4B readthrough
  ENSP ID: ENSP00000342785
MAEAALEAVRSELREFPAAARELCVPLAVPYLDKPPTPLHFYRDWVCPNRPCIIRNALQHWPALQKWSLPYFRATVGSTEVSVAVTPDGYADAVRGDRFMMPAERRLPLSFVLDVLEGRAQHPGVLYVQKQCSNLPSELPQLLPDLESHVPWASEALGKMPDAVNFWLGEAAAVTSLHKDHYENLYCVVSGEKHFLFHPPSDRPFIPYELYTPATYQLTEEGTFKVVDEEAMEKAEVSRTCLLTVRVLQAHRLPSKDLVTPSDCYVTLWLPTACSHRLQTRTVKNSSSPVWNQSFHFRIHRQLKNVMELKVFDQDLVTGDDPVLSVLFDAGTLRAGEFRRESFSLSPQGEGRLEVEFRLQSLADRGEWLVSNGVLVARELSCLHVQLEETGDQKSSEHRVQLVVPGSCEGPQEASVGTGTFRFHCPACWEQELSIRLQDAPEEQLKAPLSALPSGQVVRLVFPTSQEPLMRVELKKEAGLRELAVRLGFGPCAEEQAFLSRRKQVVAAALRQALQLDGDLQEDEIPVVAIMATGGGIRAMTSLYGQLAGLKELGLLDCVSYITGASGSTWALANLYEDPEWSQKDLAGPTELLKTQVTKNKLGVLAPSQLQRYRQELAERARLGYPSCFTNLWALINEALLHDEPHDHKLSDQREALSHGQNPLPIYCALNTKGQSLTTFEFGEWCEFSPYEVGFPKYGAFIPSELFGSEFFMGQLMKRLPESRICFLEGIWSNLYAANLQDSLYWASEPSQFWDRWVRNQANLDKEQVPLLKIEEPPSTAGRIAEFFTDLLTWRPLAQATHNFLRGLHFHKDYFQHPHFSTWKATTLDGLPNQLTPSEPHLCLLDVGYLINTSCLPLLQPTRDVDLILSLDYNLHGAFQGSGGHPRRRQLGR

SEQ ID NO: 42299 - protein, 1012 aa, Homo sapiens
  Payload ID: 8602
  Gene Symbol: JMJD7-PLA2G4B
  Gene Name: JMJD7-PLA2G4B readthrough
  ENSP ID: ENSP00000371886
MAEAALEAVRSELREFPAAARELCVPLAVPYLDKPPTPLHFYRDWVCPNRPCIIRNALQHWPALQKWSLPYFRATVGSTEVSVAVTPDGYADAVRGDRFMMPAERRLPLSFVLDVLEGRAQHPGVLYVQKQCSNLPSELPQLLPDLESHVPWASEALGKMPDAVNFWLGEAAAVTSLHKDHYENLYCVVSGEKHFLFHPPSDRPFIPYELYTPATYQLTEEGTFKVVDEEAMEKAEVSRTCLLTVRVLQAHRLPSKDLVTPSDCYVTLWLPTACSHRLQTRTVKNSSSPVWNQSFHFRIHRQLKNVMELKVFDQDLVTGDDPVLSVLFDAGTLRAGEFRRESFSLSPQGEGRLEVEFRLQSLADRGEWLVSNGVLVARELSCLHVQLEETGDQKSSEHRVQLVVPGSCEGPQEASVGTGTFRFHCPACWEQELSIRLQDAPEEQLKAPLSALPSGQVVRLVFPTSQEPLMRVELKKEAGLRELAVRLGFGPCAEEQAFLSRRKQVVAAALRQALQLDGDLQEDEIPVVAIMATGGGIRAMTSLYGQLAGLKELGLLDCVSYITGASGSTWALANLYEDPEWSQKDLAGPTELLKTQVTKNKLGVLAPSQLQRYRQELAERARLGYPSCFTNLWALINEALLHDEPHDHKLSDQREALSHGQNPLPIYCALNTKGQSLTTFEFGEWCEFSPYEVGFPKYGAFIPSELFGSEFFMGQLMKRLPESRICFLEGIWSNLYAANLQDSLYWASEPSQFWDRWVRNQANLDKEQVPLLKIEEPPSTAGRIAEFFTDLLTWRPLAQATHNFLRGLHFHKDYFQHPHFSTWKATTLDGLPNQLTPSEPHLCLLDVGYLINTSCLPLLQPTRDVDLILSLDYNLHGAFQQLQLLGRFCQEQGIPFPPISPSPEEQLQPRECHTFSDPTCPGAPAVLHFPLVSDSFREYSAPGVRRTPEEAAAGEVNLSSSDSPYHYTKVTYSQEDVDKLLHLTHYNVCNNQEQLLEALRQAVQRRRQRRPH

SEQ ID NO: 42300 - protein, 781 aa, Homo sapiens
  Payload ID: 8602
  Gene Symbol: JMJD7-PLA2G4B
  Gene Name: JMJD7-PLA2G4B readthrough
  Uniprot ID: P0C869
  ENSP ID: ENSP00000416610
MAVAEVSRTCLLTVRVLQAHRLPSKDLVTPSDCYVTLWLPTACSHRLQTRTVKNSSSPVWNQSFHFRIHRQLKNVMELKVFDQDLVTGDDPVLSVLFDAGTLRAGEFRRESFSLSPQGEGRLEVEFRLQSLADRGEWLVSNGVLVARELSCLHVQLEETGDQKSSEHRVQLVVPGSCEGPQEASVGTGTFRFHCPACWEQELSIRLQDAPEEQLKAPLSALPSGQVVRLVFPTSQEPLMRVELKKEAGLRELAVRLGFGPCAEEQAFLSRRKQVVAAALRQALQLDGDLQEDEIPVVAIMATGGGIRAMTSLYGQLAGLKELGLLDCVSYITGASGSTWALANLYEDPEWSQKDLAGPTELLKTQVTKNKLGVLAPSQLQRYRQELAERARLGYPSCFTNLWALINEALLHDEPHDHKLSDQREALSHGQNPLPIYCALNTKGQSLTTFEFGEWCEFSPYEVGFPKYGAFIPSELFGSEFFMGQLMKRLPESRICFLEGIWSNLYAANLQDSLYWASEPSQFWDRWVRNQANLDKEQVPLLKIEEPPSTAGRIAEFFTDLLTWRPLAQATHNFLRGLHFHKDYFQHPHFSTWKATTLDGLPNQLTPSEPHLCLLDVGYLINTSCLPLLQPTRDVDLILSLDYNLHGAFQQLQLLGRFCQEQGIPFPPISPSPEEQLQPRECHTFSDPTCPGAPAVLHFPLVSDSFREYSAPGVRRTPEEAAAGEVNLSSSDSPYHYTKVTYSQEDVDKLLHLTHYNVCNNQEQLLEALRQAVQRRRQRRPH

SEQ ID NO: 42301 - protein, 81 aa, Homo sapiens
  Payload ID: 8602
  Gene Symbol: JMJD7-PLA2G4B
  Gene Name: JMJD7-PLA2G4B readthrough
  ENSP ID: ENSP00000424127
  MOD_RES (1)..(1): Any amino acid
XWIPLDPLAPDLARYPSYSQAQALRCTVRAGEMLYLPALWFHHVQQSQGCIAVNFWYDMEYDLKYSYFQLLDSLTKASGLD

SEQ ID NO: 42302 - protein, 311 aa, Homo sapiens
  Payload ID: 8603
  Gene Symbol: JKAMP
  Gene Name: JNK1/MAPK8-associated membrane protein
  Uniprot ID: Q9P055
  ENSP ID: ENSP00000261247
MAVDIQPACLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLLYYAFPYIILVLSLVTLAVYMSASEIENCYDLLVRKKRLIVLFSHWLLHAYGIISISRVDKLEQDLPLLALVPTPALFYLFTAKFTEPSRILSEGANGH

SEQ ID NO: 42303 - protein, 319 aa, Homo sapiens
  Payload ID: 8603
  Gene Symbol: JKAMP
  Gene Name: JNK1/MAPK8-associated membrane protein
  Uniprot ID: Q9P055
  ENSP ID: ENSP00000348351
MKGEIQQSLGAWVLLTCLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLLYYAFPYIILVLSLVTLAVYMSASEIENCYDLLVRKKRLIVLFSHWLLHAYGIISISRVDKLEQDLPLLALVPTPALFYLFTAKFTEPSRILSEGANGH

SEQ ID NO: 42304 - protein, 305 aa, Homo sapiens
  Payload ID: 8603
  Gene Symbol: JKAMP
  Gene Name: JNK1/MAPK8-associated membrane protein
  Uniprot ID: Q9P055
  ENSP ID: ENSP00000389699
MACLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLLYYAFPYIILVLSLVTLAVYMSASEIENCYDLLVRKKRLIVLFSHWLLHAYGIISISRVDKLEQDLPLLALVPTPALFYLFTAKFTEPSRILSEGANGH

SEQ ID NO: 42305 - protein, 325 aa, Homo sapiens
  Payload ID: 8603
  Gene Symbol: JKAMP
  Gene Name: JNK1/MAPK8-associated membrane protein
  ENSP ID: ENSP00000450749
MKGEIQQSLGAWVLLTVDIQPACLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLLYYAFPYIILVLSLVTLAVYMSASEIENCYDLLVRKKRLIVLFSHWLLHAYGIISISRVDKLEQDLPLLALVPTPALFYLFTAKFTEPSRILSEGANGH

SEQ ID NO: 42306 - protein, 247 aa, Homo sapiens
  Payload ID: 8603
  Gene Symbol: JKAMP
  Gene Name: JNK1/MAPK8-associated membrane protein
  ENSP ID: ENSP00000450813
MKGEIQQSLGAWVLLTCLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLLYYAFPYIILVLSLVTLAVYMSASEIE

SEQ ID NO: 42307 - protein, 153 aa, Homo sapiens
  Payload ID: 8603
  Gene Symbol: JKAMP
  Gene Name: JNK1/MAPK8-associated membrane protein
  ENSP ID: ENSP00000451076
MAVDIQPACLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPL

SEQ ID NO: 42308 - protein, 140 aa, Homo sapiens
  Payload ID: 8603
  Gene Symbol: JKAMP
  Gene Name: JNK1/MAPK8-associated membrane protein
  ENSP ID: ENSP00000451723
MAVDIQPACLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLIYHCIYLLRILLGINDAAPTSSGEEDCMWVREI

SEQ ID NO: 42309 - protein, 213 aa, Homo sapiens
  Payload ID: 8603
  Gene Symbol: JKAMP
  Gene Name: JNK1/MAPK8-associated membrane protein
  ENSP ID: ENSP00000479775
MAVDIQPACLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLL

SEQ ID NO: 42310 - protein, 159 aa, Homo sapiens
  Payload ID: 8604
  Gene Symbol: JCHAIN
  Gene Name: joining chain of multimeric IgA and IgM
  Uniprot ID: P01591
  ENSP ID: ENSP00000254801
MKNHLLFWGVLAVFIKAVHVKAQEDERIVLVDNKCKCARITSRIIRSSEDPNEDIVERNIRIIVPLNNRENISDPTSPLRTRFVYHLSDLCKKCDPTEVELDNQIVTATQSNICDEDSATETCYTYDRNKCYTAVVPLVYGGETKMVETALTPDACYPD

SEQ ID NO: 42311 - protein, 70 aa, Homo sapiens
  Payload ID: 8604
  Gene Symbol: JCHAIN
  Gene Name: joining chain of multimeric IgA and IgM
  ENSP ID: ENSP00000417560
MKNHLLFWGVLAVFIKAVHVKAQEDERIVLVDNKCKCARITSRIIRSSEDPNEDIVERNIRIIVPLNNRE

SEQ ID NO: 42312 - protein, 157 aa, Homo sapiens
  Payload ID: 8604
  Gene Symbol: JCHAIN
  Gene Name: joining chain of multimeric IgA and IgM
  ENSP ID: ENSP00000426045
MKNHLLFWGVLAVFIKAVHVKGSRDSSASASRVAGITAQEDERIVLVDNKCKCARITSRIIRSSEDPNEDIVERNIRIIVPLNNRENISDPTSPLRTRFVYHLSDLCKKCDPTEVELDNQIVTATQSNICDEDSATETCYTYDRNKCYTAVVPLVYG

SEQ ID NO: 42313 - protein, 159 aa, Homo sapiens; identical to SEQ ID NO: 42310
  Payload ID: 8604
  Gene Symbol: JCHAIN
  Gene Name: joining chain of multimeric IgA and IgM
  Uniprot ID: P01591
  ENSP ID: ENSP00000426687

SEQ ID NO: 42314 - protein, 157 aa, Homo sapiens
  Payload ID: 8604
  Gene Symbol: JCHAIN
  Gene Name: joining chain of multimeric IgA and IgM
  ENSP ID: ENSP00000427112
MKNHLLFWGVLAVFIKAVHVKENGIHSEFRAQEDERIVLVDNKCKCARITSRIIRSSEDPNEDIVERNIRIIVPLNNRENISDPTSPLRTRFVYHLSDLCKKCDPTEVELDNQIVTATQSNICDEDSATETCYTYDRNKCYTAVVPLVYGGETKMVE

SEQ ID NO: 42315 - protein, 159 aa, Homo sapiens; identical to SEQ ID NO: 42310
  Payload ID: 8604
  Gene Symbol: JCHAIN
  Gene Name: joining chain of multimeric IgA and IgM
  Uniprot ID: P01591
  ENSP ID: ENSP00000440066

SEQ ID NO: 42316 - protein, 202 aa, Homo sapiens
  Payload ID: 8605
  Gene Symbol: JOSD1
  Gene Name: Josephin domain containing 1
  Uniprot ID: Q15040
  ENSP ID: ENSP00000216039
MSCVPWKGDKAKSESLELPQAAPPQIYHEKQRRELCALHALNNVFQDSNAFTRDTLQEIFQRLSPNTMVTPHKKSMLGNGNYDVNVIMAALQTKGYEAVWWDKRRDVGVIALTNVMGFIMNLPSSLCWGPLKLPLKRQHWICVREVGGAYYNLDSKLKMPEWIGGESELRKFLKHHLRGKNCELLLVVPEEVEAHQSWRTDV

SEQ ID NO: 42317 - protein, 62 aa, Homo sapiens
  Payload ID: 8605
  Gene Symbol: JOSD1
  Gene Name: Josephin domain containing 1
  ENSP ID: ENSP00000393131
MSCVPWKGDKAKSESLELPQAAPPQIYHEKQRRELCALHALNNVFQDSNAFTRDTLQEIFQR

SEQ ID NO: 42318 - protein, 61 aa, Homo sapiens
  Payload ID: 8605
  Gene Symbol: JOSD1
  Gene Name: Josephin domain containing 1
  ENSP ID: ENSP00000405182
MSCVPWKGDKAKSESLELPQAAPPQIYHEKQRRELCALHALNNVFQDSNAFTRDTLQEIFQ

SEQ ID NO: 42319 - protein, 123 aa, Homo sapiens
  Payload ID: 8605
  Gene Symbol: JOSD1
  Gene Name: Josephin domain containing 1
  ENSP ID: ENSP00000410010
MSCVPWKGDKAKSESLELPQAAPPQIYHEKQRRELCALHALNNVFQDSNAFTRDTLQEIFQRLSPNTMVTPHKKSMLGNGNYDVNVIMAALQTKGYEAVWWDKRRDVGVIALTNVMGFIMNLP

SEQ ID NO: 42320 - protein, 104 aa, Homo sapiens
  Payload ID: 8605
  Gene Symbol: JOSD1
  Gene Name: Josephin domain containing 1
  ENSP ID: ENSP00000415189
MSCVPWKGDKAKSESLELPQAAPPQIYHEKQRRELCALHALNNVFQDSNAFTRDTLQEIFQRLSPNTMVTPHKKSMLGNGNYDVNVIMAALQTKGYEAVWWDKR

SEQ ID NO: 42321 - protein, 154 aa, Homo sapiens
  Payload ID: 8605
  Gene Symbol: JOSD1
  Gene Name: Josephin domain containing 1
  ENSP ID: ENSP00000444798
  MOD_RES (1)..(1): Any amino acid
XKGDKAKSESLELPQAAPPQIYHEKQRRELCALHALNNVFQDSNAFTRDTLQEIFQRDVGVIALTNVMGFIMNLPSSLCWGPLKLPLKRQHWICVREVGGAYYNLDSKLKMPEWIGGESELRKFLKHHLRGKNCELLLVVPEEVEAHQSWRTDV

SEQ ID NO: 42322 - protein, 146 aa, Homo sapiens
  Payload ID: 8606
  Gene Symbol: JOSD2
  Gene Name: Josephin domain containing 2
  Uniprot ID: Q8TAC2
  ENSP ID: ENSP00000468860
MSQAPGAQPSPPTVYHERQRLELCAVHALNNVLQQQLFSQEAADEICKRPLSQLALPQVLGLILNLPSPVSLGLLSLPLRRRHWVALRQVDGVYYNLDSKLRAPEALGDEDGVRAFLAAALAQGLCEVLLVVTKEVEEKGSWLRTD

SEQ ID NO: 42323 - protein, 188 aa, Homo sapiens
  Payload ID: 8606
  Gene Symbol: JOSD2
  Gene Name: Josephin domain containing 2
  Uniprot ID: Q8TAC2
  ENSP ID: ENSP00000468956
MSQAPGAQPSPPTVYHERQRLELCAVHALNNVLQQQLFSQEAADEICKRLAPDSRLNPHRSLLGTGNYDVNVIMAALQGLGLAAVWWDRRRPLSQLALPQVLGLILNLPSPVSLGLLSLPLRRRHWVALRQVDGVYYNLDSKLRAPEALGDEDGVRAFLAAALAQGLCEVLLVVTKEVEEKGSWLRTD

SEQ ID NO: 42324 - protein, 161 aa, Homo sapiens
  Payload ID: 8606
  Gene Symbol: JOSD2
  Gene Name: Josephin domain containing 2
  ENSP ID: ENSP00000470628
MSQAPGAQPSPPTVYHERQRLELCAVHALNNVLQQQLFSQEAADEICKRLAPDSRLNPHRSLLGTGNYDVNVIMAALQGLGLAAVWWDRRRPLSQLALPQVLGLILNLPSPVSLGLLSLPLRRRHWVALRQVDGVYYNLDSKLRAPEALGDEDGVRAFLAA

SEQ ID NO: 42325 - protein, 188 aa, Homo sapiens; identical to SEQ ID NO: 42323
  Payload ID: 8606
  Gene Symbol: JOSD2
  Gene Name: Josephin domain containing 2
  Uniprot ID: Q8TAC2
  ENSP ID: ENSP00000472116

SEQ ID NO: 42326 - protein, 556 aa, Homo sapiens
  Payload ID: 8607
  Gene Symbol: JRK
  Gene Name: Jrk helix-turn-helix protein
  ENSP ID: ENSP00000461610
MASKPAAGKSRGEKRKRVVLTLKEKIDICTRLEKGESRKALMQEYNVGMSTLYDIRAHKAQLLRFFASSDSNKALEQRRTLHTPKLEHLDRVLYEWFLGKRSEGVPVSGPMLIEKAKDFYEQMQLTEPCVFSGGWLWRFKARHGIKKLDASSEKQSADHQAAEQFCAFFRSLAAEHGLSAEQVYNADETGLFWRCLPNPTPEGGAVPGPKQGKDRLTVLMCANATGSHRLKPLAIGKCSGPRAFKGIQHLPVAYKAQGNAWVDKEIFSDWFHHIFVPSVREHFRTIGLPEDSKAVLLLDSSRAHPQEAELVSSNVFTIFLPASVASLVQPMEQGIRRDFMRNFINPPVPLQGPHARYNMNDAIFSVACAWNAVPSHVFRRAWRKLWPSVAFAEGSSSEEELEAECFPVKPHNKSFAHILELVKEGSSCPGQLRQRQAASWGVAGREAEGGRPPAATSPAEVVWSSEKTPKADQDGRGDPGEGEEVAWEQAAVAFDAVLRFAERQPCFSAQEVGQLRALRAVFRSQQQETVGLEDVVVTSPEELAIPKCCLEASTET

SEQ ID NO: 42327 - protein, 568 aa, Homo sapiens
  Payload ID: 8607
  Gene Symbol: JRK
  Gene Name: Jrk helix-turn-helix protein
  ENSP ID: ENSP00000482410
MASKPAAGKSRGEKRKRVVLTLKEKIDICTRLEKGESRKALMQEYNVGMSTLYDIRAHKAQLLRFFASSDSNKALEQRRTLHTPKLEHLDRVLYEWFLGKRSEGVPVSGPMLIEKAKDFYEQMQLTEPCVFSGGWLWRFKARHGIKKLDASSEKQSADHQAAEQFCAFFRSLAAEHGLSAEQVYNADETGLFWRCLPNPTPEGGAVPGPKQGKDRLTVLMCANATGSHRLKPLAIGKCSGPRAFKGIQHLPVAYKAQGNAWVDKEIFSDWFHHIFVPSVREHFRTIGLPEDSKAVLLLDSSRAHPQEAELVSSNVFTIFLPASVASLVQPMEQGIRRDFMRNFINPPVPLQGPHARYNMNDAIFSVACAWNAVPSHVFRRAWRKLWPSVAFAEGSSSEEELEAECFPVKPHNKSFAHILELVKEGSSCPGQLRQRQAASWGVAGREAEGGRPPAATSPAEVVWSSEKTPKADQDGRGDPGEGEEVAWEQAAVAFDAVLRFAERQPCFSAQEVGQLRALRAVFRSQQQVRRRRGALGAVVKVEALQEGPGGCGATAQSPLPCSSTAGDN

SEQ ID NO: 42328 - protein, 25 aa, Homo sapiens
  Payload ID: 8607
  Gene Symbol: JRK
  Gene Name: Jrk helix-turn-helix protein
  ENSP ID: ENSP00000482585
MASKPAAGKSRGEKRKRVVLTLKEK

SEQ ID NO: 42329 - protein, 556 aa, Homo sapiens; identical to SEQ ID NO: 42326
  Payload ID: 8607
  Gene Symbol: JRK
  Gene Name: Jrk helix-turn-helix protein
  ENSP ID: ENSP00000483808

SEQ ID NO: 42330 - protein, 568 aa, Homo sapiens; identical to SEQ ID NO: 42327
  Payload ID: 8607
  Gene Symbol: JRK
  Gene Name: Jrk helix-turn-helix protein
  ENSP ID: ENSP00000485390

SEQ ID NO: 42331 - protein, 524 aa, Homo sapiens
  Payload ID: 8608
  Gene Symbol: JRKL
  Gene Name: JRK-like
  Uniprot ID: Q9Y4A0
  ENSP ID: ENSP00000333350
MSGKRKRVVLTIKDKLDIIKKLEDGGSSKQLAVIYGIGETTVRDIRKNKEKIITYASSSDSTSLLAKRKSMKPSMYEELDRAMLEWFNQQRAKGNPISGPICAKRAEFFFYALGMDGDFNPSAGWLTRFKQRHSIREINIRNERLNGDETAVEDFCNNFRDFIERENLQPEQIYNADETGLFWKCLPSRISVIKGKCTVPGHKSIEERVTIMCCANATGLHKLKLCVVGKAKKPRSFKSTDTLNLPVSYFSQKGAWMDLSIFRQWFDKIFVPQVREYLRSKGLQEKAVLLLDNSPTHPNENVLRSDDGQIFAKYLPPNVASLIQPSDQGVIATMKRNYRAGLLQNNLEEGNDLKSFWKKLTLLDALYEIAMAWNLVKPVTISRAWKKILPMVEEKESLDFDVEDISVATVAAILQHTKGLENVTTENLEKWLEVDSTEPGYEVLTDSEIIRRAQGQADESSENEEEEIELIPEKHINHAAALQWTENLLDYLEQQGDMILPDRLVIRKLRATIRNKQKMTKSSQ

SEQ ID NO: 42332 - protein, 956 aa, Homo sapiens
  Payload ID: 8609
  Gene Symbol: JMJD1C
  Gene Name: jumonji domain containing 1C
  ENSP ID: ENSP00000335929
  MOD_RES (1)..(1): Any amino acid
XDSMPAMQLASKDRVSERSSAGAHKTDCLKLAEAGETGRIILPNVNSDSVHTKSEKNFQAVSQGSVPSSVMSAVNTMCNTKTDVITSAADTTSVSSWGGSEVISSLSNTILASTSSECVSSKSVSQPVAQKQECKVSTTAPVTLASSKTGSVVQPSSGFSGTTDFIHLKKHKAALAAAQYKSSNASETEPNAIKNQTLSASLPLDSTVICSTINKANSVGNGQASQTSQPNYHTKLKKAWLTRHSEEDKNTNKMENSGNSVSEIIKPCSVNLIASTSSDIQNSVDSKIIVDKYVKDDKVNRRKAKRTYESGSESGDSDESESKSEQRTKRQPKPTYKKKQNDLQKRKGEIEEDLKPNGVLSRSAKERSKLKLQSNSNTKIAWKRAVRGVREMCDACEATLFNIHWVCQKCGFVVCLDCYKAKERKSSRDKELYAWMKCVKGQPHDHKHLMPTQIIPGSVLTDLLDAMHTLREKYGIKSHCHCTNKQNLQVGNFPTMNGVSQVLQNVLNHSNKISLCMPESQQQNTPPKSEKNGGSSPESDVGTDNKLTPPESQSPLHWLADLAEQKAREEKKENKELTLENQIKEEREQDNSESPNGRTSPLVSQNNEQGSTLRDLLTTTAGKLRVGSTDAGIAFAPVYSMGAPSSKSGRTMPNILDDIIASVVENKIPPSKTSKINVKPELKEEPEESIISAVDENNKLYSDIPHSWICEKHILWLKDYKNSSNWKLFKECWKQGQPAVVSGVHKKMNISLWKAESISLDFGDHQADLLNCKDSIISNANVKEFWDGFEEVSKRQKNKSGETVVLKLKDWPSGEDFKTMMPARYEDLLKSLPLPEYCNPEGKFNLASHLPGFFVRPDLGPRLCSAYGVVAAKDHDIGTTNLHIEVSDVVNILVYVGIAKGNGILSKAGILKKFEEEDLDDILRKRLKDSSEIPGALWHIYAGKDVDKIREFLQKV

SEQ ID NO: 42333 - protein, 2540 aa, Homo sapiens
  Payload ID: 8609
  Gene Symbol: JMJD1C
  Gene Name: jumonji domain containing 1C
  Uniprot ID: Q15652
  ENSP ID: ENSP00000382204
MAVETRAELVGKRFLCVAVGDEARSERWESGRGWRSWRAGVIRAVSHRDSRNPDLAVYVEFDDLEWDKREWVKVYEDFSTFLVEYHLIWAKRNDPSQTQGSKSKQIQWPALTFKPLVERNIPSSVTAVEFLVDKQLDFLTEDSAFQPYQDDIDSLNPVLRDNPQLHEEVKVWVKEQKVQEIFMQGPYSLNGYRVRVYRQDSATQWFTGIITHHDLFTRTMIVMNDQVLEPQNVDPSMVQMTFLDDVVHSLLKGENIGITSRRRSRANQNVNAVHSHYTRAQANSPRPAMNSQAAVPKQNTHQQQQQRSIRPNKRKGSDSSIPDEEKMKEEKYDYISRGENPKGKNKHLMNKRRKPEEDEKKLNMKRLRTDNVSDFSESSDSENSNKRIIDNSSEQKPENELKNKNTSKINGEEGKPHNNEKAGEETLKNSQPPWDQIQEDKKHEEAEKRKSVDTQLQEDMIIHSSEQSTVSDHNSNDLLPQECNMDKTHTMELLPKEKFVSRPPTPKCVIDITNDTNLEKVAQENSSTFGLQTLQKMDPNVSDSKHSIANAKFLETAKKDSDQSWVSDVVKVDLTQSSVTNASSGNDHLNMEKEKYVSYISPLSAVSVMEDKLHKRSPPPETIKSKLNTSVDTHKIKSSPSPEVVKPKITHSPDSVKSKATYVNSQATGERRLANKIEHELSRCSFHPIPTRSSTLETTKSPLIIDKNEHFTVYRDPALIGSETGANHISPFLSQHPFPLHSSSHRTCLNPGTHHPALTPAPHLLAGSSSQTPLPTINTHPLTSGPHHAVHHPHLLPTVLPGVPTASLLGGHPRLESAHASSLSHLALAHQQQQQLLQHQSPHLLGQAHPSASYNQLGLYPIIWQYPNGTHAYSGLGLPSSKWVHPENAVNAEASLRRNSPSPWLHQPTPVTSADGIGLLSHIPVRPSSAEPHRPLKITAHSSPPLTKTLVDHHKEELERKAFMEPLRSVASTSAKNDLDLNRSQTGKDCHLHRHFVDPVLNQLQRPPQETGERLNKYKEEHRRILQESIDVAPFTTKIKGLEGERENYSRVASSSSSPKSHIIKQDMDVERSVSDLYKMKHSVPQSLPQSNYFTTLSNSVVNEPPRSYPSKEVSNIYGDKQSNALAAAAANPQTLTSFITSLSKPPPLIKHQPESEGLVGKIPEHLPHQIASHSVTTFRNDCRSPTHLTVSSTNTLRSMPALHRAPVFHPPIHHSLERKEGSYSSLSPPTLTPVMPVNAGGKVQESQKPPTLIPEPKDSQANFKSSSEQSLTEMWRPNNNLSKEKTEWHVEKSSGKLQAAMASVIVRPSSSTKTDSMPAMQLASKDRVSERSSAGAHKTDCLKLAEAGETGRIILPNVNSDSVHTKSEKNFQAVSQGSVPSSVMSAVNTMCNTKTDVITSAADTTSVSSWGGSEVISSLSNTILASTSSECVSSKSVSQPVAQKQECKVSTTAPVTLASSKTGSVVQPSSGFSGTTDFIHLKKHKAALAAAQYKSSNASETEPNAIKNQTLSASLPLDSTVICSTINKANSVGNGQASQTSQPNYHTKLKKAWLTRHSEEDKNTNKMENSGNSVSEIIKPCSVNLIASTSSDIQNSVDSKIIVDKYVKDDKVNRRKAKRTYESGSESGDSDESESKSEQRTKRQPKPTYKKKQNDLQKRKGEIEEDLKPNGVLSRSAKERSKLKLQSNSNTGIPRSVLKDWRKVKKLKQTGESFLQDDSCCEIGPNLQKCRECRLIRSKKGEEPAHSPVFCRFYYFRRLSFSKNGVVRIDGFSSPDQYDDEAMSLWTHENFEDDELDIETSKYILDIIGDKFCQLVTSEKTALSWVKKDAKIAWKRAVRGVREMCDACEATLFNIHWVCQKCGFVVCLDCYKAKERKSSRDKELYAWMKCVKGQPHDHKHLMPTQIIPGSVLTDLLDAMHTLREKYGIKSHCHCTNKQNLQVGNFPTMNGVSQVLQNVLNHSNKISLCMPESQQQNTPPKSEKNGGSSPESDVGTDNKLTPPESQSPLHWLADLAEQKAREEKKENKELTLENQIKEEREQDNSESPNGRTSPLVSQNNEQGSTLRDLLTTTAGKLRVGSTDAGIAFAPVYSMGAPSSKSGRTMPNILDDIIASVVENKIPPSKTSKINVKPELKEEPEESIISAVDENNKLYSDIPHSWICEKHILWLKDYKNSSNWKLFKECWKQGQPAVVSGVHKKMNISLWKAESISLDFGDHQADLLNCKDSIISNANVKEFWDGFEEVSKRQKNKSGETVVLKLKDWPSGEDFKTMMPARYEDLLKSLPLPEYCNPEGKFNLASHLPGFFVRPDLGPRLCSAYGVVAAKDHDIGTTNLHIEVSDVVNILVYVGIAKGNGILSKAGILKKFEEEDLDDILRKRLKDSSEIPGALWHIYAGKDVDKIREFLQKISKEQGLEVLPEHDPIRDQSWYVNKKLRQRLLEEYGVRTCTLIQFLGDAIVLPAGALHQVQNFHSCIQVTEDFVSPEHLVESFHLTQELRLLKEEINYDDKLQVKNILYHAVKEMVRALKIHEDEVEDMEEN

SEQ ID NO: 42334 - protein, 2358 aa, Homo sapiens
  Payload ID: 8609
  Gene Symbol: JMJD1C
  Gene Name: jumonji domain containing 1C
  Uniprot ID: Q15652
  ENSP ID: ENSP00000444682
MQGPYSLNGYRVRVYRQDSATQWFTGIITHHDLFTRTMIVMNDQVLEPQNVDPSMVQMTFLDDVVHSLLKGENIGITSRRRSRANQNVNAVHSHYTRAQANSPRPAMNSQAAVPKQNTHQQQQQRSIRPNKRKGSDSSIPDEEKMKEEKYDYISRGENPKGKNKHLMNKRRKPEEDEKKLNMKRLRTDNVSDFSESSDSENSNKRIIDNSSEQKPENELKNKNTSKINGEEGKPHNNEKAGEETLKNSQPPWDQIQEDKKHEEAEKRKSVDTQLQEDMIIHSSEQSTVSDHNSNDLLPQECNMDKTHTMELLPKEKFVSRPPTPKCVIDITNDTNLEKVAQENSSTFGLQTLQKMDPNVSDSKHSIANAKFLETAKKDSDQSWVSDVVKVDLTQSSVTNASSGNDHLNMEKEKYVSYISPLSAVSVMEDKLHKRSPPPETIKSKLNTSVDTHKIKSSPSPEVVKPKITHSPDSVKSKATYVNSQATGERRLANKIEHELSRCSFHPIPTRSSTLETTKSPLIIDKNEHFTVYRDPALIGSETGANHISPFLSQHPFPLHSSSHRTCLNPGTHHPALTPAPHLLAGSSSQTPLPTINTHPLTSGPHHAVHHPHLLPTVLPGVPTASLLGGHPRLESAHASSLSHLALAHQQQQQLLQHQSPHLLGQAHPSASYNQLGLYPIIWQYPNGTHAYSGLGLPSSKWVHPENAVNAEASLRRNSPSPWLHQPTPVTSADGIGLLSHIPVRPSSAEPHRPLKITAHSSPPLTKTLVDHHKEELERKAFMEPLRSVASTSAKNDLDLNRSQTGKDCHLHRHFVDPVLNQLQRPPQETGERLNKYKEEHRRILQESIDVAPFTTKIKGLEGERENYSRVASSSSSPKSHIIKQDMDVERSVSDLYKMKHSVPQSLPQSNYFTTLSNSVVNEPPRSYPSKEVSNIYGDKQSNALAAAAANPQTLTSFITSLSKPPPLIKHQPESEGLVGKIPEHLPHQIASHSVTTFRNDCRSPTHLTVSSTNTLRSMPALHRAPVFHPPIHHSLERKEGSYSSLSPPTLTPVMPVNAGGKVQESQKPPTLIPEPKDSQANFKSSSEQSLTEMWRPNNNLSKEKTEWHVEKSSGKLQAAMASVIVRPSSSTKTDSMPAMQLASKDRVSERSSAGAHKTDCLKLAEAGETGRIILPNVNSDSVHTKSEKNFQAVSQGSVPSSVMSAVNTMCNTKTDVITSAADTTSVSSWGGSEVISSLSNTILASTSSECVSSKSVSQPVAQKQECKVSTTAPVTLASSKTGSVVQPSSGFSGTTDFIHLKKHKAALAAAQYKSSNASETEPNAIKNQTLSASLPLDSTVICSTINKANSVGNGQASQTSQPNYHTKLKKAWLTRHSEEDKNTNKMENSGNSVSEIIKPCSVNLIASTSSDIQNSVDSKIIVDKYVKDDKVNRRKAKRTYESGSESGDSDESESKSEQRTKRQPKPTYKKKQNDLQKRKGEIEEDLKPNGVLSRSAKERSKLKLQSNSNTGIPRSVLKDWRKVKKLKQTGESFLQDDSCCEIGPNLQKCRECRLIRSKKGEEPAHSPVFCRFYYFRRLSFSKNGVVRIDGFSSPDQYDDEAMSLWTHENFEDDELDIETSKYILDIIGDKFCQLVTSEKTALSWVKKDAKIAWKRAVRGVREMCDACEATLFNIHWVCQKCGFVVCLDCYKAKERKSSRDKELYAWMKCVKGQPHDHKHLMPTQIIPGSVLTDLLDAMHTLREKYGIKSHCHCTNKQNLQVGNFPTMNGVSQVLQNVLNHSNKISLCMPESQQQNTPPKSEKNGGSSPESDVGTDNKLTPPESQSPLHWLADLAEQKAREEKKENKELTLENQIKEEREQDNSESPNGRTSPLVSQNNEQGSTLRDLLTTTAGKLRVGSTDAGIAFAPVYSMGAPSSKSGRTMPNILDDIIASVVENKIPPSKTSKINVKPELKEEPEESIISAVDENNKLYSDIPHSWICEKHILWLKDYKNSSNWKLFKECWKQGQPAVVSGVHKKMNISLWKAESISLDFGDHQADLLNCKDSIISNANVKEFWDGFEEVSKRQKNKSGETVVLKLKDWPSGEDFKTMMPARYEDLLKSLPLPEYCNPEGKFNLASHLPGFFVRPDLGPRLCSAYGVVAAKDHDIGTTNLHIEVSDVVNILVYVGIAKGNGILSKAGILKKFEEEDLDDILRKRLKDSSEIPGALWHIYAGKDVDKIREFLQKISKEQGLEVLPEHDPIRDQSWYVNKKLRQRLLEEYGVRTCTLIQFLGDAIVLPAGALHQVQNFHSCIQVTEDFVSPEHLVESFHLTQELRLLKEEINYDDKLQVKNILYHAVKEMVRALKIHEDEVEDMEEN

SEQ ID NO: 42335 - protein, 463 aa, Homo sapiens
  Payload ID: 8610
  Gene Symbol: JMJD4
  Gene Name: jumonji domain containing 4
  Uniprot ID: Q9H9V9
  ENSP ID: ENSP00000355720
MRAGPEPQALAGQKRGALRLLVPRLVLTVSAPAEVRRRVLRPVLSWMDRETRALADSHFRGLGVDVPGVGQAPGRVAFVSEPGAFSYADFVRGFLLPNLPCVFSSAFTQGWGSRRRWVTPAGRPDFDHLLRTYGDVVVPVANCGVQEYNSNPKEHMTLRDYITYWKEYIQAGYSSPRGCLYLKDWHLCRDFPVEDVFTLPVYFSSDWLNEFWDALDVDDYRFVYAGPAGSWSPFHADIFRSFSWSVNVCGRKKWLLFPPGQEEALRDRHGNLPYDVTSPALCDTHLHPRNQLAGPPLEITQEAGEMVFVPSGWHHQVHNLDDTISINHNWVNGFNLANMWRFLQQELCAVQEEVSEWRDSMPDWHHHCQVIMRSCSGINFEEFYHFLKVIAEKRLLVLREAAAEDGAGLGFEQAAFDVGRITEVLASLVAHPDFQRVDTSAFSPQPKELLQQLREAVDAAAAP

SEQ ID NO: 42336 - protein, 447 aa, Homo sapiens
  Payload ID: 8610
  Gene Symbol: JMJD4
  Gene Name: jumonji domain containing 4
  Uniprot ID: Q9H9V9
  ENSP ID: ENSP00000387830
MRAGPEPQALAGQKRGALRLLVPRLVLTVSAPAEVRRRVLRPVLSWMDRETRALADSHFRGLGVDVPGVGQAPGRVAFVSEPGAFSYADFVRGFLLPNLPCVFSSAFTQGWGSRRRWVTPAGRPDFDHLLRTYGDVVVPVANCGVQEYNSNPKEHMTLRDYITYWKEYIQAGYSSPRGCLYLKDWHLCRDFPVEDVFTLPVYFSSDWLNEFWDALDVDDYRFVYAGPAGSWSPFHADIFRSFSWSVNVCGRKKWLLFPPGQEEALRDRHGNLPYDVTSPALCDTHLHPRNQLAGPPLEITQEAGEMVFVPSGWHHQVHNLDDTISINHNWVNGFNLANMWRFLQQELCAVQEEVIMRSCSGINFEEFYHFLKVIAEKRLLVLREAAAEDGAGLGFEQAAFDVGRITEVLASLVAHPDFQRVDTSAFSPQPKELLQQLREAVDAAAAP

SEQ ID NO: 42337 - protein, 417 aa, Homo sapiens
  Payload ID: 8610
  Gene Symbol: JMJD4
  Gene Name: jumonji domain containing 4
  ENSP ID: ENSP00000477669
MDRETRALADSHFRGLGVDVPGVGQAPGRVAFVSEPGAFSYADFVRGFLLPNLPCVFSSAFTQGWGSRRRWVTPAGRPDFDHLLRTYGDVVVPVANCGVQEYNSNPKEHMTLRDYITYWKEYIQAGYSSPRGCLYLKDWHLCRDFPVEDVFTLPVYFSSDWLNEFWDALDVDDYRFVYAGPAGSWSPFHADIFRSFSWSVNVCGRKKWLLFPPGQEEALRDRHGNLPYDVTSPALCDTHLHPRNQLAGPPLEITQEAGEMVFVPSGWHHQVHNLDDTISINHNWVNGFNLANMWRFLQQELCAVQEEVSEWRDSMPDWHHHCQVIMRSCSGINFEEFYHFLKVIAEKRLLVLREAAAEDGAGLGFEQAAFDVGRITEVLASLVAHPDFQRVDTSAFSPQPKELLQQLREAVDAAAAP

SEQ ID NO: 42338 - protein, 463 aa, Homo sapiens; identical to SEQ ID NO: 42335
  Payload ID: 8610
  Gene Symbol: JMJD4
  Gene Name: jumonji domain containing 4
  Uniprot ID: Q9H9V9
  ENSP ID: ENSP00000484088

SEQ ID NO: 42339 - protein, 335 aa, Homo sapiens
  Payload ID: 8611
  Gene Symbol: JMJD6
  Gene Name: jumonji domain containing 6
  ENSP ID: ENSP00000302916
MNHKSKKRIREAKRSARPELKDSLDWTRHNYYESFSLSPAAVADNVERADALQLSVEEFVERYERPYKPVVLLNAQEGWSAQEKWTLERLKRKYRNQKFKCGEDNDGYSVKMKMKYYIEYMESTRDDSPLYIFDSSYGEHPKRRKLLEDYKVPKFFTDDLFQYAGEKRRPPYRWFVMGPPRSGTGIHIDPLGTSAWNALVQGHKRWCLFPTSTPRELIKVTRDEGGNQQDEAITWFNVIYPRTQLPTWPPEFKPLEILQKPGETVFVPGGWWHVVLNLDTTIAITQNFASSTNFPVVWHKTVRGRPKLSRKWYRYSTGSGSASHPQPPRATVSQP

SEQ ID NO: 42340 - protein, 403 aa, Homo sapiens
  Payload ID: 8611
  Gene Symbol: JMJD6
  Gene Name: jumonji domain containing 6
  Uniprot ID: Q6NYC1
  ENSP ID: ENSP00000380750
MNHKSKKRIREAKRSARPELKDSLDWTRHNYYESFSLSPAAVADNVERADALQLSVEEFVERYERPYKPVVLLNAQEGWSAQEKWTLERLKRKYRNQKFKCGEDNDGYSVKMKMKYYIEYMESTRDDSPLYIFDSSYGEHPKRRKLLEDYKVPKFFTDDLFQYAGEKRRPPYRWFVMGPPRSGTGIHIDPLGTSAWNALVQGHKRWCLFPTSTPRELIKVTRDEGGNQQDEAITWFNVIYPRTQLPTWPPEFKPLEILQKPGETVFVPGGWWHVVLNLDTTIAITQNFASSTNFPVVWHKTVRGRPKLSRKWYRILKQEHPELAVLADSVDLQESTGIASDSSSDSSSSSSSSSSDSDSECESGSEGDGTVHRRKKRRTCSMVGNGDTTSQDDCVSKERSSSR

SEQ ID NO: 42341 - protein, 414 aa, Homo sapiens
  Payload ID: 8611
  Gene Symbol: JMJD6
  Gene Name: jumonji domain containing 6
  Uniprot ID: Q6NYC1
  ENSP ID: ENSP00000394085
MNHKSKKRIREAKRSARPELKDSLDWTRHNYYESFSLSPAAVADNVERADALQLSVEEFVERYERPYKPVVLLNAQEGWSAQEKWTLERLKRKYRNQKFKCGEDNDGYSVKMKMKYYIEYMESTRDDSPLYIFDSSYGEHPKRRKLLEDYKVPKFFTDDLFQYAGEKRRPPYRWFVMGPPRSGTGIHIDPLGTSAWNALVQGHKRWCLFPTSTPRELIKVTRDEGGNQQDEAITWFNVIYPRTQLPTWPPEFKPLEILQKPGETVFVPGGWWHVVLNLDTTIAITQNFASSTNFPVVWHKTVRGRPKLSRKWYRILKQEHPELAVLADSVDLQESTGIASDSSSDSSSSSSSSSSDSDSECESGSEGDGTVHRRKKRRTCSMVGNGDTTSQDDCVSKERSSSRIRDTCGGRAHP

SEQ ID NO: 42342 - protein, 361 aa, Homo sapiens
  Payload ID: 8611
  Gene Symbol: JMJD6
  Gene Name: jumonji domain containing 6
  ENSP ID: ENSP00000442362
MNHKSKKRIREAKRSARPELKDSLDWTRHNYYESFSLSPAAVADNVERADALQLSVEEFVERYERPYKPVVLLNAQEGWSAQEKWTLERLKRKYRNQKFKCGEDNDGYSVKMKMKYYIEYMESTRDDSPLYIFDSSYGEHPKRRKLLEDYKVPKFFTDDLFQYAGEKRRPPYRWFVMGPPRSGTGIHIDPLGTSAWNALVQGHKRWCLFPTSTPRELIKVTRDEGGNQQDEAITWFNVIYPRTQLPTWPPEFKPLEILQKPGETVFVPGGWWHVVLNLDTTIAITQNFASSTNFPVVWHKTVRGRPKLSRKWYRTDTARAAAVQATHSHPVPLCPNPDLEGPALGDFEARAPRVGSPRRLG

SEQ ID NO: 42343 - protein, 395 aa, Homo sapiens
  Payload ID: 8611
  Gene Symbol: JMJD6
  Gene Name: jumonji domain containing 6
  ENSP ID: ENSP00000465330
MNHKSKKRIREAKRSARPELKDSLDWTRHNYYESFSLSPAAVADNVERADALQLSVEEFVERYERPYKPVVLLNAQEGWSAQEKWTLERLKRKYRNQKFKCGEDNDGYSVKMKMKYYIEYMESTRDDSPLYIFDSSYGEHPKRRKLLEDYKVPKFFTDDLFQYAGEKRRPPYRWFVMGPPRSGTGIHIDPLGTSAWNALVQGHKRWCLFPTSTPRELIKVTRDEGGNQQDEAITWFNVIYPRTQLPTWPPEFKPLEILQKPGETVFVPGGWWHVVLNLDTTIAITQNFASSTNFPVVWHKTVRGRPKLSRKWYSASLDPRAMGQCTAGRRGGRAAWWETGTPPPRTTVSAKSAAPPGDPARLLSVWKDTLAARAGPGEGGLSSPADKGRPDRAQE

SEQ ID NO: 42344 - protein, 361 aa, Homo sapiens; identical to SEQ ID NO: 42342
  Payload ID: 8611
  Gene Symbol: JMJD6
  Gene Name: jumonji domain containing 6
  ENSP ID: ENSP00000483941

SEQ ID NO: 42345 - protein, 316 aa, Homo sapiens
  Payload ID: 8612
  Gene Symbol: JMJD7
  Gene Name: jumonji domain containing 7
  Uniprot ID: P0C870
  ENSP ID: ENSP00000380467
MAEAALEAVRSELREFPAAARELCVPLAVPYLDKPPTPLHFYRDWVCPNRPCIIRNALQHWPALQKWSLPYFRATVGSTEVSVAVTPDGYADAVRGDRFMMPAERRLPLSFVLDVLEGRAQHPGVLYVQKQCSNLPSELPQLLPDLESHVPWASEALGKMPDAVNFWLGEAAAVTSLHKDHYENLYCVVSGEKHFLFHPPSDRPFIPYELYTPATYQLTEEGTFKVVDEEAMEKVPWIPLDPLAPDLARYPSYSQAQALRCTVRAGEMLYLPALWFHHVQQSQGCIAVNFWYDMEYDLKYSYFQLLDSLTKASGLD

SEQ ID NO: 42346 - protein, 217 aa, Homo sapiens
  Payload ID: 8612
  Gene Symbol: JMJD7
  Gene Name: jumonji domain containing 7
  ENSP ID: ENSP00000384174
MMPAERRLPLSFVLDVLEGRAQHPGVLYVQKQCSNLPSELPQLLPDLESHVPWASEALGKMPDAVNFWLGEAAAVTSLHKDHYENLYCVVSGEKHFLFHPPSDRPFIPYELYTPATYQLTEEGTFKVVDEEAMEKVPWIPLDPLAPDLARYPSYSQAQALRCTVRAGEMLYLPALWFHHVQQSQGCIAVNFWYDMEYDLKYSYFQLLDSLTKASGLD

SEQ ID NO: 42347 - protein, 135 aa, Homo sapiens
  Payload ID: 8612
  Gene Symbol: JMJD7
  Gene Name: jumonji domain containing 7
  ENSP ID: ENSP00000399600
MMPAERRLPLSFVLDVLEGRAQHPGVLYVQKQCSNLPSELPQLLPDLESHVPWASEALGKMPDAVNFWLGEAAAVTSLHKDHYENLYCVVSGEKHFLFHPPSDRPFIPYELYTPATYQLTEEGTFKVVDEEAMEK

SEQ ID NO: 42348 - protein, 285 aa, Homo sapiens
  Payload ID: 8613
  Gene Symbol: JMJD8
  Gene Name: jumonji domain containing 8
  Uniprot ID: Q96S16
  ENSP ID: ENSP00000399475
MAGGWAQGSRRAARLPEGGRLMAPASRLLALWALAAVALPGSGAEGDGGWRPGGPGAVAEEERCTVERRADLTYAEFVQQYAFVRPVILQGLTDNSRFRALCSRDRLLASFGDRVVRLSTANTYSYHKVDLPFQEYVEQLLHPQDPTSLGNDTLYFFGDNNFTEWASLFRHYSPPPFGLLGTAPAYSFGIAGAGSGVPFHWHGPGYSEVIYGRKRWFLYPPEKTPEFHPNKTTLAWLRDTYPALPPSARPLECTIRAGEVLYFPDRWWHATLNLDTSVFISTFLG

SEQ ID NO: 42349 - protein, 234 aa, Homo sapiens
  Payload ID: 8613
  Gene Symbol: JMJD8
  Gene Name: jumonji domain containing 8
  ENSP ID: ENSP00000454358
MAPASRLLALWALAAVALPGSGAEGDGGWYAFVRPVILQGLTDNSRFRALCSRDRLLASFGDRVVRLSTANTYSYHKVDLPFQEYVEQLLHPQDPTSLGNDTLYFFGDNNFTEWASLFRHYSPPPFGLLGTAPAYSFGIAGAGSGVPFHWHGPGYSEVIYGRKRWFLYPPEKTPEFHPNKTTLAWLRDTYPALPPSARPLECTIRAGEVLYFPDRWWHATLNLDTSVFISTFLG

SEQ ID NO: 42350 - protein, 81 aa, Homo sapiens
  Payload ID: 8613
  Gene Symbol: JMJD8
  Gene Name: jumonji domain containing 8
  ENSP ID: ENSP00000454700
  MOD_RES (1)..(1): Any amino acid
XWTCPSRSMWSSCCTPRTPPPWAMTPCTSSGTTTSPSGPLSFGTTPHPHLACWEPLQLTALESQELARGCPSTGMDPGTQK

SEQ ID NO: 42351 - protein, 219 aa, Homo sapiens
  Payload ID: 8613
  Gene Symbol: JMJD8
  Gene Name: jumonji domain containing 8
  ENSP ID: ENSP00000458106
MAPASRLLALWALAAVALPGSGAEGDGGWRPGGPGAVAEEERCTVERRADLTYAEFVQQYAFVRPVILQGLTDNSRFRALCSRDRLLASFGDRVVRLSTANTYSYHKVDLPFQEYVEQLLHPQDPTSLGNDTLYFFGDNNFTEWASLFRHYSPPPFGLLGTAPAYSFGIAGAGSGVPFHWHGPGYSEVIYGRKVLYFPDRWWHATLNLDTSVFISTFLG

SEQ ID NO: 42352 - protein, 264 aa, Homo sapiens
  Payload ID: 8613
  Gene Symbol: JMJD8
  Gene Name: jumonji domain containing 8
  Uniprot ID: Q96S16
  ENSP ID: ENSP00000477481
MAPASRLLALWALAAVALPGSGAEGDGGWRPGGPGAVAEEERCTVERRADLTYAEFVQQYAFVRPVILQGLTDNSRFRALCSRDRLLASFGDRVVRLSTANTYSYHKVDLPFQEYVEQLLHPQDPTSLGNDTLYFFGDNNFTEWASLFRHYSPPPFGLLGTAPAYSFGIAGAGSGVPFHWHGPGYSEVIYGRKRWFLYPPEKTPEFHPNKTTLAWLRDTYPALPPSARPLECTIRAGEVLYFPDRWWHATLNLDTSVFISTFLG

SEQ ID NO: 42353 - protein, 1246 aa, Homo sapiens [sequence omitted]

SEQ ID NO: 42354 - protein, 1074 aa, Homo sapiens
  Payload ID: 8614
  Gene Symbol: JARID2
  Gene Name: jumonji, AT rich interactive domain 2
  Uniprot ID: Q92833
  ENSP ID: ENSP00000380478
MVYFGSSQDEEEVEEEDDETEDVKTATNNASSSCQSTPRKGKTHKHVHNGHVFNGSSRSTREKEPVQKHKSKEATPAKEKHSDHRADSRREQASANHPAAAPSTGSSAKGLAATHHHPPLHRSAQDLRKQVSKVNGVTRMSSLGAGVTSAKKMREVRPSPSKTVKYTATVTKGAVTYTKAKRELVKDTKPNHHKPSSAVNHTISGKTESSNAKTRKQVLSLGGASKSTGPAVNGLKVSGRLNPKSCTKEVGGRQLREGLQLREGLRNSKRRLEEAHQAEKPQSPPKKMKGAAGPAEGPGKKAPAERGLLNGHVKKEVPERSLERNRPKRATAGKSTPGRQAHGKADSASCENRSTSQPESVHKPQDSGKAEKGGGKAGWAAMDEIPVLRPSAKEFHDPLIYIESVRAQVEKFGMCRVIPPPDWRPECKLNDEMRFVTQIQHIHKLGRRWGPNVQRLACIKKHLKSQGITMDELPLIGGCELDLACFFRLINEMGGMQQVTDLKKWNKLADMLRIPRTAQDRLAKLQEAYCQYLLSYDSLSPEEHRRLEKEVLMEKEILEKRKGPLEGHTENDHHKFHPLPRFEPKNGLIHGVAPRNGFRSKLKEVGQAQLKTGRRRLFAQEKEVVKEEEEDKGVLNDFHKCIYKGRSVSLTTFYRTARNIMSMCFSKEPAPAEIEQEYWRLVEEKDCHVAVHCGKVDTNTHGSGFPVGKSEPFSRHGWNLTVLPNNTGSILRHLGAVPGVTIPWLNIGMVFSTSCWSRDQNHLPYIDYLHTGADCIWYCIPAEEENKLEDVVHTLLQANGTPGLQMLESNVMISPEVLCKEGIKVHRTVQQSGQFVVCFPGSFVSKVCCGYSVSETVHFATTQWTSMGFETAKEMKRRHIAKPFSMEKLLYQIAQAEAKKENGPTLSTISALLDELRDTELRQRRQLFEAGLHSSARYGSHDGSSTVADGKKKPRKWLQLETSERRCQICQHLCYLSMVVQENENVVFCLECALRHVEKQKSCRGLKLMYRYDEEQIISLVNQICGKVSGKNGSIENCLSKPTPKRGPRKRATVDVPPSRLSASSSSKSASSSS

SEQ ID NO: 42355 - protein, 146 aa, Homo sapiens
  Payload ID: 8615
  Gene Symbol: JTB
  Gene Name: jumping translocation breakpoint
  Uniprot ID: O76095
  ENSP ID: ENSP00000271843
MLAGAGRPGLPQGRHLCWLLCAFTLKLCQAEAPVQEEKLSASTSNLPCWLVEEFVVAEECSPCSNFRAKTTPECGPTGYVEKITCSSSKRNEFKSCRSALMEQRLFWKFEGAVVCVALIFACLVIIRQRQLDRKALEKVRKQIESI

SEQ ID NO: 42356 - protein, 117 aa, Homo sapiens
  Payload ID: 8615
  Gene Symbol: JTB
  Gene Name: jumping translocation breakpoint
  Uniprot ID: O76095
  ENSP ID: ENSP00000349069
MAWGWHLSFLSASTSNLPCWLVEEFVVAEECSPCSNFRAKTTPECGPTGYVEKITCSSSKRNEFKSCRSALMEQRLFWKFEGAVVCVALIFACLVIIRQRQLDRKALEKVRKQIESI

SEQ ID NO: 42357 - protein, 117 aa, Homo sapiens; identical to SEQ ID NO: 42356
  Payload ID: 8615
  Gene Symbol: JTB
  Gene Name: jumping translocation breakpoint
  Uniprot ID: O76095
  ENSP ID: ENSP00000357578

SEQ ID NO: 42358 - protein, 117 aa, Homo sapiens; identical to SEQ ID NO: 42356
  Payload ID: 8615
  Gene Symbol: JTB
  Gene Name: jumping translocation breakpoint
  Uniprot ID: O76095
  ENSP ID: ENSP00000395250

SEQ ID NO: 42359 - protein, 347 aa, Homo sapiens
  Payload ID: 8616
  Gene Symbol: JUNB
  Gene Name: jun B proto-oncogene
  Uniprot ID: P17275
  ENSP ID: ENSP00000303315
MCTKMEQPFYHDDSYTATGYGRAPGGLSLHDYKLLKPSLAVNLADPYRSLKAPGARGPGPEGGGGGSYFSGQGSDTGASLKLASSELERLIVPNSNGVITTTPTPPGQYFYPRGGGSGGGAGGAGGGVTEEQEGFADGFVKALDDLHKMNHVTPPNVSLGATGGPPAGPGGVYAGPEPPPVYTNLSSYSPASASSGGAGAAVGTGSSYPTTTISYLPHAPPFAGGHPAQLGLGRGASTFKEEPQTVPEARSRDATPPVSPINMEDQERIKVERKRLRNRLAATKCRKRKLERIARLEDKVKTLKAENAGLSSTAGLLREQVAQLKQKVMTHVSNGCQLLLGVKGHAF

SEQ ID NO: 42360 - protein, 347 aa, Homo sapiens
  Payload ID: 8617
  Gene Symbol: JUND
  Gene Name: jun D proto-oncogene
  Uniprot ID: P17535
  ENSP ID: ENSP00000252818
METPFYGDEALSGLGGGASGSGGSFASPGRLFPGAPPTAAAGSMMKKDALTLSLSEQVAAALKPAAAPPPTPLRADGAPSAAPPDGLLASPDLGLLKLASPELERLIIQSNGLVTTTPTSSQFLYPKVAASEEQEFAEGFVKALEDLHKQNQLGAGAAAAAAAAAAGGPSGTATGSAPPGELAPAAAAPEAPVYANLSSYAGGAGGAGGAATVAFAAEPVPFPPPPPPGALGPPRLAALKDEPQTVPDVPSFGESPPLSPIDMDTQERIKAERKRLRNRIAASKCRKRKLERISRLEEKVKTLKSQNTELASTASLLREQVAQLKQKVLSHVNSGCQLLPQHQVPAY

SEQ ID NO: 42361 - protein, 166 aa, Homo sapiens
  Payload ID: 8617
  Gene Symbol: JUND
  Gene Name: jun D proto-oncogene
  ENSP ID: ENSP00000475153
AAAPEAPVYANLSSYAGGAGGAGGAATVAFAAEPVPFPPPPPPGALGPPRLAALKDEPQTVPDVPSFGESPPLSPIDMDTQERIKAERKRLRNRIAASKCRKRKLERISRLEEKVKTLKSQNTELASTASLLREQVAQLKQKVLSHVNSGCQLLPQHQREEQSVRF

SEQ ID NO: 42362 - protein, 174 aa, Homo sapiens
  Payload ID: 8618
  Gene Symbol: JDP2
  Gene Name: Jun dimerization protein 2
  Uniprot ID: Q8WYK2
  ENSP ID: ENSP00000267569
MVAGWPATPPAMMPGQIPDPSVTTGSLPGLGPLTGLPSSALTVEELKYADIRNLGAMIAPLHFLEVKLGKRPQPVKSELDEEEERRKRRREKNKVAAARCRNKKKERTEFLQRESERLELMNAELKTQIEELKQERQQLILMLNRHRPTCIVRTDSVKTPESEGNPLLEQLEKK

SEQ ID NO: 42363 - protein, 163 aa, Homo sapiens
  Payload ID: 8618
  Gene Symbol: JDP2
  Gene Name: Jun dimerization protein 2
  Uniprot ID: Q8WYK2
  ENSP ID: ENSP00000399587
MMPGQIPDPSVTTGSLPGLGPLTGLPSSALTVEELKYADIRNLGAMIAPLHFLEVKLGKRPQPVKSELDEEEERRKRRREKNKVAAARCRNKKKERTEFLQRESERLELMNAELKTQIEELKQERQQLILMLNRHRPTCIVRTDSVKTPESEGNPLLEQLEKK

SEQ ID NO: 42364 - protein, 163 aa, Homo sapiens; identical to SEQ ID NO: 42363
  Payload ID: 8618
  Gene Symbol: JDP2
  Gene Name: Jun dimerization protein 2
  Uniprot ID: Q8WYK2
  ENSP ID: ENSP00000409787

SEQ ID NO: 42365 - protein, 163 aa, Homo sapiens; identical to SEQ ID NO: 42363
  Payload ID: 8618
  Gene Symbol: JDP2
  Gene Name: Jun dimerization protein 2
  Uniprot ID: Q8WYK2
  ENSP ID: ENSP00000415558

SEQ ID NO: 42366 - protein, 133 aa, Homo sapiens
  Payload ID: 8618
  Gene Symbol: JDP2
  Gene Name: Jun dimerization protein 2
  ENSP ID: ENSP00000452769
MMPGQIPDPSVTTGSLPGLGPLTGLPSSALTVEELKYADIRNLGAMIAPLHFLEVKLGKRPQPVKSELDEEEERRKRRREKNKVAAARCRNKKKERTEFLQRESERLELMNAELKTQIEELKQERQQLILMLN

SEQ ID NO: 42367 - protein, 331 aa, Homo sapiens
  Payload ID: 8619
  Gene Symbol: JUN
  Gene Name: jun proto-oncogene
  Uniprot ID: P05412
  ENSP ID: ENSP00000360266
MTAKMETTFYDDALNASFLPSESGPYGYSNPKILKQSMTLNLADPVGSLKPHLRAKNSDLLTSPDVGLLKLASPELERLIIQSSNGHITTTPTPTQFLCPKNVTDEQEGFAEGFVRALAELHSQNTLPSVTSAAQPVNGAGMVAPAVASVAGGSGSGGFSASLHSEPPVYANLSNFNPGALSSGGGAPSYGAAGLAFPAQPQQQQQPPHHLPQQMPVQHPRLQALKEEPQTVPEMPGETPPLSPIDMESQERIKAERKRMRNRIAASKCRKRKLERIARLEEKVKTLKAQNSELASTANMLREQVAQLKQKVMNHVNSGCQLMLTQQLQTF

SEQ ID NO: 42368 - protein, 988 aa, Homo sapiens
  Payload ID: 8620
  Gene Symbol: JMY
  Gene Name: junction mediating and regulatory protein, p53 cofactor
  Uniprot ID: Q8N9B5
  ENSP ID: ENSP00000379441
MSFALEETLESDWVAVRPHVFDEREKHKFVFIVAWNEIEGKFAITCHNRTAQRQRSGSREQAGARGGAEAGGAASDGSRGPGSPAGRGRPEATASATLVRSPGPRRSSAWAEGGSPRSTRSLLGDPRLRSPGSKGAESRLRSPVRAKPIPGQKTSEADDAAGAAAAAARPAPREAQVSSVRIVSASGTVSEEIEVLEMVKEDEAPLALSDAEQPPPATELESPAEECSWAGLFSFQDLRAVHQQLCSVNSQLEPCLPVFPEEPSGMWTVLFGGAPEMTEQEIDTLCYQLQVYLGHGLDTCGWKILSQVLFTETDDPEEYYESLSELRQKGYEEVLQRARKRIQELLDKHKNTESMVELLDLYQMEDEAYSSLAEATTELYQYLLQPFRDMRELAMLRRQQIKISMENDYLGPRRIESLQKEDADWQRKAHMAVLSIQDLTVKYFEITAKAQKAVYDRMRADQKKFGKASWAAAAERMEKLQYAVSKETLQMMRAKEICLEQRKHALKEEMQSLRGGTEAIARLDQLEADYYDLQLQLYEVQFEILKCEELLLTAQLESIKRLISEKRDEVVYYDTYESMEAMLEKEEMAASAYLQREELQKLQQKARQLEARRGRVSAKKSYLRNKKEICIAKHNEKIQQRTRIEDEYRTHHTVQLKREKLHDEEERKSAWVSQERQRTLDRLRTFKQRYPGQVILKSTRLRLAHARRKGAASPVLQEDHCDSLPSVLQVEEKTEEVGEGRVKRGPSQTTEPQSLVQLEDTSLTQLEATSLPLSGVTSELPPTISLPLLNNNLEPCSVTINPLPSPLPPTPPPPPPPPPPPPPPPLPVAKDSGPETLEKDLPRKEGNEKRIPKSASAPSAHLFDSSQLVSARKKLRKTAEGLQRRRVSSPMDEVLASLKRGSFHLKKVEQRTLPPFPDEDDSNNILAQIRKGVKLKKVQKDVLRESFTLLPDTDPLTRSIHEALRRIKEASPESEDEEEALPCTDWEN

SEQ ID NO: 42369 - protein, 745 aa, Homo sapiens
  Payload ID: 8621
  Gene Symbol: JUP
  Gene Name: junction plakoglobin
  Uniprot ID: P14923
  ENSP ID: ENSP00000311113
MEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPLLNKNNPKFLAITTDCLQLLAYGNQESKLIILANGGPQALVQIMRNYSYEKLLWTTSRVLKVLSVCPSNKPAIVEAGGMQALGKHLTSNSPRLVQNCLWTLRNLSDVATKQEGLESVLKILVNQLSVDDVNVLTCATGTLSNLTCNNSKNKTLVTQNSGVEALIHAILRAGDKDDITEPAVCALRHLTSRHPEAEMAQNSVRLNYGIPAIVKLLNQPNQWPLVKATIGLIRNLALCPANHAPLQEAAVIPRLVQLLVKAHQDAQRHVAAGTQQPYTDGVRMEEIVEGCTGALHILARDPMNRMEIFRLNTIPLFVQLLYSSVENIQRVAAGVLCELAQDKEAADAIDAEGASAPLMELLHSRNEGTATYAAAVLFRISEDKNPDYRKRVSVELTNSLFKHDPAAWEAAQSMIPINEPYGDDMDATYRPMYSSDVPLDPLEMHMDMDGDYPIDTYSDGLRPPYPTADHMLA

SEQ ID NO: 42370 - protein, 745 aa, Homo sapiens; identical to SEQ ID NO: 42369
  Payload ID: 8621
  Gene Symbol: JUP
  Gene Name: junction plakoglobin
  Uniprot ID: P14923
  ENSP ID: ENSP00000377507

SEQ ID NO: 42371 - protein, 745 aa, Homo sapiens; identical to SEQ ID NO: 42369
  Payload ID: 8621
  Gene Symbol: JUP
  Gene Name: junction plakoglobin
  Uniprot ID: P14923
  ENSP ID: ENSP00000377508

SEQ ID NO: 42372 - protein, 297 aa, Homo sapiens
  Payload ID: 8621
  Gene Symbol: JUP
  Gene Name: junction plakoglobin
  ENSP ID: ENSP00000389886
MEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPLLNKNNPKFLAITTDCLQLLAY

SEQ ID NO: 42373 - protein, 295 aa, Homo sapiens
  Payload ID: 8621
  Gene Symbol: JUP
  Gene Name: junction plakoglobin
  ENSP ID: ENSP00000394146
MEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPLLNKNNPKFLAITTDCLQLL

SEQ ID NO: 42374 - protein, 235 aa, Homo sapiens
  Payload ID: 8621
  Gene Symbol: JUP
  Gene Name: junction plakoglobin
  ENSP ID: ENSP00000401034
MEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRML

SEQ ID NO: 42375 - protein, 86 aa, Homo sapiens
  Payload ID: 8621
  Gene Symbol: JUP
  Gene Name: junction plakoglobin
  ENSP ID: ENSP00000409948
MEVMNLMEQPIKVTEWQQTYTYDSGIHSGANTCVPSVSSKGIMEEDEACGRQYTLKKTTTYTQGVPPSQGDLEYQMSTTARAKRVR

SEQ ID NO: 42376 - protein, 276 aa, Homo sapiens
  Payload ID: 8621
  Gene Symbol: JUP
  Gene Name: junction plakoglobin
  ENSP ID: ENSP00000411449
MEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPL

SEQ ID NO: 42377 - protein, 2 aa, Homo sapiens
  Payload ID: 8621
  Gene Symbol: JUP
  Gene Name: junction plakoglobin
  ENSP ID: ENSP00000467065
ME

SEQ ID NO: 42378 - protein, 104 aa, Homo sapiens
  Payload ID: 8621
  Gene Symbol: JUP
  Gene Name: junction plakoglobin
  ENSP ID: ENSP00000468347
MEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLAT

SEQ ID NO: 42379 - protein, 262 aa, Homo sapiens
  Payload ID: 8622
  Gene Symbol: JAM2
  Gene Name: junctional adhesion molecule 2
  Uniprot ID: P57087
  ENSP ID: ENSP00000318416
MARRSRHRLLLLLLRYLVVALGYHKAYGFSAPKDQQVVTAVEYQGDFKNRAEMIDFNIRIKNVTRSDAGKYRCEVSAPSEQGQNLEEDTVTLEVLVAPAVPSCEVPSSALSGTVVELRCQDKEGNPAPEYTWFKDGIRLLENPRLGSQSTNSSYTMNTKTGTLQFNTVSKLDTGEYSCEARNSVGYRRCPGKRMQVDDLNISGIIAAVVVVALVISVCGLGVCYAQRKGYFSKETSFQKSNSSSKATTMSENDFKHTKSFII

SEQ ID NO: 42380 - protein, 312 aa, Homo sapiens
  Payload ID: 8622
  Gene Symbol: JAM2
  Gene Name: junctional adhesion molecule 2
  Uniprot ID: P57087
  ENSP ID: ENSP00000383376
MARRSRHRLLLLLLRYLVVALGYHKAYGFSAPKDQQVVTAVEYQEAILACKTPKKTVSSRLEWKKLGRSVSFVYYQQTLQGDFKNRAEMIDFNIRIKNVTRSDAGKYRCEVSAPSEQGQNLEEDTVTLEVLVAPAVPSCEVPSSALSGTVVELRCQDKEGNPAPEYTWFKDGIRLLENPRLGSQSTNSSYTMNTKTGTLQFNTVSKLDTGEYSCEARNSVGYRRCPGKRMQVDDLNISGIIAAVVVVALVISVCGLGVCYAQRKGYFSKETSFQKSNSSSKATTMSENVQWLTPVIPALWKAAAGGSRGQEF

SEQ ID NO: 42381 - protein, 298 aa, Homo sapiens
  Payload ID: 8622
  Gene Symbol: JAM2
  Gene Name: junctional adhesion molecule 2
  Uniprot ID: P57087
  ENSP ID: ENSP00000420419
MARRSRHRLLLLLLRYLVVALGYHKAYGFSAPKDQQVVTAVEYQEAILACKTPKKTVSSRLEWKKLGRSVSFVYYQQTLQGDFKNRAEMIDFNIRIKNVTRSDAGKYRCEVSAPSEQGQNLEEDTVTLEVLVAPAVPSCEVPSSALSGTVVELRCQDKEGNPAPEYTWFKDGIRLLENPRLGSQSTNSSYTMNTKTGTLQFNTVSKLDTGEYSCEARNSVGYRRCPGKRMQVDDLNISGIIAAVVVVALVISVCGLGVCYAQRKGYFSKETSFQKSNSSSKATTMSENDFKHTKSFII

SEQ ID NO: 42382 - protein, 261 aa, Homo sapiens
  Payload ID: 8622
  Gene Symbol: JAM2
  Gene Name: junctional adhesion molecule 2
  ENSP ID: ENSP00000436801
  MOD_RES (1)..(1): Any amino acid
XAILACKTPKKTVSSRLEWKKLGRSVSFVYYQQTLQGDFKNRAEMIDFNIRIKNVTRSDAGKYRCEVSAPSEQGQNLEEDTVTLEVLVAPAVPSCEVPSSALSGTVVELRCQDKEGNPAPEYTWFKDGIRLLENPRLGSQSTNSSYTMNTKTGTLQFNTVSKLDTGEYSCEARNSVGYRRCPGKRMQVDDLNISGIIAAVVVVALVISVCGLGVCYAQRKGYFSKETSFQSGRPNFGSMGVERRWMTNYLRLWQLGVEKIY

SEQ ID NO: 42383 - protein, 310 aa, Homo sapiens
  Payload ID: 8623
  Gene Symbol: JAM3
  Gene Name: junctional adhesion molecule 3
  Uniprot ID: Q9BX67
  ENSP ID: ENSP00000299106
MALRRPPRLRLCARLPDFFLLLLFRGCLIGAVNLKSSNRTPVVQEFESVELSCIITDSQTSDPRIEWKKIQDEQTTYVFFDNKIQGDLAGRAEILGKTSLKIWNVTRRDSALYRCEVVARNDRKEIDEIVIELTVQVKPVTPVCRVPKAVPVGKMATLHCQESEGHPRPHYSWYRNDVPLPTDSRANPRFRNSSFHLNSETGTLVFTAVHKDDSGQYYCIASNDAGSARCEEQEMEVYDLNIGGIIGGVLVVLAVLALITLGICCAYRRGYFINNKQDGESYKNPGKPDGVNYIRTDEEGDFRHKSSFVI

SEQ ID NO: 42384 - protein, 259 aa, Homo sapiens
  Payload ID: 8623
  Gene Symbol: JAM3
  Gene Name: junctional adhesion molecule 3
  Uniprot ID: Q9BX67
  ENSP ID: ENSP00000395742
MALRRPPRLRLCARLPDFFLLLLFRGCLIGAVNLKSSNRTPVVQEFESVELSCIITDSQTSDPRIEWKKIQDEQTTYVFFDNKIQVKPVTPVCRVPKAVPVGKMATLHCQESEGHPRPHYSWYRNDVPLPTDSRANPRFRNSSFHLNSETGTLVFTAVHKDDSGQYYCIASNDAGSARCEEQEMEVYDLNIGGIIGGVLVVLAVLALITLGICCAYRRGYFINNKQDGESYKNPGKPDGVNYIRTDEEGDFRHKSSFVI

SEQ ID NO: 42385 - protein, 38 aa, Homo sapiens
  Payload ID: 8623
  Gene Symbol: JAM3
  Gene Name: junctional adhesion molecule 3
  ENSP ID: ENSP00000432455
MALRRPPRLRLCARLPDFFLLLLFRESSLVCFPRLHSK

SEQ ID NO: 42386 - protein, 124 aa, Homo sapiens
  Payload ID: 8623
  Gene Symbol: JAM3
  Gene Name: junctional adhesion molecule 3
  ENSP ID: ENSP00000433206
MALRRPPRLRLCARLPDFFLLLLFRGDLAGRAEILGKTSLKIWNVTRRDSALYRCEVVARNDRKEIDEIVIELTVQVKPVTPVCRVPKAVPVGKMATLHCQESEGHPRPHYSWYRNDVPLPTDS

SEQ ID NO: 42387 - protein, 331 aa, Homo sapiens
  Payload ID: 8624
  Gene Symbol: JSRP1
  Gene Name: junctional sarcoplasmic reticulum protein 1
  Uniprot ID: Q96MG2
  ENSP ID: ENSP00000300961
MSMTTRAWEELDGGLGSCQALEDHSALAETQEDRASATPRLADSGSVPHDSQVAEGPSVDTRPKKMEKEPAARGTPGTGKERLKAGASPRSVPARKKAQTAPPLQPPPPPPALSEELPWGDLSLNKCLVLASLVALLGSAFQLCRDAVPGEAALQARVPEPWVPPSSAPREPSSPLPKFEAQAPPSAPPAPRAEAEVRPKIPGSREAAENDEEEPGEATGEAVREDRVTLADRGPKERPRREGKPRKEKPRKEERPKKERPRKEERPRAAREPREALPQRWESREGGHRPWARDSRDAEPRKKQAWVSPRRPDEEQRPGSRQKLRAGKGRD

SEQ ID NO: 42388 - protein, 261 aa, Homo sapiens
  Payload ID: 8624
  Gene Symbol: JSRP1
  Gene Name: junctional sarcoplasmic reticulum protein 1
  ENSP ID: ENSP00000465604
MVRLAWMVALGLSPSFSLAKQWLLRIRCREDFTIRPLGSETRKTSAASLRAAAAARRSQNGASAAARLYRCCAQATPPAPPGTRPHEGQSRGAAGKKSRARPSQRLIGERERERKRLSGDWLPGLGPAAAPAMSMTTRAWEELDGGLGSCQALEDHSALAETQEDRASATPRLADSGSVPHDSQVAEGPSVDTRPKKMEKEPAARGTPGTGKERLKAGASPRSVPARKKAQTAPPLQPPPPPPALSEELPWGDLSLNKCLV

SEQ ID NO: 42389 - protein, 661 aa, Homo sapiens
  Payload ID: 8625
  Gene Symbol: JPH1
  Gene Name: junctophilin 1
  Uniprot ID: Q9HDC5
  ENSP ID: ENSP00000344488
MTGGRFDFDDGGTYCGGWEEGKAHGHGICTGPKGQGEYSGSWSHGFEVVGGYTWPSGNTYQGYWAQGKRHGLGVETKGKWMYRGEWSHGFKGRYGVRQSLCTPARYEGTWSNGLQDGYGVETYGDGGTYQGQWAGGMRHGYGVRQSVPYGMATVIRSPLRTSLASLRSEQSNGSVLHDAAAAADSPAGTRGGFVLNFHADAELAGKKKGGLFRRGSLLGSMKLRKSESKSSISSKRSSVRSDAAMSRISSSDANSTISFGDVDCDFCPVEDHVDATTTETYMGEWKNDKRNGFGVSERSNGMKYEGEWANNKRHGYGCTVFPDGSKEEGKYKNNILVRGIRKQLIPIRHTKTREKVDRAIEGAQRAAAMARTKVEIANSRTAHARAKADAADQAALAARQECDIARAVARELSPDFYQPGPDYVKQRFQEGVDAKENPEEKVPEKPPTPKESPHFYRKGTTPPRSPEASPKHSHSPASSPKPLKKQNPSSGARLNQDKRSVADEQVTAIVNKPLMSKAPTKEAGAVVPQSKYSGRHHIPNPSNGELHSQYHGYYVKLNAPQHPPVDVEDGDGSSQSSSALVHKPSANKWSPSKSVTKPVAKESKAEPKAKKSELAIPKNPASNDSCPALEKEANSGPNSIMIVLVMLLNIGLAILFVHFLT

SEQ ID NO: 42390 - protein, 79 aa, Homo sapiens
  Payload ID: 8625
  Gene Symbol: JPH1
  Gene Name: junctophilin 1
  ENSP ID: ENSP00000429652
MTGGRYLPGPVGRRHAAWLRRAPERALRHGHGDPLTAAYLAGLAAQRAEQWQRAPRRRSRRRQPGRHPRRFRAQLPRRR

SEQ ID NO: 42391 - protein, 129 aa, Homo sapiens
  Payload ID: 8626
  Gene Symbol: JPH2
  Gene Name: junctophilin 2
  Uniprot ID: Q9BR39
  ENSP ID: ENSP00000344590
MSGGRFDFDDGGAYCGGWEGGKAHGHGLCTGPKGQGEYSGSWNFGFEVAGVYTWPSGNTFEGYWSQGKRHGLGIETKGRWLYKGEWTHGFKGRYGIRQSSSSGAKYEGTWNNGLQDGYGTETYADGGMC

SEQ ID NO: 42392 - protein, 696 aa, Homo sapiens
  Payload ID: 8626
  Gene Symbol: JPH2
  Gene Name: junctophilin 2
  Uniprot ID: Q9BR39
  ENSP ID: ENSP00000362071
MSGGRFDFDDGGAYCGGWEGGKAHGHGLCTGPKGQGEYSGSWNFGFEVAGVYTWPSGNTFEGYWSQGKRHGLGIETKGRWLYKGEWTHGFKGRYGIRQSSSSGAKYEGTWNNGLQDGYGTETYADGGTYQGQFTNGMRHGYGVRQSVPYGMAVVVRSPLRTSLSSLRSEHSNGTVAPDSPASPASDGPALPSPAIPRGGFALSLLANAEAAARAPKGGGLFQRGALLGKLRRAESRTSVGSQRSRVSFLKSDLSSGASDAASTASLGEAAEGADEAAPFEADIDATTTETYMGEWKNDKRSGFGVSERSSGLRYEGEWLDNLRHGYGCTTLPDGHREEGKYRHNVLVKDTKRRMLQLKSNKVRQKVEHSVEGAQRAAAIARQKAEIAASRTSHAKAKAEAAEQAALAANQESNIARTLARELAPDFYQPGPEYQKRRLLQEILENSESLLEPPDRGAGAAGLPQPPRESPQLHERETPRPEGGSPSPAGTPPQPKRPRPGVSKDGLLSPGAWNGEPSGEGSRSVTPSEGAGRRSPARPATERMAIEALQAPPAPSREPEVALYQGYHSYAVRTTPPEPPPFEDQPEPEVSGSESAPSSPATAPLQAPTLRGPEPARETPAKLEPKPIIPKAEPRAKARKTEARGLTKAGAKKKARKEAALAAEAEVEVEEVPNTILICMVILLNIGLAILFVHLLT

SEQ ID NO: 42393 - protein, 748 aa, Homo sapiens
  Payload ID: 8627
  Gene Symbol: JPH3
  Gene Name: junctophilin 3
  Uniprot ID: Q8WXH2
  ENSP ID: ENSP00000284262
MSSGGRFNFDDGGSYCGGWEDGKAHGHGVCTGPKGQGEYTGSWSHGFEVLGVYTWPSGNTYQGTWAQGKRHGIGLESKGKWVYKGEWTHGFKGRYGVRECAGNGAKYEGTWSNGLQDGYGTETYSDGGTYQGQWVGGMRQGYGVRQSVPYGMAAVIRSPLRTSINSLRSEHTNGTALHPDASPAVAGSPAVSRGGFVLVAHSDSEILKSKKKGLFRRSLLSGLKLRKSESKSSLASQRSKQSSFRSEAGMSTVSSTASDIHSTISLGEAEAELAVIEDDIDATTTETYVGEWKNDKRSGFGVSQRSDGLKYEGEWASNRRHGYGCMTFPDGTKEEGKYKQNILVGGKRKNLIPLRASKIREKVDRAVEAAERAATIAKQKAEIAASRTSHSRAKAEAALTAAQKAQEEARIARITAKEFSPSFQHRENGLEYQRPKRQTSCDDIEVLSTGTPLQQESPELYRKGTTPSDLTPDDSPLQSFPTSPAATPPPAPAARNKVAHFSRQVSVDEERGGDIQMLLEGRAGDCARSSWGEEQAGGSRGVRSGALRGGLLVDDFRTRGSGRKQPGNPKPRERRTESPPVFTWTSHHRASNHSPGGSRLLELQEEKLSNYRMEMKPLLRMETHPQKRRYSKGGACRGLGDDHRPEDRGFGVQRLRSKAQNKENFRPASSAEPAVQKLASLRLGGAEPRLLRWDLTFSPPQKSLPVALESDEENGDELKSSTGSAPILVVMVILLNIGVAILFINFFI

SEQ ID NO: 42394 - protein, 628 aa, Homo sapiens
  Payload ID: 8628
  Gene Symbol: JPH4
  Gene Name: junctophilin 4
  Uniprot ID: Q96JJ6
  ENSP ID: ENSP00000348648
MSPGGKFDFDDGGCYVGGWEAGRAHGYGVCTGPGAQGEYSGCWAHGFESLGVFTGPGGHSYQGHWQQGKREGLGVERKSRWTYRGEWLGGLKGRSGVWESVSGLRYAGLWKDGFQDGYGTETYSDGGTYQGQWQAGKRHGYGVRQSVPYHQAALLRSPRRTSLDSGHSDPPTPPPPLPLPGDEGGSPASGSRGGFVLAGPGDADGASSRKRTPAAGGFFRRSLLLSGLRAGGRRSSLGSKRGSLRSEVSSEVGSTGPPGSEASGPPAAAPPALIEGSATEVYAGEWRADRRSGFGVSQRSNGLRYEGEWLGNRRHGYGRTTRPDGSREEGKYKRNRLVHGGRVRSLLPLALRRGKVKEKVDRAVEGARRAVSAARQRQEIAAARAADALLKAVAASSVAEKAVEAARMAKLIAQDLQPMLEAPGRRPRQDSEGSDTEPLDEDSPGVYENGLTPSEGSPELPSSPASSRQPWRPPACRSPLPPGGDQGPFSSPKAWPEEWGGAGAQAEELAGYEAEDEAGMQGPGPRDGSPLLGGCSDSSGSLREEEGEDEEPLPPLRAPAGTEPEPIAMLVLRGSSSRGPDAGCLTEELGEPAATERPAQPGAANPLVVGAVALLDLSLAFLFSQLLT

SEQ ID NO: 42395 - protein, 628 aa, Homo sapiens; identical to SEQ ID NO: 42394
  Payload ID: 8628
  Gene Symbol: JPH4
  Gene Name: junctophilin 4
  Uniprot ID: Q96JJ6
  ENSP ID: ENSP00000380307

SEQ ID NO: 42396 - protein, 293 aa, Homo sapiens
  Payload ID: 8628
  Gene Symbol: JPH4
  Gene Name: junctophilin 4
  ENSP ID: ENSP00000439562
MTRHLRLTAEGEREEKTEEASDITGRTEKQQWGRTDQTPRLPAPKEQGRAADALLKAVAASSVAEKAVEAARMAKLIAQDLQPMLEAPGRRPRQDSEGSDTEPLDEDSPGVYENGLTPSEGSPELPSSPASSRQPWRPPACRSPLPPGGDQGPFSSPKAWPEEWGGAGAQAEELAGYEAEDEAGMQGPGPRDGSPLLGGCSDSSGSLREEEGEDEEPLPPLRAPAGTEPEPIAMLVLRGSSSRGPDAGCLTEELGEPAATERPAQPGAANPLVVGAVALLDLSLAFLFSQLLT

SEQ ID NO: 42397 - protein, 629 aa, Homo sapiens [sequence omitted]

SEQ ID NO: 42398 - protein, 837 aa, Homo sapiens
  Payload ID: 8629
  Gene Symbol: KAT2A
  Gene Name: K(lysine) acetyltransferase 2A
  Uniprot ID: Q92830
  ENSP ID: ENSP00000225916
MAEPSQAPTPAPAAQPRPLQSPAPAPTPTPAPSPASAPIPTPTPAPAPAPAAAPAGSTGTGGPGVGSGGAGSGGDPARPGLSQQQRASQRKAQVRGLPRAKKLEKLGVFSACKANETCKCNGWKNPKPPTAPRMDLQQPAANLSELCRSCEHPLADHVSHLENVSEDEINRLLGMVVDVENLFMSVHKEEDTDTKQVYFYLFKLLRKCILQMTRPVVEGSLGSPPFEKPNIEQGVLNFVQYKFSHLAPRERQTMFELSKMFLLCLNYWKLETPAQFRQRSQAEDVATYKVNYTRWLCYCHVPQSCDSLPRYETTHVFGRSLLRSIFTVTRRQLLEKFRVEKDKLVPEKRTLILTHFPKFLSMLEEEIYGANSPIWESGFTMPPSEGTQLVPRPASVSAAVVPSTPIFSPSMGGGSNSSLSLDSAGAEPMPGEKRTLPENLTLEDAKRLRVMGDIPMELVNEVMLTITDPAAMLGPETSLLSANAARDETARLEERRGIIEFHVIGNSLTPKANRRVLLWLVGLQNVFSHQLPRMPKEYIARLVFDPKHKTLALIKDGRVIGGICFRMFPTQGFTEIVFCAVTSNEQVKGYGTHLMNHLKEYHIKHNILYFLTYADEYAIGYFKKQGFSKDIKVPKSRYLGYIKDYEGATLMECELNPRIPYTELSHIIKKQKEIIKKLIERKQAQIRKVYPGLSCFKEGVRQIPVESVPGIRETGWKPLGKEKGKELKDPDQLYTTLKNLLAQIKSHPSAWPFMEPVKKSEAPDYYEVIRFPIDLKTMTERLRSRYYVTRKLFVADLQRVIANCREYNPPDSEYCRCASALEKFFYFKLKEGGLIDK

SEQ ID NO: 42399 - protein, 70 aa, Homo sapiens
  Payload ID: 8629
  Gene Symbol: KAT2A
  Gene Name: K(lysine) acetyltransferase 2A
  ENSP ID: ENSP00000467324
GYGTHLMNHLKEYHIKHNILYFLTYADEYAIGYFKKQGFSKDIKVPKSRYLGYIKDYEGATLMEYHQEAD

SEQ ID NO: 42400 - protein, 276 aa, Homo sapiens
  Payload ID: 8629
  Gene Symbol: KAT2A
  Gene Name: K(lysine) acetyltransferase 2A
  ENSP ID: ENSP00000468390
QQQRASQRKAQVRGLPRAKKLEKLGVFSACKANETCKCNGWKNPKPPTAPRMDLQQPAANLSELCRSCEHPLADHVSHLENVSEDEINRLLGMVVDVENLFMSVHKEEDTDTKQVYFYLFKLLRKCILQMTRPVVEGSLGSPPFEKPNIEQGVLNFVQYKFSHLAPRERQTMFELSKMFLLCLNYWKLETPAQFRQRSQAEDVATYKVNYTRWLCYCHVPQSCDSLPRYETTHVFGRSLLRSIFTVTRRQLLEKFRVEKDKLVPEKRTLILTHFPK

SEQ ID NO: 42401 - protein, 832 aa, Homo sapiens
  Payload ID: 8630
  Gene Symbol: KAT2B
  Gene Name: K(lysine) acetyltransferase 2B
  Uniprot ID: Q92831
  ENSP ID: ENSP00000263754
MSEAGGAGPGGCGAGAGAGAGPGALPPQPAALPPAPPQGSPCAAAAGGSGACGPATAVAAAGTAEGPGGGGSARIAVKKAQLRSAPRAKKLEKLGVYSACKAEESCKCNGWKNPNPSPTPPRADLQQIIVSLTESCRSCSHALAAHVSHLENVSEEEMNRLLGIVLDVEYLFTCVHKEEDADTKQVYFYLFKLLRKSILQRGKPVVEGSLEKKPPFEKPSIEQGVNNFVQYKFSHLPAKERQTIVELAKMFLNRINYWHLEAPSQRRLRSPNDDISGYKENYTRWLCYCNVPQFCDSLPRYETTQVFGRTLLRSVFTVMRRQLLEQARQEKDKLPLEKRTLILTHFPKFLSMLEEEVYSQNSPIWDQDFLSASSRTSQLGIQTVINPPPVAGTISYNSTSSSLEQPNAGSSSPACKASSGLEANPGEKRKMTDSHVLEEAKKPRVMGDIPMELINEVMSTITDPAAMLGPETNFLSAHSARDEAARLEERRGVIEFHVVGNSLNQKPNKKILMWLVGLQNVFSHQLPRMPKEYITRLVFDPKHKTLALIKDGRVIGGICFRMFPSQGFTEIVFCAVTSNEQVKGYGTHLMNHLKEYHIKHDILNFLTYADEYAIGYFKKQGFSKEIKIPKTKYVGYIKDYEGATLMGCELNPRIPYTEFSVIIKKQKEIIKKLIERKQAQIRKVYPGLSCFKDGVRQIPIESIPGIRETGWKPSGKEKSKEPRDPDQLYSTLKSILQQVKSHQSAWPFMEPVKRTEAPGYYEVIRFPMDLKTMSERLKNRYYVSKKLFMADLQRVFTNCKEYNPPESEYYKCANILEKFFFSKIKEAGLIDK

SEQ ID NO: 42402 - protein, 546 aa, Homo sapiens
  Payload ID: 8631
  Gene Symbol: KAT5
  Gene Name: K(lysine) acetyltransferase 5
  Uniprot ID: Q92993
  ENSP ID: ENSP00000340330
MAEVVSPVPGAGRREPGEVGRARGPPVADPGVALSPQGEIIEGCRLPVLRRNQDNEDEWPLAEILSVKDISGRKLFYVHYIDFNKRLDEWVTHERLDLKKIQFPKKEAKTPTKNGLPGSRPGSPEREVPASAQASGKTLPIPVQITLRFNLPKEREAIPGGEPDQPLSSSSCLQPNHRSTKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 42403 - protein, 461 aa, Homo sapiens
  Payload ID: 8631
  Gene Symbol: KAT5
  Gene Name: K(lysine) acetyltransferase 5
  Uniprot ID: Q92993
  ENSP ID: ENSP00000344955
MAEVGEIIEGCRLPVLRRNQDNEDEWPLAEILSVKDISGRKLFYVHYIDFNKRLDEWVTHERLDLKKIQFPKKEAKTPTKNGLPGSRPGSPEREVKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 42404 - protein, 513 aa, Homo sapiens
  Payload ID: 8631
  Gene Symbol: KAT5
  Gene Name: K(lysine) acetyltransferase 5
  Uniprot ID: Q92993
  ENSP ID: ENSP00000366245
MAEVGEIIEGCRLPVLRRNQDNEDEWPLAEILSVKDISGRKLFYVHYIDFNKRLDEWVTHERLDLKKIQFPKKEAKTPTKNGLPGSRPGSPEREVPASAQASGKTLPIPVQITLRFNLPKEREAIPGGEPDQPLSSSSCLQPNHRSTKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 42405 - protein, 302 aa, Homo sapiens
  Payload ID: 8631
  Gene Symbol: KAT5
  Gene Name: K(lysine) acetyltransferase 5
  ENSP ID: ENSP00000431819
MTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 42406 - protein, 494 aa, Homo sapiens
  Payload ID: 8631
  Gene Symbol: KAT5
  Gene Name: K(lysine) acetyltransferase 5
  Uniprot ID: Q92993
  ENSP ID: ENSP00000434765
MAEVVSPVPGAGRREPGEVGRARGPPVADPGVALSPQGEIIEGCRLPVLRRNQDNEDEWPLAEILSVKDISGRKLFYVHYIDFNKRLDEWVTHERLDLKKIQFPKKEAKTPTKNGLPGSRPGSPEREVKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 42407 - protein, 45 aa, Homo sapiens
  Payload ID: 8631
  Gene Symbol: KAT5
  Gene Name: K(lysine) acetyltransferase 5
  ENSP ID: ENSP00000434993
MTGSLVSDRSHDDIVTRMKNIECIELGRHRLKPWYFSPYPQELTT

SEQ ID NO: 42408 - protein, 95 aa, Homo sapiens
  Payload ID: 8631
  Gene Symbol: KAT5
  Gene Name: K(lysine) acetyltransferase 5
  ENSP ID: ENSP00000435766
  MOD_RES (1)..(1): Any amino acid
XAEVGERGEATDHHQVSLALSTWGEISEITSIKKEDVISTLQYLNLINYYKGQYILTLSEDIVDGHERAMLKRLLRIDSKCLHFTPKDWSKRGKW

SEQ ID NO: 42409 - protein, 16 aa, Homo sapiens
  Payload ID: 8631
  Gene Symbol: KAT5
  Gene Name: K(lysine) acetyltransferase 5
  ENSP ID: ENSP00000435939
MTGSLVSDRSHDDIVT

SEQ ID NO: 42410 - protein, 189 aa, Homo sapiens
  Payload ID: 8631
  Gene Symbol: KAT5
  Gene Name: K(lysine) acetyltransferase 5
  ENSP ID: ENSP00000436000
MGRARRRYFDEGAWLLAAPRALAEILSVKDISGRKLFYVHYIDFNKRLDEWVTHERLDLKKIQFPKKEAKTPTKNGLPGSRPGSPEREVKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYF

SEQ ID NO: 42411 - protein, 269 aa, Homo sapiens
  Payload ID: 8631
  Gene Symbol: KAT5
  Gene Name: K(lysine) acetyltransferase 5
  ENSP ID: ENSP00000436012
MGRARRRYFDEGAWLLAAPRALAEILSVKDISGRKLFYVHYIDFNKRLDEWVTHERLDLKKIQFPKKEAKTPTKNGLPGSRPGSPEREVPASAQASGKTLPIPVQITLRFNLPKEREAIPGGEPDQPLSSSSCLQPNHRSTKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKC

SEQ ID NO: 42412 - protein, 167 aa, Homo sapiens
  Payload ID: 8631
  Gene Symbol: KAT5
  Gene Name: K(lysine) acetyltransferase 5
  ENSP ID: ENSP00000436247
  MOD_RES (1)..(1): Any amino acid
XGEIIEGCRLPVLRRNQDNEDEWPLAEILSVKDISGRKLFYVHYIDFNKRLDEWVTHERLDLKKIQFPKKEAKTPTKNGLPGSRPGSPEREPASAQASGKTLPIPVQITLRFNLPKEREAIPGGEPDQPLSSSSCLQPNHRSTKRKVEVVSPATPVPSETAPASVFP

SEQ ID NO: 42413 - protein, 2004 aa, Homo sapiens
  Payload ID: 8632
  Gene Symbol: KAT6A
  Gene Name: K(lysine) acetyltransferase 6A
  Uniprot ID: Q92794
  ENSP ID: ENSP00000265713
MVKLANPLYTEWILEAIKKVKKQKQRPSEERICNAVSSSHGLDRKTVLEQLELSVKDGTILKVSNKGLNSYKDPDNPGRIALPKPRNHGKLDNKQNVDWNKLIKRAVEGLAESGGSTLKSIERFLKGQKDVSALFGGSAASGFHQQLRLAIKRAIGHGRLLKDGPLYRLNTKATNVDGKESCESLSCLPPVSLLPHEKDKPVAEPIPICSFCLGTKEQNREKKPEELISCADCGNSGHPSCLKFSPELTVRVKALRWQCIECKTCSSCRDQGKNADNMLFCDSCDRGFHMECCDPPLTRMPKGMWICQICRPRKKGRKLLQKKAAQIKRRYTNPIGRPKNRLKKQNTVSKGPFSKVRTGPGRGRKRKITLSSQSASSSSEEGYLERIDGLDFCRDSNVSLKFNKKTKGLIDGLTKFFTPSPDGRKARGEVVDYSEQYRIRKRGNRKSSTSDWPTDNQDGWDGKQENEERLFGSQEIMTEKDMELFRDIQEQALQKVGVTGPPDPQVRCPSVIEFGKYEIHTWYSSPYPQEYSRLPKLYLCEFCLKYMKSRTILQQHMKKCGWFHPPANEIYRKNNISVFEVDGNVSTIYCQNLCLLAKLFLDHKTLYYDVEPFLFYVLTQNDVKGCHLVGYFSKEKHCQQKYNVSCIMILPQYQRKGYGRFLIDFSYLLSKREGQAGSPEKPLSDLGRLSYMAYWKSVILECLYHQNDKQISIKKLSKLTGICPQDITSTLHHLRMLDFRSDQFVIIRREKLIQDHMAKLQLNLRPVDVDPECLRWTPVIVSNSVVSEEEEEEAEEGENEEPQCQERELEISVGKSVSHENKEQDSYSVESEKKPEVMAPVSSTRLSKQVLPHDSLPANSQPSRRGRWGRKNRKTQERFGDKDSKLLLEETSSAPQEQYGECGEKSEATQEQYTESEEQLVASEEQPSQDGKPDLPKRRLSEGVEPWRGQLKKSPEALKCRLTEGSERLPRRYSEGDRAVLRGFSESSEEEEEPESPRSSSPPILTKPTLKRKKPFLHRRRRVRKRKHHNSSVVTETISETTEVLDEPFEDSDSERPMPRLEPTFEIDEEEEEEDENELFPREYFRRLSSQDVLRCQSSSKRKSKDEEEDEESDDADDTPILKPVSLLRKRDVKNSPLEPDTSTPLKKKKGWPKGKSRKPIHWKKRPGRKPGFKLSREIMPVSTQACVIEPIVSIPKAGRKPKIQESEETVEPKEDMPLPEERKEEEEMQAEAEEAEEGEEEDAASSEVPAASPADSSNSPETETKEPEVEEEEEKPRVSEEQRQSEEEQQELEEPEPEEEEDAAAETAQNDDHDADDEDDGHLESTKKKELEEQPTREDVKEEPGVQESFLDANMQKSREKIKDKEETELDSEEEQPSHDTSVVSEQMAGSEDDHEEDSHTKEELIELKEEEEIPHSELDLETVQAVQSLTQEESSEHEGAYQDCEETLAACQTLQSYTQADEDPQMSMVEDCHASEHNSPISSVQSHPSQSVRSVSSPNVPALESGYTQISPEQGSLSAPSMQNMETSPMMDVPSVSDHSQQVVDSGFSDLGSIESTTENYENPSSYDSTMGGSICGNSSSQSSCSYGGLSSSSSLTQSSCVVTQQMASMGSSCSMMQQSSVQPAANCSIKSPQSCVVERPPSNQQQQPPPPPPQQPQPPPPQPQPAPQPPPPQQQPQQQPQPQPQQPPPPPPPQQQPPLSQCSMNNSFTPAPMIMEIPESGSTGNISIYERIPGDFGAGSYSQPSATFSLAKLQQLTNTIMDPHAMPYSHSPAVTSYATSVSLSNTGLAQLAPSHPLAGTPQAQATMTPPPNLASTTMNLTSPLLQCNMSATNIGIPHTQRLQGQMPVKGHISIRSKSAPLPSAAAHQQQLYGRSPSAVAMQAGPRALAVQRGMNMGVNLMPTPAYNVNSMNMNTLNAMNSYRMTQPMMNSSYHSNPAYMNQTAQYPMQMQMGMMGSQAYTQQPMQPNPHGNMMYTGPSHHSYMNAAGVPKQSLNGPYMRR

SEQ ID NO: 42414 - protein, 2004 aa, Homo sapiens; identical to SEQ ID NO: 42413
  Payload ID: 8632
  Gene Symbol: KAT6A
  Gene Name: K(lysine) acetyltransferase 6A
  Uniprot ID: Q92794
  ENSP ID: ENSP00000380136

SEQ ID NO: 42415 - protein, 2004 aa, Homo sapiens; identical to SEQ ID NO: 42413
  Payload ID: 8632
  Gene Symbol: KAT6A
  Gene Name: K(lysine) acetyltransferase 6A
  Uniprot ID: Q92794
  ENSP ID: ENSP00000385888

SEQ ID NO: 42416 - protein, 13 aa, Homo sapiens
  Payload ID: 8632
  Gene Symbol: KAT6A
  Gene Name: K(lysine) acetyltransferase 6A
  ENSP ID: ENSP00000396699
MVKLANPLYTEWI

SEQ ID NO: 42417 - protein, 728 aa, Homo sapiens
  Payload ID: 8632
  Gene Symbol: KAT6A
  Gene Name: K(lysine) acetyltransferase 6A
  ENSP ID: ENSP00000399638
MSACAGTFHGAKVKGGCGQRGTYHRSHSGQTCAVVVMCKQLYWNWISTFTSGIRLEEQRAADGKTLKQQTVPQQKVGVTGPPDPQVRCPSVIEFGKYEIHTWYSSPYPQEYSRLPKLYLCEFCLKYMKSRTILQQHMKKCGWFHPPANEIYRKNNISVFEVDGNVSTIYCQNLCLLAKLFLDHKTLYYDVEPFLFYVLTQNDVKGCHLVGYFSKEKHCQQKYNVSCIMILPQYQRKGYGRFLIDFSYLLSKREGQAGSPEKPLSDLGRLSYMAYWKSVILECLYHQNDKQISIKKLSKLTGICPQDITSTLHHLRMLDFRSDQFVIIRREKLIQDHMAKLQLNLRPVDVDPECLRWTPVIVSNSVVSEEEEEEAEEGENEEPQCQERELEISVGKSVSHENKEQDSYSVESEKKPEVMAPVSSTRLSKQVLPHDSLPANSQPSRRGRWGRKNRKTQERFGDKDSKLLLEETSSAPQEQYGECGEKSEATQEQYTESEEQLVASEEQPSQDGKPDLPKRRLSEGVEPWRGQLKKSPEALKCRLTEGSERLPRRYSEGDRAVLRGFSESSEEEEEPESPRSSSPPILTKPTLKRKKPFLHRRRRVRKRKHHNSSVVTETISETTEVLDEPFEDSDSERPMPRLEPTFEIDEEEEEEDENELFPREYFRRLSSQDVLRCQSSSKRKSKDEEEDEESDDADDTPILKPVSLLRKRDVKNSPLEPDTSTPLKK

SEQ ID NO: 42418 - protein, 815 aa, Homo sapiens
  Payload ID: 8632
  Gene Symbol: KAT6A
  Gene Name: K(lysine) acetyltransferase 6A
  ENSP ID: ENSP00000430606
MVKLANPLYTEWILEAIKKVKKQKQRPSEERICNAVSSSHGLDRKTVLEQLELSVKDGTILKVSNKGLNSYKDPDNPGRIALPKPRNHGKLDNKQNVDWNKLIKRAVEGLAESGGSTLKSIERFLKGQKDVSALFGGSAASGFHQQLRLAIKRAIGHGRLLKDGPLYRLNTKATNVDGKESCESLSCLPPVSLLPHEKDKPVAEPIPICSFCLGTKEQNREKKPEELISCADCGNSGHPSCLKFSPELTVRVKALRWQCIECKTCSSCRDQGKNADNMLFCDSCDRGFHMECCDPPLTRMPKGMWICQICRPRKKGRKLLQKKAAQIKRRYTNPIGRPKNRLKKQNTVSKGPFSKVRTGPGRGRKRKITLSSQSASSSSEEGYLERIDGLDFCRDSNVSLKFNKKTKGLIDGLTKFFTPSPDGRKARGEVVDYSEQYRIRKRGNRKSSTSDWPTDNQDGWDGKQENEERLFGSQEIMTEKDMELFRDIQEQALQKVGVTGPPDPQVRCPSVIEFGKYEIHTWYSSPYPQEYSRLPKLYLCEFCLKYMKSRTILQQHMKKCGWFHPPANEIYRKNNISVFEVDGNVSTIYCQNLCLLAKLFLDHKTLYYDVEPFLFYVLTQNDVKGCHLVGYFSKEKHCQQKYNVSCIMILPQYQRKGYGRFLIDFSYLLSKREGQAGSPEKPLSDLGRLSYMAYWKSVILECLYHQNDKQISIKKLSKLTGICPQDITSTLHHLRMLDFRSDQFVIIRREKLIQDHMAKLQLNLRPVDVDPECLRWTPVIVSNSVVSEEEEEEAEEGENEEPQCQERELEISVRA

SEQ ID NO: 42419 - protein, 2073 aa, Homo sapiens
  Payload ID: 8633
  Gene Symbol: KAT6B
  Gene Name: K(lysine) acetyltransferase 6B
  Uniprot ID: Q8WYB5
  ENSP ID: ENSP00000287239
MVKLANPLYTEWILEAIQKIKKQKQRPSEERICHAVSTSHGLDKKTVSEQLELSVQDGSVLKVTNKGLASYKDPDNPGRFSSVKPGTFPKSAKGSRGSCNDLRNVDWNKLLRRAIEGLEEPNGSSLKNIEKYLRSQSDLTSTTNNPAFQQRLRLGAKRAVNNGRLLKDGPQYRVNYGSLDGKGAPQYPSAFPSSLPPVSLLPHEKDQPRADPIPICSFCLGTKESNREKKPEELLSCADCGSSGHPSCLKFCPELTTNVKALRWQCIECKTCSACRVQGRNADNMLFCDSCDRGFHMECCDPPLSRMPKGMWICQVCRPKKKGRKLLHEKAAQIKRRYAKPIGRPKNKLKQRLLSVTSDEGSMNAFTGRGSPGRGQKTKVCTTPSSGHAASGKDSSSRLAVTDPTRPGATTKITTTSTYISASTLKVNKKTKGLIDGLTKFFTPSPDGRRSRGEIIDFSKHYRPRKKVSQKQSCTSHVLATGTTQKLKPPPSSLPPPTPISGQSPSSQKSSTATSSPSPQSSSSQCSVPSLSSLTTNSQLKALFDGLSHIYTTQGQSRKKGHPSYAPPKRMRRKTELSSTAKSKAHFFGKRDIRSRFISHSSSSSWGMARGSIFKAIAHFKRTTFLKKHRMLGRLKYKVTPQMGTPSPGKGSLTDGRIKPDQDDDTEIKINIKQESADVNVIGNKDVVTEEDLDVFKQAQELSWEKIECESGVEDCGRYPSVIEFGKYEIQTWYSSPYPQEYARLPKLYLCEFCLKYMKSKNILLRHSKKCGWFHPPANEIYRRKDLSVFEVDGNMSKIYCQNLCLLAKLFLDHKTLYYDVEPFLFYVLTKNDEKGCHLVGYFSKEKLCQQKYNVSCIMIMPQHQRQGFGRFLIDFSYLLSRREGQAGSPEKPLSDLGRLSYLAYWKSVILEYLYHHHERHISIKAISRATGMCPHDIATTLQHLHMIDKRDGRFVIIRREKLILSHMEKLKTCSRANELDPDSLRWTPILISNAAVSEEEREAEKEAERLMEQASCWEKEEQEILSTRANSRQSPAKVQSKNKYLHSPESRPVTGERGQLLELSKESSEEEEEEEDEEEEEEEEEEEEDEEEEEEEEEEEEEENIQSSPPRLTKPQSVAIKRKRPFVLKKKRGRKRRRINSSVTTETISETTEVLNEPFDNSDEERPMPQLEPTCEIEVEEDGRKPVLRKAFQHQPGKKRQTEEEEGKDNHCFKNADPCRNNMNDDSSNLKEGSKDNPEPLKCKQVWPKGTKRGLSKWRQNKERKTGFKLNLYTPPETPMEPDEQVTVEEQKETSEGKTSPSPIRIEEEVKETGEALLPQEENRREETCAPVSPNTSPGEKPEDDLIKPEEEEEEEEEEEEEEEEEEGEEEEGGGNVEKDPDGAKSQEKEEPEISTEKEDSARLDDHEEEEEEDEEPSHNEDHDADDEDDSHMESAEVEKEELPRESFKEVLENQETFLDLNVQPGHSNPEVLMDCGVDLTASCNSEPKELAGDPEAVPESDEEPPPGEQAQKQDQKNSKEVDTEFKEGNPATMEIDSETVQAVQSLTQESSEQDDTFQDCAETQEACRSLQNYTRADQSPQIATTLDDCQQSDHSSPVSSVHSHPGQSVRSVNSPSVPALENSYAQISPDQSAISVPSLQNMETSPMMDVPSVSDHSQQVVDSGFSDLGSIESTTENYENPSSYDSTMGGSICGNGSSQNSCSYSNLTSSSLTQSSCAVTQQMSNISGSCSMLQQTSISSPPTCSVKSPQGCVVERPPSSSQQLAQCSMAANFTPPMQLAEIPETSNANIGLYERMGQSDFGAGHYPQPSATFSLAKLQQLTNTLIDHSLPYSHSAAVTSYANSASLSTPLSNTGLVQLSQSPHSVPGGPQAQATMTPPPNLTPPPMNLPPPLLQRNMAASNIGISHSQRLQTQIASKGHISMRTKSASLSPAAATHQSQIYGRSQTVAMQGPARTLTMQRGMNMSVNLMPAPAYNVNSVNMNMNTLNAMNGYSMSQPMMNSGYHSNHGYMNQTPQYPMQMQMGMMGTQPYAQQPMQTPPHGNMMYTAPGHHGYMNTGMSKQSLNGSYMRR

SEQ ID NO: 42420 - protein, 1890 aa, Homo sapiens
  Payload ID: 8633
  Gene Symbol: KAT6B
  Gene Name: K(lysine) acetyltransferase 6B
  Uniprot ID: Q8WYB5
  ENSP ID: ENSP00000361796
MVKLANPLYTEWILEAIQKIKKQKQRPSEERICHAVSTSHGLDKKTVSEQLELSVQDGSVLKVTNKGLASYKDPDNPGRFSSVKPGTFPKSAKGSRGSCNDLRNVDWNKLLRRAIEGLEEPNGSSLKNIEKYLRSQSDLTSTTNNPAFQQRLRLGAKRAVNNGRLLKDGPQYRVNYGSLDGKGAPQYPSAFPSSLPPVSLLPHEKDQPRADPIPICSFCLGTKESNREKKPEELLSCADCGSSGHPSCLKFCPELTTNVKALRWQCIECKTCSACRVQGRNADNMLFCDSCDRGFHMECCDPPLSRMPKGMWICQVCRPKKKGRKLLHEKAAQIKRRYAKPIGRPKNKLKQRLLSVTSDEGSMNAFTGRGSPGRGQKTKVCTTPSSGHAASGKDSSSRLAVTDPTRPGATTKITTTSTYISASTLKVNKKTKGLIDGLTKFFTPSPDGRRSRGEIIDFSKHYRPRKKVSQKQSCTSHVLATDTEIKINIKQESADVNVIGNKDVVTEEDLDVFKQAQELSWEKIECESGVEDCGRYPSVIEFGKYEIQTWYSSPYPQEYARLPKLYLCEFCLKYMKSKNILLRHSKKCGWFHPPANEIYRRKDLSVFEVDGNMSKIYCQNLCLLAKLFLDHKTLYYDVEPFLFYVLTKNDEKGCHLVGYFSKEKLCQQKYNVSCIMIMPQHQRQGFGRFLIDFSYLLSRREGQAGSPEKPLSDLGRLSYLAYWKSVILEYLYHHHERHISIKAISRATGMCPHDIATTLQHLHMIDKRDGRFVIIRREKLILSHMEKLKTCSRANELDPDSLRWTPILISNAAVSEEEREAEKEAERLMEQASCWEKEEQEILSTRANSRQSPAKVQSKNKYLHSPESRPVTGERGQLLELSKESSEEEEEEEDEEEEEEEEEEEEDEEEEEEEEEEEEEENIQSSPPRLTKPQSVAIKRKRPFVLKKKRGRKRRRINSSVTTETISETTEVLNEPFDNSDEERPMPQLEPTCEIEVEEDGRKPVLRKAFQHQPGKKRQTEEEEGKDNHCFKNADPCRNNMNDDSSNLKEGSKDNPEPLKCKQVWPKGTKRGLSKWRQNKERKTGFKLNLYTPPETPMEPDEQVTVEEQKETSEGKTSPSPIRIEEEVKETGEALLPQEENRREETCAPVSPNTSPGEKPEDDLIKPEEEEEEEEEEEEEEEEEEGEEEEGGGNVEKDPDGAKSQEKEEPEISTEKEDSARLDDHEEEEEEDEEPSHNEDHDADDEDDSHMESAEVEKEELPRESFKEVLENQETFLDLNVQPGHSNPEVLMDCGVDLTASCNSEPKELAGDPEAVPESDEEPPPGEQAQKQDQKNSKEVDTEFKEGNPATMEIDSETVQAVQSLTQESSEQDDTFQDCAETQEACRSLQNYTRADQSPQIATTLDDCQQSDHSSPVSSVHSHPGQSVRSVNSPSVPALENSYAQISPDQSAISVPSLQNMETSPMMDVPSVSDHSQQVVDSGFSDLGSIESTTENYENPSSYDSTMGGSICGNGSSQNSCSYSNLTSSSLTQSSCAVTQQMSNISGSCSMLQQTSISSPPTCSVKSPQGCVVERPPSSSQQLAQCSMAANFTPPMQLAEIPETSNANIGLYERMGQSDFGAGHYPQPSATFSLAKLQQLTNTLIDHSLPYSHSAAVTSYANSASLSTPLSNTGLVQLSQSPHSVPGGPQAQATMTPPPNLTPPPMNLPPPLLQRNMAASNIGISHSQRLQTQIASKGHISMRTKSASLSPAAATHQSQIYGRSQTVAMQGPARTLTMQRGMNMSVNLMPAPAYNVNSVNMNMNTLNAMNGYSMSQPMMNSGYHSNHGYMNQTPQYPMQMQMGMMGTQPYAQQPMQTPPHGNMMYTAPGHHGYMNTGMSKQSLNGSYMRR

SEQ ID NO: 42421 - protein, 1781 aa, Homo sapiens
  Payload ID: 8633
  Gene Symbol: KAT6B
  Gene Name: K(lysine) acetyltransferase 6B
  Uniprot ID: Q8WYB5
  ENSP ID: ENSP00000361799
MVKLANPLYTEWILEAIQKIKKQKQRPSEERICHAVSTSHGLDKKTVSEQLELSVQDGSVLKVTNKGLASYKDPDNPGRFSSVKPGTFPKSAKGSRGSCNDLRNVDWNKLLRRAIEGLEEPNGSSLKNIEKYLRSQSDLTSTTNNPAFQQRLRLGAKRAVNNGRLLKDGPQYRVNYGSLDGKGAPQYPSAFPSSLPPVSLLPHEKDQPRADPIPICSFCLGTKESNREKKPEELLSCADCGSSGHPSCLKFCPELTTNVKALRWQCIECKTCSACRVQGRNADNMLFCDSCDRGFHMECCDPPLSRMPKGMWICQVCRPKKKGRKLLHEKAAQIKRRYAKPIGRPKNKLKQRLLSVTSDEGSMNAFTGRGSPDTEIKINIKQESADVNVIGNKDVVTEEDLDVFKQAQELSWEKIECESGVEDCGRYPSVIEFGKYEIQTWYSSPYPQEYARLPKLYLCEFCLKYMKSKNILLRHSKKCGWFHPPANEIYRRKDLSVFEVDGNMSKIYCQNLCLLAKLFLDHKTLYYDVEPFLFYVLTKNDEKGCHLVGYFSKEKLCQQKYNVSCIMIMPQHQRQGFGRFLIDFSYLLSRREGQAGSPEKPLSDLGRLSYLAYWKSVILEYLYHHHERHISIKAISRATGMCPHDIATTLQHLHMIDKRDGRFVIIRREKLILSHMEKLKTCSRANELDPDSLRWTPILISNAAVSEEEREAEKEAERLMEQASCWEKEEQEILSTRANSRQSPAKVQSKNKYLHSPESRPVTGERGQLLELSKESSEEEEEEEDEEEEEEEEEEEEDEEEEEEEEEEEEEENIQSSPPRLTKPQSVAIKRKRPFVLKKKRGRKRRRINSSVTTETISETTEVLNEPFDNSDEERPMPQLEPTCEIEVEEDGRKPVLRKAFQHQPGKKRQTEEEEGKDNHCFKNADPCRNNMNDDSSNLKEGSKDNPEPLKCKQVWPKGTKRGLSKWRQNKERKTGFKLNLYTPPETPMEPDEQVTVEEQKETSEGKTSPSPIRIEEEVKETGEALLPQEENRREETCAPVSPNTSPGEKPEDDLIKPEEEEEEEEEEEEEEEEEEGEEEEGGGNVEKDPDGAKSQEKEEPEISTEKEDSARLDDHEEEEEEDEEPSHNEDHDADDEDDSHMESAEVEKEELPRESFKEVLENQETFLDLNVQPGHSNPEVLMDCGVDLTASCNSEPKELAGDPEAVPESDEEPPPGEQAQKQDQKNSKEVDTEFKEGNPATMEIDSETVQAVQSLTQESSEQDDTFQDCAETQEACRSLQNYTRADQSPQIATTLDDCQQSDHSSPVSSVHSHPGQSVRSVNSPSVPALENSYAQISPDQSAISVPSLQNMETSPMMDVPSVSDHSQQVVDSGFSDLGSIESTTENYENPSSYDSTMGGSICGNGSSQNSCSYSNLTSSSLTQSSCAVTQQMSNISGSCSMLQQTSISSPPTCSVKSPQGCVVERPPSSSQQLAQCSMAANFTPPMQLAEIPETSNANIGLYERMGQSDFGAGHYPQPSATFSLAKLQQLTNTLIDHSLPYSHSAAVTSYANSASLSTPLSNTGLVQLSQSPHSVPGGPQAQATMTPPPNLTPPPMNLPPPLLQRNMAASNIGISHSQRLQTQIASKGHISMRTKSASLSPAAATHQSQIYGRSQTVAMQGPARTLTMQRGMNMSVNLMPAPAYNVNSVNMNMNTLNAMNGYSMSQPMMNSGYHSNHGYMNQTPQYPMQMQMGMMGTQPYAQQPMQTPPHGNMMYTAPGHHGYMNTGMSKQSLNGSYMRR

SEQ ID NO: 42422 - protein, 1781 aa, Homo sapiens; identical to SEQ ID NO: 42421
  Payload ID: 8633
  Gene Symbol: KAT6B
  Gene Name: K(lysine) acetyltransferase 6B
  Uniprot ID: Q8WYB5
  ENSP ID: ENSP00000361809

SEQ ID NO: 42423 - protein, 1781 aa, Homo sapiens; identical to SEQ ID NO: 42421
  Payload ID: 8633
  Gene Symbol: KAT6B
  Gene Name: K(lysine) acetyltransferase 6B
  Uniprot ID: Q8WYB5
  ENSP ID: ENSP00000361810

SEQ ID NO: 42424 - protein, 1781 aa, Homo sapiens; identical to SEQ ID NO: 42421
  Payload ID: 8633
  Gene Symbol: KAT6B
  Gene Name: K(lysine) acetyltransferase 6B
  ENSP ID: ENSP00000485896

SEQ ID NO: 42425 - protein, 2073 aa, Homo sapiens; identical to SEQ ID NO: 42419
  Payload ID: 8633
  Gene Symbol: KAT6B
  Gene Name: K(lysine) acetyltransferase 6B
  ENSP ID: ENSP00000486595

SEQ ID NO: 42426 - protein, 1890 aa, Homo sapiens; identical to SEQ ID NO: 42420
  Payload ID: 8633
  Gene Symbol: KAT6B
  Gene Name: K(lysine) acetyltransferase 6B
  ENSP ID: ENSP00000486731

SEQ ID NO: 42427 - protein, 1781 aa, Homo sapiens; identical to SEQ ID NO: 42421
  Payload ID: 8633
  Gene Symbol: KAT6B
  Gene Name: K(lysine) acetyltransferase 6B
  ENSP ID: ENSP00000487219

SEQ ID NO: 42428 - protein, 1781 aa, Homo sapiens; identical to SEQ ID NO: 42421
  Payload ID: 8633
  Gene Symbol: KAT6B
  Gene Name: K(lysine) acetyltransferase 6B
  ENSP ID: ENSP00000487238

SEQ ID NO: 42429 - protein, 611 aa, Homo sapiens
  Payload ID: 8634
  Gene Symbol: KAT7
  Gene Name: K(lysine) acetyltransferase 7
  Uniprot ID: O95251
  ENSP ID: ENSP00000259021
MPRRKRNAGSSSDGTEDSDFSTDLEHTDSSESDGTSRRSARVTRSSARLSQSSQDSSPVRNLQSFGTEEPAYSTRRVTRSQQQPTPVTPKKYPLRQTRSSGSETEQVVDFSDRETKNTADHDESPPRTPTGNAPSSESDIDISSPNVSHDESIAKDMSLKDSGSDLSHRPKRRRFHESYNFNMKCPTPGCNSLGHLTGKHERHFSISGCPLYHNLSADECKVRAQSRDKQIEERMLSHRQDDNNRHATRHQAPTERQLRYKEKVAELRKKRNSGLSKEQKEKYMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 42430 - protein, 581 aa, Homo sapiens
  Payload ID: 8634
  Gene Symbol: KAT7
  Gene Name: K(lysine) acetyltransferase 7
  Uniprot ID: O95251
  ENSP ID: ENSP00000398961
MPRRKRNAGSSSDGTEDSDFSTDLEHTDSSESDGTSRRSARVTRSSARLSQSSQDSSPVRNLQSFGTEEPAYSTRRVTRSQQQPTPVTPKKYPLRQTRSSGSETEQVVDFSDRETKNTADHDESPPRTPTGNAPSSESDIDISSPNVSHDESIAKDMSLKDSGSDLSHRPKRRRFHESYNFNMKCPTPGCNSLGHLTGKHERHFSISGCPLYHNLSADECKAPTERQLRYKEKVAELRKKRNSGLSKEQKEKYMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 42431 - protein, 425 aa, Homo sapiens
  Payload ID: 8634
  Gene Symbol: KAT7
  Gene Name: K(lysine) acetyltransferase 7
  ENSP ID: ENSP00000409477
MSLKDSGSDLSHRPKRRRFHESYNFNMKCPTPGCNSLGHLTGKHERHFSISGCPLYHNLSADECKAPTERQLRYKEKVAELRKKRNSGLSKEQKEKYMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 42432 - protein, 472 aa, Homo sapiens
  Payload ID: 8634
  Gene Symbol: KAT7
  Gene Name: K(lysine) acetyltransferase 7
  Uniprot ID: O95251
  ENSP ID: ENSP00000413415
MPRRKRNAGSSSDGTEDSDFSTDLEHTDSSESDGTSRRSARVTRSSARLSQSSQGHLTGKHERHFSISGCPLYHNLSADECKVRAQSRDKQIEERMLSHRQDDNNRHATRHQAPTERQLRYKEKVAELRKKRNSGLSKEQKEKYMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 42433 - protein, 16 aa, Homo sapiens
  Payload ID: 8634
  Gene Symbol: KAT7
  Gene Name: K(lysine) acetyltransferase 7
  ENSP ID: ENSP00000421368
MSLKDSGSDLSHRPKR

SEQ ID NO: 42434 - protein, 442 aa, Homo sapiens
  Payload ID: 8634
  Gene Symbol: KAT7
  Gene Name: K(lysine) acetyltransferase 7
  Uniprot ID: O95251
  ENSP ID: ENSP00000423385
MPRRKRNAGSSSDGTEDSDFSTDLEHTDSSESDGTSRRSARVTRSSARLSQSSQGHLTGKHERHFSISGCPLYHNLSADECKAPTERQLRYKEKVAELRKKRNSGLSKEQKEKYMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 42435 - protein, 501 aa, Homo sapiens
  Payload ID: 8634
  Gene Symbol: KAT7
  Gene Name: K(lysine) acetyltransferase 7
  Uniprot ID: O95251
  ENSP ID: ENSP00000424577
MPRRKRNAGSSSDGTEDSDFSTDLEHTDSSESDGTSRRSARVTRSSARLSQSSQDSSPVRNLQSFGTEEPAYSTRRVTRSQQQPTPVTPKKYPLRQTRSSGSETEQVVDFSDRGHLTGKHERHFSISGCPLYHNLSADECKAPTERQLRYKEKVAELRKKRNSGLSKEQKEKYMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 42436 - protein, 458 aa, Homo sapiens
  Payload ID: 8635
  Gene Symbol: KAT8
  Gene Name: K(lysine) acetyltransferase 8
  Uniprot ID: Q9H7Z6
  ENSP ID: ENSP00000219797
MAAQGAAAAVAAGTSGVAGEGEPGPGENAAAEGTAPSPGRVSPPTPARGEPEVTVEIGETYLCRRPDSTWHSAEVIQSRVNDQEGREEFYVHYVGFNRRLDEWVDKNRLALTKTVKDAVQKNSEKYLSELAEQPERKITRNQKRKHDEINHVQKTYAEMDPTTAALEKEHEAITKVKYVDKIHIGNYEIDAWYFSPFPEDYGKQPKLWLCEYCLKYMKYEKSYRFHLGQCQWRQPPGKEIYRKSNISVYEVDGKDHKIYCQNLCLLAKLFLDHKTLYFDVEPFVFYILTEVDRQGAHIVGYFSKEKESPDGNNVACILTLPPYQRRGYGKFLIAFSYELSKLESTVGSPEKPLSDLGKLSYRSYWSWVLLEILRDFRGTLSIKDLSQMTSITQNDIISTLQSLNMVKYWKGQHVICVTPKLVEEHLKSAQYKKPPITVDSVCLKWAPPKHKQVKLSKK

SEQ ID NO: 42437 - protein, 467 aa, Homo sapiens
  Payload ID: 8635
  Gene Symbol: KAT8
  Gene Name: K(lysine) acetyltransferase 8
  Uniprot ID: Q9H7Z6
  ENSP ID: ENSP00000406037
MAAQGAAAAVAAGTSGVAGEGEPGPGENAAAEGTAPSPGRVSPPTPARGEPEVTVEIGETYLCRRPDSTWHSAEVIQSRVNDQEGREEFYVHYVGFNRRLDEWVDKNRLALTKTVKDAVQKNSEKYLSELAEQPERKITRNQKRKHDEINHVQKTYAEMDPTTAALEKEHEAITKVKYVDKIHIGNYEIDAWYFSPFPEDYGKQPKLWLCEYCLKYMKYEKSYRFHLGQCQWRQPPGKEIYRKSNISVYEVDGKDHKIYCQNLCLLAKLFLDHKTLYFDVEPFVFYILTEVDRQGAHIVGYFSKEKESPDGNNVACILTLPPYQRRGYGKFLIAFSYELSKLESTVGSPEKPLSDLGKLSYRSYWSWVLLEILRDFRGTLSIKDLSQMTSITQNDIISTLQSLNMVKYWKGQHVICVTPKLVEEHLKSAQYKKPPITGGWGAAVCRGRWGSVSIWTGRSQGLLIAVT

SEQ ID NO: 42438 - protein, 187 aa, Homo sapiens
  Payload ID: 8635
  Gene Symbol: KAT8
  Gene Name: K(lysine) acetyltransferase 8
  ENSP ID: ENSP00000454592
  MOD_RES (1)..(1): Any amino acid
XYGKQPKLWLCEYCLKYMKYEKSYRFHLGQCQWRQPPGKEIYRKSNISVYEVDGKDHKIYCQNLCLLAKLFLDHKTLYFDVEPFVFYILTEVDRQGAHIVGYFSKEKESPDGNNVACILTLPPYQRRGYGKFLIAFSYELSKLESTVGSPEKPLSDLGKLSYRSYWSWVLLEILRDFRGTLSIKDLR

SEQ ID NO: 42439 - protein, 458 aa, Homo sapiens; identical to SEQ ID NO: 42436
  Payload ID: 8635
  Gene Symbol: KAT8
  Gene Name: K(lysine) acetyltransferase 8
  Uniprot ID: Q9H7Z6
  ENSP ID: ENSP00000456933

SEQ ID NO: 42440 - protein, 1663 aa, Homo sapiens
  Payload ID: 8636
  Gene Symbol: KALRN
  Gene Name: kalirin, RhoGEF kinase
  Uniprot ID: O60229
  ENSP ID: ENSP00000240874
MTDRFWDQWYLWYLRLLRLLDRGSFRNDGLKASDVLPILKEKVAFVSGGRDKRGGPILTFPARSNHDRIRQEDLRKLVTYLASVPSEDVCKRGFTVIIDMRGSKWDLIKPLLKTLQEAFPAEIHVALIIKPDNFWQKQKTNFGSSKFIFETSMVSVEGLTKLVDPSQLTEEFDGSLDYNHEEWIELRLSLEEFFNSAVHLLSRLEDLQEMLARKEFPVDVEGSRRLIDEHTQLKKKVLKAPVEELDREGQRLLQCIRCSDGFSGRNCIPGSADFQSLVPKITSLLDKLHSTRQHLHQMWHVRKLKLDQCFQLRLFEQDAEKMFDWISHNKELFLQSHTEIGVSYQYALDLQTQHNHFAMNSMNAYVNINRIMSVASRLSEAGHYASQQIKQISTQLDQEWKSFAAALDERSTILAMSAVFHQKAEQFLSGVDAWCKMCSEGGLPSEMQDLELAIHHHQTLYEQVTQAYTEVSQDGKALLDVLQRPLSPGNSESLTATANYSKAVHQVLDVVHEVLHHQRRLESIWQHRKVRLHQRLQLCVFQQDVQQVLDWIENHGEAFLSKHTGVGKSLHRARALQKRHDDFEEVAQNTYTNADKLLEAAEQLAQTGECDPEEIYKAARHLEVRIQDFVRRVEQRKLLLDMSVSFHTHTKELWTWMEDLQKEMLEDVCADSVDAVQELIKQFQQQQTATLDATLNVIKEGEDLIQQLRSAPPSLGEPSEARDSAVSNNKTPHSSSISHIESVLQQLDDAQVQMEELFHERKIKLDIFLQLRIFEQYTIEVTAELDAWNEDLLRQMNDFNTEDLTLAEQRLQRHTERKLAMNNMTFEVIQQGQDLHQYITEVQASGIELICEKDIDLAAQVQELLEFLHEKQHELELNAEQTHKRLEQCLQLRHLQAEVKQVLGWIRNGESMLNASLVNASSLSEAEQLQREHEQFQLAIESLFHATSLQKTHQSALQVQQKAEVLLQAGHYDADAIRECAEKVALHWQQLMLKMEDRLKLVNASVAFYKTSEQVCSVLESLEQEYRRDEDWCGGRDKLGPAAEIDHVIPLISKHLEQKEAFLKACTLARRNAEVFLKYIHRNNVSMPSVASHTRGPEQQVKAILSELLQRENRVLHFWTLKKRRLDQCQQYVVFERSAKQALDWIQETGEFYLSTHTSTGETTEETQELLKEYGEFRVPAKQTKEKVKLLIQLADSFVEKGHIHATEIRKWVTTVDKHYRDFSLRMGKYRYSLEKALGVNTEDNKDLELDIIPASLSDREVKLRDANHEVNEEKRKSARKKEFIMAELLQTEKAYVRDLHECLETYLWEMTSGVEEIPPGILNKEHIIFGNIQEIYDFHNNIFLKELEKYEQLPEDVGHCFVTWADKFQMYVTYCKNKPDSNQLILEHAGTFFDEIQQRHGLANSISSYLIKPVQRITKYQLLLKELLTCCEEGKGELKDGLEVMLSVPKKANDAMHVSMLEGFDENLDVQGELILQDAFQVWDPKSLIRKGRERHLFLFEISLVFSKEIKDSSGHTKYVYKNKLLTSELGVTEHVEGDPCKFALWSGRTPSSDNKTVLKASNIETKQEWIKNIREVIQERIIHLKGALKEPLQLPKTPAKQRNNSKRDGVEDIDSQGDGSSQPDTISIASRTSQNTVDSDKDGNLVPRWHLGPGDPFSTYV

SEQ ID NO: 42441 - protein, 1289 aa, Homo sapiens
  Payload ID: 8636
  Gene Symbol: KALRN
  Gene Name: kalirin, RhoGEF kinase
  Uniprot ID: O60229
  ENSP ID: ENSP00000291478
MKGGDRAYTRGPSLGWLFAKCCCCFPCRDAYSHSSSENGGKSESVANLQAQPSLNSIHSSPGPKRSTNTLKKWLTSPVRRLNSGKADGNIKKQKKVRDGRKSFDLGSPKPGDETTPQGDSADEKSKKGWGEDEPDEESHTPLPPPMKIFDNDPTQDEMSSSLLAARQASTEVPTAADLVNAIEKLVKNKLSLEGSSYRGSLKDPAGCLNEGMAPPTPPKNPEEEQKAKALRGRMFVLNELVQTEKDYVKDLGIVVEGFMKRIEEKGVPEDMRGKDKIVFGNIHQIYDWHKDFFLAELEKCIQEQDRLAQLFIKHERKLHIYVWYCQNKPRSEYIVAEYDAYFEEVKQEINQRLTLSDFLIKPIQRITKYQLLLKDFLRYSEKAGLECSDIEKAVELMCLVPKRCNDMMNLGRLQGFEGTLTAQGKLLQQDTFYVIELDAGMQSRTKERRVFLFEQIVIFSELLRKGSLTPGYMFKRSIKMNYLVLEENVDNDPCKFALMNRETSERVVLQAANADIQQAWVQDINQVLETQRDFLNALQSPIEYQRKERSTAVMRSQPARLPQASPRPYSSVPAGSEKPPKGSSYNPPLPPLKISTSNGSPGFEYHQPGDKFEASKQNDLGGCNGTSSMAVIKDYYALKENEICVSQGEVVQVLAVNQQNMCLVYQPASDHSPAAEGWVPGSILAPLTKATAAESSDGSIKKSCSWHTLRMRKRAEVENTGKNEATGPRKPKDILGNKVSVKETNSSEESECDDLDPNTSMEILNPNFIQEVAPEFLVPLVDVTCLLGDTVILQCKVCGRPKPTITWKGPDQNILDTDNSSATYTVSSCDSGEITLKICNLMPQDSGIYTCIATNDHGTTSTSATVKVQGVPAAPNRPIAQERSCTSVILRWLPPSSTGNCTISGYTVEYREEGSQIWQQSVASTLDTYLVIEDLSPGCPYQFRVSASNPWGISLPSEPSEFVRLPEYDAAADGATISWKENFDSAYTELNEIGRGRFSIVKKCIHKATRKDVAVKFVSKKMKKKEQAAHEAALLQHLQHPQYITLHDTYESPTSYILILELMDDGRLLDYLMNHDELMEEKVAFYIRDIMEALQYLHNCRVAHLDIKPENLLIDLRIPVPRVKLIDLEDAVQISGHFHIHHLLGNPEFAAPEVIQGIPVSLGTDIWSIGVLTYVMLSGVSPFLDESKEETCINVCRVDFSFPHEYFCGVSNAARDFINVILQEDFRRRPTAATCLQHPWLQPHNGSYSKIPLDTSRLACFIERRKHQNDVRPIPNVKSYIVNRVNQGT

SEQ ID NO: 42442 - protein, 2955 aa, Homo sapiens
  Payload ID: 8636
  Gene Symbol: KALRN
  Gene Name: kalirin, RhoGEF kinase
  ENSP ID: ENSP00000346122
  MOD_RES (1)..(1): Any amino acid
XSFRNDGLKASDVLPILKEKVAFVSGGRDKRGGPILTFPARSNHDRIRQEDLRKLVTYLASVPSEDVCKRGFTVIIDMRGSKWDLIKPLLKTLQEAFPAEIHVALIIKPDNFWQKQKTNFGSSKFIFETSMVSVEGLTKLVDPSQLTEEFDGSLDYNHEEWIELRLSLEEFFNSAVHLLSRLEDLQEMLARKEFPVDVEGSRRLIDEHTQLKKKVLKAPVEELDREGQRLLQCIRCSDGFSGRNCIPGSADFQSLVPKITSLLDKLHSTRQHLHQMWHVRKLKLDQCFQLRLFEQDAEKMFDWISHNKELFLQSHTEIGVSYQYALDLQTQHNHFAMNSMNAYVNINRIMSVASRLSEAGHYASQQIKQISTQLDQEWKSFAAALDERSTILAMSAVFHQKAEQFLSGVDAWCKMCSEGGLPSEMQDLELAIHHHQTLYEQVTQAYTEVSQDGKALLDVLQRPLSPGNSESLTATANYSKAVHQVLDVVHEVLHHQRRLESIWQHRKVRLHQRLQLCVFQQDVQQVLDWIENHGEAFLSKHTGVGKSLHRARALQKRHDDFEEVAQNTYTNADKLLEAAEQLAQTGECDPEEIYKAARHLEVRIQDFVRRVEQRKLLLDMSVSFHTHTKELWTWMEDLQKEMLEDVCADSVDAVQELIKQFQQQQTATLDATLNVIKEGEDLIQQLRSAPPSLGEPSEARDSAVSNNKTPHSSSISHIESVLQQLDDAQVQMEELFHERKIKLDIFLQLRIFEQYTIEVTAELDAWNEDLLRQMNDFNTEDLTLAEQRLQRHTERKLAMNNMTFEVIQQGQDLHQYITEVQASGIELICEKDIDLAAQVQELLEFLHEKQHELELNAEQTHKRLEQCLQLRHLQAEVKQVLGWIRNGESMLNASLVNASSLSEAEQLQREHEQFQLAIEKTHQSALQVQQKAEVLLQAGHYDADAIRECAEKVALHWQQLMLKMEDRLKLVNASVAFYKTSEQVCSVLESLEQEYRRDEDWCGGRDKLGPAAEIDHVIPLISKHLEQKEAFLKACTLARRNAEVFLKYIHRNNVSMPSVASHTRGPEQQVKAILSELLQRENRVLHFWTLKKRRLDQCQQYVVFERSAKQALDWIQETGEFYLSTHTSTGETTEETQELLKEYGEFRVPAKQTKEKVKLLIQLADSFVEKGHIHATEIRKWVTTVDKHYRDFSLRMGKYRYSLEKALGVNTEDNKDLELDIIPASLSDREVKLRDANHEVNEEKRKSARKKEFIMAELLQTEKAYVRDLHECLETYLWEMTSGVEEIPPGILNKEHIIFGNIQEIYDFHNNIFLKELEKYEQLPEDVGHCFVTWADKFQMYVTYCKNKPDSNQLILEHAGTFFDEIQQRHGLANSISSYLIKPVQRITKYQLLLKELLTCCEEGKGELKDGLEVMLSVPKKANDAMHVSMLEGFDENLDVQGELILQDAFQVWDPKSLIRKGRERHLFLFEISLVFSKEIKDSSGHTKYVYKNKLLTSELGVTEHVEGDPCKFALWSGRTPSSDNKTVLKASNIETKQEWIKNIREVIQERIIHLKGALKEPLQLPKTPAKQRNNSKRDGVEDIDSQGDGSSQPDTISIASRTSQNTVDSDKLSGGCELTVVLQDFSAGHSSELTIQVGQTVELLERPSERPGWCLVRTTERSPPLEGLVPSSALCISHSRSSVEMDCFFPLVKDAYSHSSSENGGKSESVANLQAQPSLNSIHSSPGPKRSTNTLKKWLTSPVRRLNSGKADGNIKKQKKVRDGRKSFDLGSPKPGDETTPQGDSADEKSKKGWGEDEPDEESHTPLPPPMKIFDNDPTQDEMSSSLLAARQASTEVPTAADLVNAIEKLVKNKLSLEGSSYRGSLKDPAGCLNEGMAPPTPPKNPEEEQKAKALRGRMFVLNELVQTEKDYVKDLGIVVEGFMKRIEEKGVPEDMRGKDKIVFGNIHQIYDWHKDFFLAELEKCIQEQDRLAQLFIKHERKLHIYVWYCQNKPRSEYIVAEYDAYFEEVKQEINQRLTLSDFLIKPIQRITKYQLLLKDFLRYSEKAGLECSDIEKAVELMCLVPKRCNDMMNLGRLQGFEGTLTAQGKLLQQDTFYVIELDAGMQSRTKERRVFLFEQIVIFSELLRKGSLTPGYMFKRSIKMNYLVLEENVDNDPCKFALMNRETSERVVLQAANADIQQAWVQDINQVLETQRDFLNALQSPIEYQRKERSTAVMRSQPARLPQASPRPYSSVPAGSEKPPKGSSYNPPLPPLKISTSNGSPGFEYHQPGDKFEASKQNDLGGCNGTSSMAVIKDYYALKENEICVSQGEVVQVLAVNQQNMCLVYQPASDHSPAAEGWVPGSILAPLTKATAAESSDGSIKKSCSWHTLRMRKRAEVENTGKNEATGPRKPKDILGNKVSVKETNSSEESECDDLDPNTSMEILNPNFIQEVAPEFLVPLVDVTCLLGDTVILQCKVCGRPKPTITWKGPDQNILDTDNSSATYTVSSCDSGEITLKICNLMPQDSGIYTCIATNDHGTTSTSATVKVQGVPAAPNRPIAQERSCTSVILRWLPPSSTGNCTISGYTVEYREEGSQIWQQSVASTLDTYLVIEDLSPGCPYQFRVSASNPWGISLPSEPSEFVRLPEYDAAADGATISWKENFDSAYTELNEIGRGRFSIVKKCIHKATRKDVAVKFVSKKMKKKEQAAHEAALLQHLQHPQYITLHDTYESPTSYILILELMDDGRLLDYLMNHDELMEEKVAFYIRDIMEALQYLHNCRVAHLDIKPENLLIDLRIPVPRVKLIDLEDAVQISGHFHIHHLLGNPEFAAPEVIQGIPVSLGTDIWSIGVLTYVMLSGVSPFLDESKEETCINVCRVDFSFPHEYFCGVSNAARDFINVILQEDFRRRPTAATCLQHPWLQPHNGSYSKIPLDTSRLACFIERRKHQNDVRPIPNVKSYIVNRVNQGT

SEQ ID NO: 42443 - protein, 2986 aa, Homo sapiens
  Payload ID: 8636
  Gene Symbol: KALRN
  Gene Name: kalirin, RhoGEF kinase
  ENSP ID: ENSP00000353109
MTDRFWDQWYLWYLRLLRLLDRGSFRNDGLKASDVLPILKEKVAFVSGGRDKRGGPILTFPARSNHDRIRQEDLRKLVTYLASVPSEDVCKRGFTVIIDMRGSKWDLIKPLLKTLQEAFPAEIHVALIIKPDNFWQKQKTNFGSSKFIFETSMVSVEGLTKLVDPSQLTEEFDGSLDYNHEEWIELRLSLEEFFNSAVHLLSRLEDLQEMLARKEFPVDVEGSRRLIDEHTQLKKKVLKAPVEELDREGQRLLQCIRCSDGFSGRNCIPGSADFQSLVPKITSLLDKLHSTRQHLHQMWHVRKLKLDQCFQLRLFEQDAEKMFDWISHNKELFLQSHTEIGVSYQYALDLQTQHNHFAMNSMNAYVNINRIMSVASRLSEAGHYASQQIKQISTQLDQEWKSFAAALDERSTILAMSAVFHQKAEQFLSGVDAWCKMCSEGGLPSEMQDLELAIHHHQTLYEQVTQAYTEVSQDGKALLDVLQRPLSPGNSESLTATANYSKAVHQVLDVVHEVLHHQRRLESIWQHRKVRLHQRLQLCVFQQDVQQVLDWIENHGEAFLSKHTGVGKSLHRARALQKRHDDFEEVAQNTYTNADKLLEAAEQLAQTGECDPEEIYKAARHLEVRIQDFVRRVEQRKLLLDMSVSFHTHTKELWTWMEDLQKEMLEDVCADSVDAVQELIKQFQQQQTATLDATLNVIKEGEDLIQQLRSAPPSLGEPSEARDSAVSNNKTPHSSSISHIESVLQQLDDAQVQMEELFHERKIKLDIFLQLRIFEQYTIEVTAELDAWNEDLLRQMNDFNTEDLTLAEQRLQRHTERKLAMNNMTFEVIQQGQDLHQYITEVQASGIELICEKDIDLAAQVQELLEFLHEKQHELELNAEQTHKRLEQCLQLRHLQAEVKQVLGWIRNGESMLNASLVNASSLSEAEQLQREHEQFQLAIESLFHATSLQKTHQSALQVQQKAEVLLQAGHYDADAIRECAEKVALHWQQLMLKMEDRLKLVNASVAFYKTSEQVCSVLESLEQEYRRDEDWCGGRDKLGPAAEIDHVIPLISKHLEQKEAFLKACTLARRNAEVFLKYIHRNNVSMPSVASHTRGPEQQVKAILSELLQRENRVLHFWTLKKRRLDQCQQYVVFERSAKQALDWIQETGEFYLSTHTSTGETTEETQELLKEYGEFRVPAKQTKEKVKLLIQLADSFVEKGHIHATEIRKWVTTVDKHYRDFSLRMGKYRYSLEKALGVNTEDNKDLELDIIPASLSDREVKLRDANHEVNEEKRKSARKKEFIMAELLQTEKAYVRDLHECLETYLWEMTSGVEEIPPGILNKEHIIFGNIQEIYDFHNNIFLKELEKYEQLPEDVGHCFVTWADKFQMYVTYCKNKPDSNQLILEHAGTFFDEIQQRHGLANSISSYLIKPVQRITKYQLLLKELLTCCEEGKGELKDGLEVMLSVPKKANDAMHVSMLEGFDENLDVQGELILQDAFQVWDPKSLIRKGRERHLFLFEISLVFSKEIKDSSGHTKYVYKNKLLTSELGVTEHVEGDPCKFALWSGRTPSSDNKTVLKASNIETKQEWIKNIREVIQERIIHLKGALKEPLQLPKTPAKQRNNSKRDGVEDIDSQGDGSSQPDTISIASRTSQNTVDSDKLSGGCELTVVLQDFSAGHSSELTIQVGQTVELLERPSERPGWCLVRTTERSPPLEGLVPSSALCISHSRSSVEMDCFFPLVKDAYSHSSSENGGKSESVANLQAQPSLNSIHSSPGPKRSTNTLKKWLTSPVRRLNSGKADGNIKKQKKVRDGRKSFDLGSPKPGDETTPQGDSADEKSKKGWGEDEPDEESHTPLPPPMKIFDNDPTQDEMSSSLLAARQASTEVPTAADLVNAIEKLVKNKLSLEGSSYRGSLKDPAGCLNEGMAPPTPPKNPEEEQKAKALRGRMFVLNELVQTEKDYVKDLGIVVEGFMKRIEEKGVPEDMRGKDKIVFGNIHQIYDWHKDFFLAELEKCIQEQDRLAQLFIKHERKLHIYVWYCQNKPRSEYIVAEYDAYFEEVKQEINQRLTLSDFLIKPIQRITKYQLLLKDFLRYSEKAGLECSDIEKAVELMCLVPKRCNDMMNLGRLQGFEGTLTAQGKLLQQDTFYVIELDAGMQSRTKERRVFLFEQIVIFSELLRKGSLTPGYMFKRSIKMNYLVLEENVDNDPCKFALMNRETSERVVLQAANADIQQAWVQDINQVLETQRDFLNALQSPIEYQRKERSTAVMRSQPARLPQASPRPYSSVPAGSEKPPKGSSYNPPLPPLKISTSNGSPGFEYHQPGDKFEASKQNDLGGCNGTSSMAVIKDYYALKENEICVSQGEVVQVLAVNQQNMCLVYQPASDHSPAAEGWVPGSILAPLTKATAAESSDGSIKKSCSWHTLRMRKRAEVENTGKNEATGPRKPKDILGNKVSVKETNSSEESECDDLDPNTSMEILNPNFIQEVAPEFLVPLVDVTCLLGDTVILQCKVCGRPKPTITWKGPDQNILDTDNSSATYTVSSCDSGEITLKICNLMPQDSGIYTCIATNDHGTTSTSATVKVQGVPAAPNRPIAQERSCTSVILRWLPPSSTGNCTISGYTVEYREEGSQIWQQSVASTLDTYLVIEDLSPGCPYQFRVSASNPWGISLPSEPSEFVRLPEYDAAADGATISWKENFDSAYTELNEIGRGRFSIVKKCIHKATRKDVAVKFVSKKMKKKEQAAHEAALLQHLQHPQYITLHDTYESPTSYILILELMDDGRLLDYLMNHDELMEEKVAFYIRDIMEALQYLHNCRVAHLDIKPENLLIDLRIPVPRVKLIDLEDAVQISGHFHIHHLLGNPEFAAPEVIQGIPVSLGTDIWSIGVLTYVMLSGVSPFLDESKEETCINVCRVDFSFPHEYFCGVSNAARDFINVILQEDFRRRPTAATCLQHPWLQPHNGSYSKIPLDTSRLACFIERRKHQNDVRPIPNVKSYIVNRVNQGT

SEQ ID NO: 42444 - protein, 268 aa, Homo sapiens
  Payload ID: 8636
  Gene Symbol: KALRN
  Gene Name: kalirin, RhoGEF kinase
  ENSP ID: ENSP00000395236
  MOD_RES (1)..(1): Any amino acid
XCILCCQCSCCQNWIQPIVPDKIRATSMENITSSIFDVISKGKVAPTFSYWSFRNDGLKASDVLPILKEKVAFVSGGRDKRGGPILTFPARSNHDRIRQEDLRKLVTYLASVPSEDVCKRGFTVIIDMRGSKWDLIKPLLKTLQEAFPAEIHVALIIKPDNFWQKQKTNFGSSKFIFETSMVSVEGLTKLVDPSQLTEEFDGSLDYNHEEWIELRLSLEEFFNSAVHLLSRLEDLQEMLARKEFPVDVEGSRRLIDEHTQLKKKVLKA

SEQ ID NO: 42445 - protein, 194 aa, Homo sapiens
  Payload ID: 8636
  Gene Symbol: KALRN
  Gene Name: kalirin, RhoGEF kinase
  ENSP ID: ENSP00000400064
MKGGDRAYTRGPSLGWLFAKCCCCFPCRDAYSHSSSENGGKSESVANLQAQPSLNSIHSSPGPKRSTNTLKKWLTSPVRRLNSGKADGNIKKQKKVRDGRKSFDLGSPKPGDETTPQGDSADEKSKKGWGEDEPDEESHTPLPPPMKIFDNDPTQDEMSLEGSSYRGSLKDPAGCLNEGMAPPTPPKNPEEEQK

SEQ ID NO: 42446 - protein, 215 aa, Homo sapiens
  Payload ID: 8636
  Gene Symbol: KALRN
  Gene Name: kalirin, RhoGEF kinase
  ENSP ID: ENSP00000402950
WQHRKVRLHQRLQLCVFQQDVQQVLDWIENHGEAFLSKHTGVGKSLHRARALQKRHDDFEEVAQNTYTNADKLLEAAEQLAQTGECDPEEIYKAARHLEVRIQDFVRRVEQRKLLLDMSVSFHTHTKELWTWMEDLQKEMLEDVCADSVDAVQELIKQFQQQQTATLDATLNVIKEGEDLIQQLRSAPPSLGEPSEARSAWAELSSGKCLGLDVR

SEQ ID NO: 42447 - protein, 1654 aa, Homo sapiens
  Payload ID: 8636
  Gene Symbol: KALRN
  Gene Name: kalirin, RhoGEF kinase
  ENSP ID: ENSP00000418611
MTDRFWDQWYLWYLRLLRLLDRGSFRNDGLKASDVLPILKEKVAFVSGGRDKRGGPILTFPARSNHDRIRQEDLRKLVTYLASVPSEDVCKRGFTVIIDMRGSKWDLIKPLLKTLQEAFPAEIHVALIIKPDNFWQKQKTNFGSSKFIFETSMVSVEGLTKLVDPSQLTEEFDGSLDYNHEEWIELRLSLEEFFNSAVHLLSRLEDLQEMLARKEFPVDVEGSRRLIDEHTQLKKKVLKAPVEELDREGQRLLQCIRCSDGFSGRNCIPGSADFQSLVPKITSLLDKLHSTRQHLHQMWHVRKLKLDQCFQLRLFEQDAEKMFDWISHNKELFLQSHTEIGVSYQYALDLQTQHNHFAMNSMNAYVNINRIMSVASRLSEAGHYASQQIKQISTQLDQEWKSFAAALDERSTILAMSAVFHQKAEQFLSGVDAWCKMCSEGGLPSEMQDLELAIHHHQTLYEQVTQAYTEVSQDGKALLDVLQRPLSPGNSESLTATANYSKAVHQVLDVVHEVLHHQRRLESIWQHRKVRLHQRLQLCVFQQDVQQVLDWIENHGEAFLSKHTGVGKSLHRARALQKRHDDFEEVAQNTYTNADKLLEAAEQLAQTGECDPEEIYKAARHLEVRIQDFVRRVEQRKLLLDMSVSFHTHTKELWTWMEDLQKEMLEDVCADSVDAVQELIKQFQQQQTATLDATLNVIKEGEDLIQQLRSAPPSLGEPSEARDSAVSNNKTPHSSSISHIESVLQQLDDAQVQMEELFHERKIKLDIFLQLRIFEQYTIEVTAELDAWNEDLLRQMNDFNTEDLTLAEQRLQRHTERKLAMNNMTFEVIQQGQDLHQYITEVQASGIELICEKDIDLAAQVQELLEFLHEKQHELELNAEQTHKRLEQCLQLRHLQAEVKQVLGWIRNGESMLNASLVNASSLSEAEQLQREHEQFQLAIEKTHQSALQVQQKAEVLLQAGHYDADAIRECAEKVALHWQQLMLKMEDRLKLVNASVAFYKTSEQVCSVLESLEQEYRRDEDWCGGRDKLGPAAEIDHVIPLISKHLEQKEAFLKACTLARRNAEVFLKYIHRNNVSMPSVASHTRGPEQQVKAILSELLQRENRVLHFWTLKKRRLDQCQQYVVFERSAKQALDWIQETGEFYLSTHTSTGETTEETQELLKEYGEFRVPAKQTKEKVKLLIQLADSFVEKGHIHATEIRKWVTTVDKHYRDFSLRMGKYRYSLEKALGVNTEDNKDLELDIIPASLSDREVKLRDANHEVNEEKRKSARKKEFIMAELLQTEKAYVRDLHECLETYLWEMTSGVEEIPPGILNKEHIIFGNIQEIYDFHNNIFLKELEKYEQLPEDVGHCFVTWADKFQMYVTYCKNKPDSNQLILEHAGTFFDEIQQRHGLANSISSYLIKPVQRITKYQLLLKELLTCCEEGKGELKDGLEVMLSVPKKANDAMHVSMLEGFDENLDVQGELILQDAFQVWDPKSLIRKGRERHLFLFEISLVFSKEIKDSSGHTKYVYKNKLLTSELGVTEHVEGDPCKFALWSGRTPSSDNKTVLKASNIETKQEWIKNIREVIQERIIHLKGALKEPLQLPKTPAKQRNNSKRDGVEDIDSQGDGSSQPDTISIASRTSQNTVDSDKDGNLVPRWHLGPGDPFSTYV

SEQ ID NO: 42448 - protein, 53 aa, Homo sapiens
  Payload ID: 8636
  Gene Symbol: KALRN
  Gene Name: kalirin, RhoGEF kinase
  ENSP ID: ENSP00000487487
MTDRFWDQWYLWYLRLLRLLDRVPSMLLQMTGFPFYRLSLHSVDCFPCCAEAF

SEQ ID NO: 42449 - protein, 262 aa, Homo sapiens
  Payload ID: 8637
  Gene Symbol: KLK1
  Gene Name: kallikrein 1
  Uniprot ID: P06870
  ENSP ID: ENSP00000301420
MWFLVLCLALSLGGTGAAPPIQSRIVGGWECEQHSQPWQAALYHFSTFQCGGILVHRQWVLTAAHCISDNYQLWLGRHNLFDDENTAQFVHVSESFPHPGFNMSLLENHTRQADEDYSHDLMLLRLTEPADTITDAVKVVELPTEEPEVGSTCLASGWGSIEPENFSFPDDLQCVDLKILPNDECKKAHVQKVTDFMLCVGHLEGGKDTCVGDSGGPLMCDGVLQGVTSWGYVPCGTPNKPSVAVRVLSYVKWIEDTIAENS

SEQ ID NO: 42450 - protein, 56 aa, Homo sapiens
  Payload ID: 8637
  Gene Symbol: KLK1
  Gene Name: kallikrein 1
  ENSP ID: ENSP00000472939
MWFLVLCLALSLGGTALVFWNPTPRILNAFSASASALASPKIASKRTPYPSSTLRP

SEQ ID NO: 42451 - protein, 638 aa, Homo sapiens
  Payload ID: 8638
  Gene Symbol: KLKB1
  Gene Name: kallikrein B, plasma (Fletcher factor) 1
  Uniprot ID: P03952
  ENSP ID: ENSP00000264690
MILFKQATYFISLFATVSCGCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 42452 - protein, 148 aa, Homo sapiens
  Payload ID: 8638
  Gene Symbol: KLKB1
  Gene Name: kallikrein B, plasma (Fletcher factor) 1
  ENSP ID: ENSP00000412366
MILFKQATYFISLFATVSCGCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQ

SEQ ID NO: 42453 - protein, 141 aa, Homo sapiens
  Payload ID: 8638
  Gene Symbol: KLKB1
  Gene Name: kallikrein B, plasma (Fletcher factor) 1
  ENSP ID: ENSP00000415563
MYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQFFSYATQTFHKAEYRNNCLLKYSPGGTPTAI

SEQ ID NO: 42454 - protein, 514 aa, Homo sapiens
  Payload ID: 8638
  Gene Symbol: KLKB1
  Gene Name: kallikrein B, plasma (Fletcher factor) 1
  ENSP ID: ENSP00000424469
MYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGRFRWSLSLQTQWNVAFGGHHQLG

SEQ ID NO: 42455 - protein, 686 aa, Homo sapiens
  Payload ID: 8638
  Gene Symbol: KLKB1
  Gene Name: kallikrein B, plasma (Fletcher factor) 1
  ENSP ID: ENSP00000426629
  MOD_RES (1)..(1): Any amino acid
XSEDCEVAGYRVLKGTEAVIIPYALHRDPRYFPNPEEFQPERFFPENAQGRHPYAYVPFSAGPRNCIGCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 42456 - protein, 250 aa, Homo sapiens
  Payload ID: 8639
  Gene Symbol:
  Gene Name: Kallikrein-9  [Source:UniProtKB/Swiss-Prot
  Acc:Q9UKQ9]
  Uniprot ID: Q9UKQ9
  ENSP ID: ENSP00000250366
MKLGLLCALLSLLAGHGWADTRAIGAEECRPNSQPWQAGLFHLTRLFCGATLISDRWLLTAAHCRKPYLWVRLGEHHLWKWEGPEQLFRVTDFFPHPGFNKDLSANDHNDDIMLIRLPRQARLSPAVQPLNLSQTCVSPGMQCLISGWGAVSSPKALFPVTLQCANISILENKLCHWAYPGHISDSMLCAGLWEGGRGSCQGDSGGPLVCNGTLAGVVSGGAEPCSRPRRPAVYTSVCHYLDWIQEIMEN

SEQ ID NO: 42457 - protein, 91 aa, Homo sapiens
  Payload ID: 8639
  Gene Symbol:
  Gene Name: Kallikrein-9  [Source:UniProtKB/Swiss-Prot
  Acc:Q9UKQ9]
  ENSP ID: ENSP00000471395
VTLQCANISILENKLCHWAYPGHISDSMLCAGLWEGGRGSCQGDSGGPLVCNGTLAGVVSGGAEPCSRPRRPAVYTSVCHYLDWIQEIMEN

SEQ ID NO: 42458 - protein, 276 aa, Homo sapiens
  Payload ID: 8640
  Gene Symbol: KLK10
  Gene Name: kallikrein-related peptidase 10
  Uniprot ID: O43240
  ENSP ID: ENSP00000311746
MRAPHLHLSAASGARALAKLLPLLMAQLWAAEAALLPQNDTRLDPEAYGSPCARGSQPWQVSLFNGLSFHCAGVLVDQSWVLTAAHCGNKPLWARVGDDHLLLLQGEQLRRTTRSVVHPKYHQGSGPILPRRTDEHDLMLLKLARPVVLGPRVRALQLPYRCAQPGDQCQVAGWGTTAARRVKYNKGLTCSSITILSPKECEVFYPGVVTNNMICAGLDRGQDPCQSDSGGPLVCDETLQGILSWGVYPCGSAQHPAVYTQICKYMSWINKVIRSN

SEQ ID NO: 42459 - protein, 276 aa, Homo sapiens; identical to SEQ ID NO: 42458
  Payload ID: 8640
  Gene Symbol: KLK10
  Gene Name: kallikrein-related peptidase 10
  Uniprot ID: O43240
  ENSP ID: ENSP00000351640

SEQ ID NO: 42460 - protein, 276 aa, Homo sapiens; identical to SEQ ID NO: 42458
  Payload ID: 8640
  Gene Symbol: KLK10
  Gene Name: kallikrein-related peptidase 10
  Uniprot ID: O43240
  ENSP ID: ENSP00000375681

SEQ ID NO: 42461 - protein, 143 aa, Homo sapiens
  Payload ID: 8640
  Gene Symbol: KLK10
  Gene Name: kallikrein-related peptidase 10
  ENSP ID: ENSP00000471610
MRAPHLHLSAASGARALAKLLPLLMAQLWAAEAALLPQNDTRLDPEAYGSPCARGSQPWQVSLFNGLSFHCAGVLVDQSWVLTAAHCGNKPLWARVGDDHLLLLQGEQLRRTTRSVVHPKYHQGSGPILPRRTDEHDLMLLKL

SEQ ID NO: 42462 - protein, 43 aa, Homo sapiens
  Payload ID: 8640
  Gene Symbol: KLK10
  Gene Name: kallikrein-related peptidase 10
  ENSP ID: ENSP00000472773
MTTCCFFRESSSAGPLALLSIPSTTRAQAPSCQGERMSTISCC

SEQ ID NO: 42463 - protein, 250 aa, Homo sapiens
  Payload ID: 8641
  Gene Symbol: KLK11
  Gene Name: kallikrein-related peptidase 11
  Uniprot ID: Q9UBX7
  ENSP ID: ENSP00000324269
MRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 42464 - protein, 116 aa, Homo sapiens
  Payload ID: 8641
  Gene Symbol: KLK11
  Gene Name: kallikrein-related peptidase 11
  ENSP ID: ENSP00000324414
MQRLRWLRDWKSSGRGLTAAKEPGARSSPLQAMRILQLILLALATGLVGGETRIIKGFECKPHSQPWQAALFEKTRLLCGATLIAPRWLLTAAHCLKPWPLHSSPGAAQPPEGGGL

SEQ ID NO: 42465 - protein, 275 aa, Homo sapiens
  Payload ID: 8641
  Gene Symbol: KLK11
  Gene Name: kallikrein-related peptidase 11
  Uniprot ID: Q9UBX7
  ENSP ID: ENSP00000375680
MRILQLILLALATGLVGGETRIIKGFECKPHSQPWQAALFEKTRLLCGATLIAPRWLLTAAHCLKPWVSLTSPTHVSPDLSSSNYCLSHLSRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 42466 - protein, 250 aa, Homo sapiens; identical to SEQ ID NO: 42463
  Payload ID: 8641
  Gene Symbol: KLK11
  Gene Name: kallikrein-related peptidase 11
  Uniprot ID: Q9UBX7
  ENSP ID: ENSP00000413958

SEQ ID NO: 42467 - protein, 141 aa, Homo sapiens
  Payload ID: 8641
  Gene Symbol: KLK11
  Gene Name: kallikrein-related peptidase 11
  ENSP ID: ENSP00000470113
  MOD_RES (1)..(1): Any amino acid
XNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQSLQGIISWGQDPCAITRKPGVYTKVCKYVDWIQETMKNN

SEQ ID NO: 42468 - protein, 170 aa, Homo sapiens
  Payload ID: 8641
  Gene Symbol: KLK11
  Gene Name: kallikrein-related peptidase 11
  ENSP ID: ENSP00000470574
MRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIE

SEQ ID NO: 42469 - protein, 68 aa, Homo sapiens
  Payload ID: 8641
  Gene Symbol: KLK11
  Gene Name: kallikrein-related peptidase 11
  ENSP ID: ENSP00000470783
MRILQLILLALATGLVGGETRIIKGFECKPHSQPWQAALFEKTRLLCGATLIAPRWLLTAAHCLKPRY

SEQ ID NO: 42470 - protein, 109 aa, Homo sapiens
  Payload ID: 8641
  Gene Symbol: KLK11
  Gene Name: kallikrein-related peptidase 11
  ENSP ID: ENSP00000471636
MRILQLILLALATVRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 42471 - protein, 282 aa, Homo sapiens
  Payload ID: 8641
  Gene Symbol: KLK11
  Gene Name: kallikrein-related peptidase 11
  Uniprot ID: Q9UBX7
  ENSP ID: ENSP00000473047
MQRLRWLRDWKSSGRGLTAAKEPGARSSPLQAMRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 42472 - protein, 254 aa, Homo sapiens
  Payload ID: 8642
  Gene Symbol: KLK12
  Gene Name: kallikrein-related peptidase 12
  Uniprot ID: Q9UKR0
  ENSP ID: ENSP00000250351
MGLSIFLLLCVLGLSQAATPKIFNGTECGRNSQPWQVGLFEGTSLRCGGVLIDHRWVLTAAHCSGSRYWVRLGEHSLSQLDWTEQIRHSGFSVTHPGYLGASTSHEHDLRLLRLRLPVRVTSSVQPLPLPNDCATAGTECHVSGWGITNHPRNPFPDLLQCLNLSIVSHATCHGVYPGRITSNMVCAGGVPGQDACQGDSGGPLVCGGVLQGLVSWGSVGPCGQDGIPGVYTYICNSTLVGLGTSWNFNSCQPF

SEQ ID NO: 42473 - protein, 248 aa, Homo sapiens
  Payload ID: 8642
  Gene Symbol: KLK12
  Gene Name: kallikrein-related peptidase 12
  Uniprot ID: Q9UKR0
  ENSP ID: ENSP00000324181
MGLSIFLLLCVLGLSQAATPKIFNGTECGRNSQPWQVGLFEGTSLRCGGVLIDHRWVLTAAHCSGSRYWVRLGEHSLSQLDWTEQIRHSGFSVTHPGYLGASTSHEHDLRLLRLRLPVRVTSSVQPLPLPNDCATAGTECHVSGWGITNHPRNPFPDLLQCLNLSIVSHATCHGVYPGRITSNMVCAGGVPGQDACQGDSGGPLVCGGVLQGLVSWGSVGPCGQDGIPGVYTYICKYVDWIRMIMRNN

SEQ ID NO: 42474 - protein, 111 aa, Homo sapiens
  Payload ID: 8642
  Gene Symbol: KLK12
  Gene Name: kallikrein-related peptidase 12
  Uniprot ID: Q9UKR0
  ENSP ID: ENSP00000434036
MGLSIFLLLCVLGLSQAATPKIFNGTECGRNSQPWQVGLFEGTSLRCGGVLIDHRWVLTAAHCSGRPIPGSAPVPQPLHRLPCHLPWCVSRENHEQHGVCRRRPGAGCLPG

SEQ ID NO: 42475 - protein, 79 aa, Homo sapiens
  Payload ID: 8642
  Gene Symbol: KLK12
  Gene Name: kallikrein-related peptidase 12
  ENSP ID: ENSP00000434339
MGLSIFLLLCVLGEFSRSRERAGLRLDPFTPMRRPHHPPHLSSGPQPGGEEERGFLCASIYLQLSGAQPGSHTEDFQWH

SEQ ID NO: 42476 - protein, 79 aa, Homo sapiens; identical to SEQ ID NO: 42475
  Payload ID: 8642
  Gene Symbol: KLK12
  Gene Name: kallikrein-related peptidase 12
  ENSP ID: ENSP00000434604

SEQ ID NO: 42477 - protein, 177 aa, Homo sapiens
  Payload ID: 8642
  Gene Symbol: KLK12
  Gene Name: kallikrein-related peptidase 12
  ENSP ID: ENSP00000436121
MGLSIFLLLCVLGLSQAATPKIFNGTECGRNSQPWQVGLFEGTSLRCGGVLIDHRWVLTAAHCSGSRYWVRLGEHSLSQLDWTEQIRHSGFSVTHPGYLGASTSHEHDLRLLRLRLPVRVTSSVQPLPLPNDCATAGTECHVSGWGITNHPRSKGPRARGQGSGWVQVWDAGREVES

SEQ ID NO: 42478 - protein, 248 aa, Homo sapiens; identical to SEQ ID NO: 42473
  Payload ID: 8642
  Gene Symbol: KLK12
  Gene Name: kallikrein-related peptidase 12
  Uniprot ID: Q9UKR0
  ENSP ID: ENSP00000436458

SEQ ID NO: 42479 - protein, 99 aa, Homo sapiens
  Payload ID: 8643
  Gene Symbol: KLK13
  Gene Name: kallikrein-related peptidase 13
  ENSP ID: ENSP00000156476
MWPLALVIASLTLALSGGVSQESSKVLNTNGTSGFLPGGYTCFPHSQPWQAALLVQGRLLCGGVLVHPKWVLTAAHCLKEGLKVYLGKHALGRVEAGEQ

SEQ ID NO: 42480 - protein, 125 aa, Homo sapiens
  Payload ID: 8643
  Gene Symbol: KLK13
  Gene Name: kallikrein-related peptidase 13
  Uniprot ID: Q9UKR3
  ENSP ID: ENSP00000334079
MWPLALVIASLTLALSGVNYPKTLQCANIQLRSDEECRQVYPGKITDNMLCAGTKEGGKDSCEGDSGGPLVCNRTLYGIVSWGDFPCGQPDRPGVYTRVSRYVLWIRETIRKYETQQQKWLKGPQ

SEQ ID NO: 42481 - protein, 98 aa, Homo sapiens
  Payload ID: 8643
  Gene Symbol: KLK13
  Gene Name: kallikrein-related peptidase 13
  ENSP ID: ENSP00000365995
MGLIYKCLPEKVTVNIETRCLPGVFQGSQHQWDQWVSPRWLHLLPPLSALAGCPTSARAATLWGSPGPPQMGPHCRTLSKGGAQSLPRQARPRACGSW

SEQ ID NO: 42482 - protein, 93 aa, Homo sapiens
  Payload ID: 8643
  Gene Symbol: KLK13
  Gene Name: kallikrein-related peptidase 13
  ENSP ID: ENSP00000392640
MWPLALVIASLTLALSGGEDFKEPSQGPRDVMAASRPEAFPKGLTLEPRPEKGGICGCLAPGTILGLKVGWLFSSGDTPWIHARATPECHTLG

SEQ ID NO: 42483 - protein, 204 aa, Homo sapiens
  Payload ID: 8643
  Gene Symbol: KLK13
  Gene Name: kallikrein-related peptidase 13
  ENSP ID: ENSP00000470245
MWPLALVIASLTLALSGGVSQESSKVLNTNGTSGFLPGGYTCFPHSQPWQAALLVQGRLLCGGVLVHPKWVLTAAHCLKEGLKVYLGKHALGRVEAVNYPKTLQCANIQLRSDEECRQVYPGKITDNMLCAGTKEGGKDSCEGDSGGPLVCNRTLYGIVSWGDFPCGQPDRPGVYTRVSRYVLWIRETIRKYETQQQKWLKGPQ

SEQ ID NO: 42484 - protein, 277 aa, Homo sapiens
  Payload ID: 8643
  Gene Symbol: KLK13
  Gene Name: kallikrein-related peptidase 13
  Uniprot ID: Q9UKR3
  ENSP ID: ENSP00000470555
MWPLALVIASLTLALSGGVSQESSKVLNTNGTSGFLPGGYTCFPHSQPWQAALLVQGRLLCGGVLVHPKWVLTAAHCLKEGLKVYLGKHALGRVEAGEQVREVVHSIPHPEYRRSPTHLNHDHDIMLLELQSPVQLTGYIQTLPLSHNNRLTPGTTCRVSGWGTTTSPQVNYPKTLQCANIQLRSDEECRQVYPGKITDNMLCAGTKEGGKDSCEGDSGGPLVCNRTLYGIVSWGDFPCGQPDRPGVYTRVSRYVLWIRETIRKYETQQQKWLKGPQ

SEQ ID NO: 42485 - protein, 98 aa, Homo sapiens; identical to SEQ ID NO: 42481
  Payload ID: 8643
  Gene Symbol: KLK13
  Gene Name: kallikrein-related peptidase 13
  ENSP ID: ENSP00000470931

SEQ ID NO: 42486 - protein, 180 aa, Homo sapiens
  Payload ID: 8643
  Gene Symbol: KLK13
  Gene Name: kallikrein-related peptidase 13
  ENSP ID: ENSP00000472248
MWPLALVIASLTLALSGGVSQESSKVLNTNGTSGFLPGGYTCFPHSQPWQAALLVQGRLLCGGVLVHPKWVLTAAHCLKEGLKVYLGKHALGRVEAGEQVREVVHSIPHPEYRRSPTHLNHDHDIMLLELQSPVQLTGYIQTLPLSHNNRLTPGTTCRVSGWGTTTSPQGMHPHRWPEAP

SEQ ID NO: 42487 - protein, 93 aa, Homo sapiens; identical to SEQ ID NO: 42482
  Payload ID: 8643
  Gene Symbol: KLK13
  Gene Name: kallikrein-related peptidase 13
  ENSP ID: ENSP00000472596

SEQ ID NO: 42488 - protein, 267 aa, Homo sapiens
  Payload ID: 8644
  Gene Symbol: KLK14
  Gene Name: kallikrein-related peptidase 14
  Uniprot ID: Q9P0G3
  ENSP ID: ENSP00000156499
MSLRVLGSGTWPSAPKMFLLLTALQVLAIAMTQSQEDENKIIGGHTCTRSSQPWQAALLAGPRRRFLCGGALLSGQWVITAAHCGRPILQVALGKHNLRRWEATQQVLRVVRQVTHPNYNSRTHDNDLMLLQLQQPARIGRAVRPIEVTQACASPGTSCRVSGWGTISSPIARYPASLQCVNINISPDEVCQKAYPRTITPGMVCAGVPQGGKDSCQGDSGGPLVCRGQLQGLVSWGMERCALPGYPGVYTNLCKYRSWIEETMRDK

SEQ ID NO: 42489 - protein, 267 aa, Homo sapiens; identical to SEQ ID NO: 42488
  Payload ID: 8644
  Gene Symbol: KLK14
  Gene Name: kallikrein-related peptidase 14
  Uniprot ID: Q9P0G3
  ENSP ID: ENSP00000375678

SEQ ID NO: 42490 - protein, 255 aa, Homo sapiens
  Payload ID: 8645
  Gene Symbol: KLK15
  Gene Name: kallikrein-related peptidase 15
  Uniprot ID: Q9H2R5
  ENSP ID: ENSP00000314783
MWLLLTLSFLLASTAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQVRPAVLPTRCPHPGEACVVSGWGLVSHNEPGTAGSPRSQVSLPDTLHCANISIISDTSCDKSYPGRLTNTMVCAGAEGRGAESCEGDSGGPLVCGGILQGIVSWGDVPCDNTTKPGVYTKVCHYLEWIRETMKRN

SEQ ID NO: 42491 - protein, 120 aa, Homo sapiens
  Payload ID: 8645
  Gene Symbol: KLK15
  Gene Name: kallikrein-related peptidase 15
  ENSP ID: ENSP00000468856
MWLLLTLSFLLASTAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQ

SEQ ID NO: 42492 - protein, 256 aa, Homo sapiens
  Payload ID: 8645
  Gene Symbol: KLK15
  Gene Name: kallikrein-related peptidase 15
  Uniprot ID: Q9H2R5
  ENSP ID: ENSP00000469315
MWLLLTLSFLLASTAAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQVRPAVLPTRCPHPGEACVVSGWGLVSHNEPGTAGSPRSQVSLPDTLHCANISIISDTSCDKSYPGRLTNTMVCAGAEGRGAESCEGDSGGPLVCGGILQGIVSWGDVPCDNTTKPGVYTKVCHYLEWIRETMKRN

SEQ ID NO: 42493 - protein, 160 aa, Homo sapiens
  Payload ID: 8645
  Gene Symbol: KLK15
  Gene Name: kallikrein-related peptidase 15
  ENSP ID: ENSP00000471164
MWLLLTLSFLLASTAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQVRPAVLPTRCPHPGEACVVSGWGLVSHNEPGTAGSPRSQG

SEQ ID NO: 42494 - protein, 43 aa, Homo sapiens
  Payload ID: 8645
  Gene Symbol: KLK15
  Gene Name: kallikrein-related peptidase 15
  ENSP ID: ENSP00000472523
MRVRLGEHNLRKRDGPEQLRTTSRVIPHPRYEARSHRNDIMLL

SEQ ID NO: 42495 - protein, 261 aa, Homo sapiens
  Payload ID: 8646
  Gene Symbol: KLK2
  Gene Name: kallikrein-related peptidase 2
  Uniprot ID: P20151
  ENSP ID: ENSP00000313581
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGGDSGGPLVCNGVLQGITSWGPEPCALPEKPAVYTKVVHYRKWIKDTIAANP

SEQ ID NO: 42496 - protein, 223 aa, Homo sapiens
  Payload ID: 8646
  Gene Symbol: KLK2
  Gene Name: kallikrein-related peptidase 2
  Uniprot ID: P20151
  ENSP ID: ENSP00000350748
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGVSHPYSQHLEGKG

SEQ ID NO: 42497 - protein, 159 aa, Homo sapiens
  Payload ID: 8646
  Gene Symbol: KLK2
  Gene Name: kallikrein-related peptidase 2
  Uniprot ID: P20151
  ENSP ID: ENSP00000375686
MSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGGDSGGPLVCNGVLQGITSWGPEPCALPEKPAVYTKVVHYRKWIKDTIAANP

SEQ ID NO: 42498 - protein, 122 aa, Homo sapiens
  Payload ID: 8646
  Gene Symbol: KLK2
  Gene Name: kallikrein-related peptidase 2
  ENSP ID: ENSP00000469318
MWDLVLSIALSVGCTGAVPLIQSRIVGGWECEKHSQPWQVAVYSHGWAHCGGVLVHPQWVLTAAHCLKKACQDHRCCEGPGPAHPGASTGDHLLRLRLGQHRTRGVLAPQESSVCEPPSPVQ

SEQ ID NO: 42499 - protein, 49 aa, Homo sapiens
  Payload ID: 8646
  Gene Symbol: KLK2
  Gene Name: kallikrein-related peptidase 2
  ENSP ID: ENSP00000469770
MWDLVLSIALSVGCTGIARSGWVGTTCLSLKTQARGSLSATASHTRSTI

SEQ ID NO: 42500 - protein, 49 aa, Homo sapiens; identical to SEQ ID NO: 42499
  Payload ID: 8646
  Gene Symbol: KLK2
  Gene Name: kallikrein-related peptidase 2
  ENSP ID: ENSP00000471014

SEQ ID NO: 42501 - protein, 164 aa, Homo sapiens
  Payload ID: 8646
  Gene Symbol: KLK2
  Gene Name: kallikrein-related peptidase 2
  Uniprot ID: P20151
  ENSP ID: ENSP00000471214
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEE

SEQ ID NO: 42502 - protein, 51 aa, Homo sapiens
  Payload ID: 8646
  Gene Symbol: KLK2
  Gene Name: kallikrein-related peptidase 2
  ENSP ID: ENSP00000471321
  MOD_RES (1)..(1): Any amino acid
XEKVTEFMLCAGLWTGGKDTCGHNSPIPVLSTCLLGTCYVTSIAVDPGKQQ

SEQ ID NO: 42503 - protein, 43 aa, Homo sapiens
  Payload ID: 8646
  Gene Symbol: KLK2
  Gene Name: kallikrein-related peptidase 2
  ENSP ID: ENSP00000471323
MSLLKHQSLRPDEDSSHDLMLLRLSEPAKITDVVKVLGLPTQE

SEQ ID NO: 42504 - protein, 184 aa, Homo sapiens
  Payload ID: 8646
  Gene Symbol: KLK2
  Gene Name: kallikrein-related peptidase 2
  ENSP ID: ENSP00000471725
  MOD_RES (1)..(1): Any amino acid
XPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGESGAVDGAGQKKDRAWLRVILGVHLSVMVCFKVSHHGALSHVPCLKSLLCTPRWCITGSGSRTPSQPTPECPCPTPTSSKFKSTS

SEQ ID NO: 42505 - protein, 69 aa, Homo sapiens
  Payload ID: 8646
  Gene Symbol: KLK2
  Gene Name: kallikrein-related peptidase 2
  ENSP ID: ENSP00000472095
MWDLVLSIALSVGCTGAVPLIQSRIVGGWECEKHSQPWQVAVYSHGWAHCGGVLVHPQWVLTAAHCLKK

SEQ ID NO: 42506 - protein, 49 aa, Homo sapiens; identical to SEQ ID NO: 42499
  Payload ID: 8646
  Gene Symbol: KLK2
  Gene Name: kallikrein-related peptidase 2
  ENSP ID: ENSP00000472499

SEQ ID NO: 42507 - protein, 22 aa, Homo sapiens
  Payload ID: 8646
  Gene Symbol: KLK2
  Gene Name: kallikrein-related peptidase 2
  ENSP ID: ENSP00000472852
MSLLKHQSLRPDEDSSHDLMLL

SEQ ID NO: 42508 - protein, 261 aa, Homo sapiens
  Payload ID: 8647
  Gene Symbol: KLK3
  Gene Name: kallikrein-related peptidase 3
  Uniprot ID: P07288
  ENSP ID: ENSP00000314151
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 42509 - protein, 238 aa, Homo sapiens
  Payload ID: 8647
  Gene Symbol: KLK3
  Gene Name: kallikrein-related peptidase 3
  Uniprot ID: P07288
  ENSP ID: ENSP00000353829
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSWVILITELTMPALPMVLHGSLVPWRGGV

SEQ ID NO: 42510 - protein, 90 aa, Homo sapiens
  Payload ID: 8647
  Gene Symbol: KLK3
  Gene Name: kallikrein-related peptidase 3
  ENSP ID: ENSP00000393628
MWVPVVFLTLSVTWIGAAPLILSRIVGGWECEKHSQPWQVLVASRGRAVCGGVLVHPQWVLTAAHCIRNKSVILLGRHSLFHPEDTGQAR

SEQ ID NO: 42511 - protein, 124 aa, Homo sapiens
  Payload ID: 8647
  Gene Symbol: KLK3
  Gene Name: kallikrein-related peptidase 3
  ENSP ID: ENSP00000468912
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSTLNQRSS

SEQ ID NO: 42512 - protein, 172 aa, Homo sapiens
  Payload ID: 8647
  Gene Symbol: KLK3
  Gene Name: kallikrein-related peptidase 3
  ENSP ID: ENSP00000470523
MWVPVVFLTLAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTC

SEQ ID NO: 42513 - protein, 218 aa, Homo sapiens
  Payload ID: 8647
  Gene Symbol: KLK3
  Gene Name: kallikrein-related peptidase 3
  Uniprot ID: P07288
  ENSP ID: ENSP00000471155
MWVPVVFLTLSVTWIGAAPLILSRIVGGWECEKHSQPWQVLVASRGRAVCGGVLVHPQWVLTAAHCIRKPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 42514 - protein, 104 aa, Homo sapiens
  Payload ID: 8647
  Gene Symbol: KLK3
  Gene Name: kallikrein-related peptidase 3
  ENSP ID: ENSP00000471648
MWVPVVFLTLSVTWIGERGHGWGDAGEGASPDCQAEALSPPTQHPSPDRELGSFLSLPAPLQAHTPSPSILQQSSLPHQVPAPSHLPQNFLPIAQPAPCSQLLY

SEQ ID NO: 42515 - protein, 262 aa, Homo sapiens
  Payload ID: 8647
  Gene Symbol: KLK3
  Gene Name: kallikrein-related peptidase 3
  ENSP ID: ENSP00000471827
  MOD_RES (1)..(1): Any amino acid
XFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEECTPGPDVLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 42516 - protein, 172 aa, Homo sapiens
  Payload ID: 8647
  Gene Symbol: KLK3
  Gene Name: kallikrein-related peptidase 3
  ENSP ID: ENSP00000472213
MWVPVVFLTLSVTWIAPPLQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQK

SEQ ID NO: 42517 - protein, 195 aa, Homo sapiens
  Payload ID: 8647
  Gene Symbol: KLK3
  Gene Name: kallikrein-related peptidase 3
  ENSP ID: ENSP00000472411
MWVPVVFLTLSVTWIGAAPLILSRIVGGWECEKHSQPWQVLVASRGRAVCGGVLVHPQWVLTAAHCIRKPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSWVILITELTMPALPMVLHGSLVPWRGGV

SEQ ID NO: 42518 - protein, 227 aa, Homo sapiens
  Payload ID: 8647
  Gene Symbol: KLK3
  Gene Name: kallikrein-related peptidase 3
  Uniprot ID: P07288
  ENSP ID: ENSP00000472907
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSVSHPYSQDLEGKGEWGP

SEQ ID NO: 42519 - protein, 220 aa, Homo sapiens
  Payload ID: 8647
  Gene Symbol: KLK3
  Gene Name: kallikrein-related peptidase 3
  ENSP ID: ENSP00000483513
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 42520 - protein, 254 aa, Homo sapiens
  Payload ID: 8648
  Gene Symbol: KLK4
  Gene Name: kallikrein-related peptidase 4
  ENSP ID: ENSP00000326159
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANGRMPTVLQCVNVSVVSEEVCSKLYDPLYHPSMFCAGGGQDQKDSCNGDSGGPLICNGYLQGLVSFGKAPCGQVGVPGVYTNLCKFTEWIEKTVQAS

SEQ ID NO: 42521 - protein, 110 aa, Homo sapiens
  Payload ID: 8648
  Gene Symbol: KLK4
  Gene Name: kallikrein-related peptidase 4
  Uniprot ID: Q9Y5K2
  ENSP ID: ENSP00000399448
MENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANG

SEQ ID NO: 42522 - protein, 71 aa, Homo sapiens
  Payload ID: 8648
  Gene Symbol: KLK4
  Gene Name: kallikrein-related peptidase 4
  ENSP ID: ENSP00000469769
MVEASLSVRHPEYNRPLLANDLMLIKLDESVSESDTIRSISIASQCPTAGNSCLVSGWGLLANECLPCCSA

SEQ ID NO: 42523 - protein, 71 aa, Homo sapiens; identical to SEQ ID NO: 42522
  Payload ID: 8648
  Gene Symbol: KLK4
  Gene Name: kallikrein-related peptidase 4
  ENSP ID: ENSP00000469963

SEQ ID NO: 42524 - protein, 75 aa, Homo sapiens
  Payload ID: 8648
  Gene Symbol: KLK4
  Gene Name: kallikrein-related peptidase 4
  ENSP ID: ENSP00000472091
MATAGNPWGWFLGYLILGVAGSLVSGSCSQIINGEDCSPHSQPWQAALVMENELFCSGVLVHPQWVLSAAHCFQK

SEQ ID NO: 42525 - protein, 293 aa, Homo sapiens
  Payload ID: 8649
  Gene Symbol: KLK5
  Gene Name: kallikrein-related peptidase 5
  Uniprot ID: Q9Y337
  ENSP ID: ENSP00000337733
MATARPPWMWVLCALITALLLGVTEHVLANNDVSCDHPSNTVPSGSNQDLGAGAGEDARSDDSSSRIINGSDCDMHTQPWQAALLLRPNQLYCGAVLVHPQWLLTAAHCRKKVFRVRLGHYSLSPVYESGQQMFQGVKSIPHPGYSHPGHSNDLMLIKLNRRIRPTKDVRPINVSSHCPSAGTKCLVSGWGTTKSPQVHFPKVLQCLNISVLSQKRCEDAYPRQIDDTMFCAGDKAGRDSCQGDSGGPVVCNGSLQGLVSWGDYPCARPNRPGVYTNLCKFTKWIQETIQANS

SEQ ID NO: 42526 - protein, 293 aa, Homo sapiens; identical to SEQ ID NO: 42525
  Payload ID: 8649
  Gene Symbol: KLK5
  Gene Name: kallikrein-related peptidase 5
  Uniprot ID: Q9Y337
  ENSP ID: ENSP00000375685

SEQ ID NO: 42527 - protein, 205 aa, Homo sapiens
  Payload ID: 8649
  Gene Symbol: KLK5
  Gene Name: kallikrein-related peptidase 5
  ENSP ID: ENSP00000469439
MATARPPWMWVLCALITALLLGVTEHVLANNDVSCDHPSNTVPSGSNQDLGAGAGEDARSDDSSSRIINGSDCDMHTQPWQAALLLRPNQLYCGAVLVHPQWLLTAAHCRKKVFRVRLGHYSLSPVYESGQQMFQGVKSIPHPGYSHPGHSNDLMLIKLNRRIRPTKDVRPINVSSHCPSAGTKCLVSGWGTTKSPQVHFPKVLQ

SEQ ID NO: 42528 - protein, 293 aa, Homo sapiens; identical to SEQ ID NO: 42525
  Payload ID: 8649
  Gene Symbol: KLK5
  Gene Name: kallikrein-related peptidase 5
  Uniprot ID: Q9Y337
  ENSP ID: ENSP00000471966

SEQ ID NO: 42529 - protein, 244 aa, Homo sapiens
  Payload ID: 8650
  Gene Symbol: KLK6
  Gene Name: kallikrein-related peptidase 6
  Uniprot ID: Q92876
  ENSP ID: ENSP00000309148
MKKLMVVLSLIAAAWAEEQNKLVHGGPCDKTSHPYQAALYTSGHLLCGGVLIHPLWVLTAAHCKKPNLQVFLGKHNLRQRESSQEQSSVVRAVIHPDYDAASHDQDIMLLRLARPAKLSELIQPLPLERDCSANTTSCHILGWGKTADGDFPDTIQCAYIHLVSREECEHAYPGQITQNMLCAGDEKYGKDSCQGDSGGPLVCGDHLRGLVSWGNIPCGSKEKPGVYTNVCRYTNWIQKTIQAK

SEQ ID NO: 42530 - protein, 244 aa, Homo sapiens; identical to SEQ ID NO: 42529
  Payload ID: 8650
  Gene Symbol: KLK6
  Gene Name: kallikrein-related peptidase 6
  Uniprot ID: Q92876
  ENSP ID: ENSP00000366047

SEQ ID NO: 42531 - protein, 120 aa, Homo sapiens
  Payload ID: 8650
  Gene Symbol: KLK6
  Gene Name: kallikrein-related peptidase 6
  ENSP ID: ENSP00000366049
MKKLMVVLSLIAAAWAEEQNKLVHGGPCDKTSHPYQAALYTSGHLLCGGVLIHPLWVLTAAHCKKPVILGVRWYVETTSEALCHGVTSPVDQRRSQESTPTSADTRTGSKKPFRPSDPDM

SEQ ID NO: 42532 - protein, 137 aa, Homo sapiens
  Payload ID: 8650
  Gene Symbol: KLK6
  Gene Name: kallikrein-related peptidase 6
  Uniprot ID: Q92876
  ENSP ID: ENSP00000375684
MLLRLARPAKLSELIQPLPLERDCSANTTSCHILGWGKTADGDFPDTIQCAYIHLVSREECEHAYPGQITQNMLCAGDEKYGKDSCQGDSGGPLVCGDHLRGLVSWGNIPCGSKEKPGVYTNVCRYTNWIQKTIQAK

SEQ ID NO: 42533 - protein, 40 aa, Homo sapiens
  Payload ID: 8650
  Gene Symbol: KLK6
  Gene Name: kallikrein-related peptidase 6
  Uniprot ID: Q92876
  ENSP ID: ENSP00000469630
MKKLMVVLSLIAAGIFRSSWGSITFGKGRVPRSRVLLSGL

SEQ ID NO: 42534 - protein, 69 aa, Homo sapiens
  Payload ID: 8650
  Gene Symbol: KLK6
  Gene Name: kallikrein-related peptidase 6
  ENSP ID: ENSP00000469702
MADPATRHLTPTKLPSTPRATCSVVGSLSIHCGSSQLPTAKNRIFRSSWGSITFGKGRVPRSRVLLSGL

SEQ ID NO: 42535 - protein, 244 aa, Homo sapiens; identical to SEQ ID NO: 42529
  Payload ID: 8650
  Gene Symbol: KLK6
  Gene Name: kallikrein-related peptidase 6
  Uniprot ID: Q92876
  ENSP ID: ENSP00000470482

SEQ ID NO: 42536 - protein, 40 aa, Homo sapiens; identical to SEQ ID NO: 42533
  Payload ID: 8650
  Gene Symbol: KLK6
  Gene Name: kallikrein-related peptidase 6
  Uniprot ID: Q92876
  ENSP ID: ENSP00000471948

SEQ ID NO: 42537 - protein, 66 aa, Homo sapiens
  Payload ID: 8651
  Gene Symbol: KLK7
  Gene Name: kallikrein-related peptidase 7
  ENSP ID: ENSP00000304791
MARSLLLPLQILLLSLALETAGEEVSTPCTWAVIRWATGELRGSRPRSHSATPATPHRPMLMTSCS

SEQ ID NO: 42538 - protein, 253 aa, Homo sapiens
  Payload ID: 8651
  Gene Symbol: KLK7
  Gene Name: kallikrein-related peptidase 7
  Uniprot ID: P49862
  ENSP ID: ENSP00000375683
MARSLLLPLQILLLSLALETAGEEAQGDKIIDGAPCARGSHPWQVALLSGNQLHCGGVLVNERWVLTAAHCKMNEYTVHLGSDTLGDRRAQRIKASKSFRHPGYSTQTHVNDLMLVKLNSQARLSSMVKKVRLPSRCEPPGTTCTVSGWGTTTSPDVTFPSDLMCVDVKLISPQDCTKVYKDLLENSMLCAGIPDSKKNACNGDSGGPLVCRGTLQGLVSWGTFPCGQPNDPGVYTQVCKFTKWINDTMKKHR

SEQ ID NO: 42539 - protein, 181 aa, Homo sapiens
  Payload ID: 8651
  Gene Symbol: KLK7
  Gene Name: kallikrein-related peptidase 7
  Uniprot ID: P49862
  ENSP ID: ENSP00000469950
MNEYTVHLGSDTLGDRRAQRIKASKSFRHPGYSTQTHVNDLMLVKLNSQARLSSMVKKVRLPSRCEPPGTTCTVSGWGTTTSPDVTFPSDLMCVDVKLISPQDCTKVYKDLLENSMLCAGIPDSKKNACNGDSGGPLVCRGTLQGLVSWGTFPCGQPNDPGVYTQVCKFTKWINDTMKKHR

SEQ ID NO: 42540 - protein, 69 aa, Homo sapiens
  Payload ID: 8651
  Gene Symbol: KLK7
  Gene Name: kallikrein-related peptidase 7
  ENSP ID: ENSP00000470084
MNEYTVHLGSDTLGDRRAQRIKASKSFRHPGYSTQTHVNDLMLVKLNSQARLSSMVKKVRLPSRCEPPG

SEQ ID NO: 42541 - protein, 253 aa, Homo sapiens; identical to SEQ ID NO: 42538
  Payload ID: 8651
  Gene Symbol: KLK7
  Gene Name: kallikrein-related peptidase 7
  Uniprot ID: P49862
  ENSP ID: ENSP00000470538

SEQ ID NO: 42542 - protein, 139 aa, Homo sapiens
  Payload ID: 8652
  Gene Symbol: KLK8
  Gene Name: kallikrein-related peptidase 8
  ENSP ID: ENSP00000291726
MLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 42543 - protein, 32 aa, Homo sapiens
  Payload ID: 8652
  Gene Symbol: KLK8
  Gene Name: kallikrein-related peptidase 8
  Uniprot ID: O60259
  ENSP ID: ENSP00000325072
MGRPRPRAAKTWMFLLLLGGAWAGRFWRPPGV

SEQ ID NO: 42544 - protein, 119 aa, Homo sapiens
  Payload ID: 8652
  Gene Symbol: KLK8
  Gene Name: kallikrein-related peptidase 8
  Uniprot ID: O60259
  ENSP ID: ENSP00000341555
MGRPRPRAAKTWMFLLLLGGAWAENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 42545 - protein, 305 aa, Homo sapiens
  Payload ID: 8652
  Gene Symbol: KLK8
  Gene Name: kallikrein-related peptidase 8
  Uniprot ID: O60259
  ENSP ID: ENSP00000375682
MGRPRPRAAKTWMFLLLLGGAWAACGSLDLLTKLYAENLPCVHLNPQWPSQPSHCPRGWRSNPLPPAAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 42546 - protein, 32 aa, Homo sapiens; identical to SEQ ID NO: 42543
  Payload ID: 8652
  Gene Symbol: KLK8
  Gene Name: kallikrein-related peptidase 8
  Uniprot ID: O60259
  ENSP ID: ENSP00000469278

SEQ ID NO: 42547 - protein, 260 aa, Homo sapiens
  Payload ID: 8652
  Gene Symbol: KLK8
  Gene Name: kallikrein-related peptidase 8
  Uniprot ID: O60259
  ENSP ID: ENSP00000472016
MGRPRPRAAKTWMFLLLLGGAWAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 42548 - protein, 97 aa, Homo sapiens
  Payload ID: 8652
  Gene Symbol: KLK8
  Gene Name: kallikrein-related peptidase 8
  ENSP ID: ENSP00000472273
MGRPRPRAAKTWMFLLLLGGAWAGHSRAQEDKVLGGHECQPHSQPWQAALFQGQQLLCGGVLVGGNWVLTAAHCKKPKYTVRLGDHSLQNKDGPEQE

SEQ ID NO: 42549 - protein, 54 aa, Homo sapiens
  Payload ID: 8652
  Gene Symbol: KLK8
  Gene Name: kallikrein-related peptidase 8
  ENSP ID: ENSP00000473067
  MOD_RES (1)..(1): Any amino acid
XLLLLGGAWAGNTQYAWETTAYRIKMAQSKKYLWFSPSHTPATTAAMWRTTTMI

SEQ ID NO: 42550 - protein, 61 aa, Homo sapiens
  Payload ID: 8653
  Gene Symbol: KLK9
  Gene Name: kallikrein-related peptidase 9
  Uniprot ID: Q9UKQ9
  ENSP ID: ENSP00000443289
MKLGLLCALLSLLAGICGSALESTTSGNGRVRSSCSGLRTSSPTLASTRTSAPMTTMMTSC

SEQ ID NO: 42551 - protein, 250 aa, Homo sapiens; identical to SEQ ID NO: 42456
  Payload ID: 8653
  Gene Symbol: KLK9
  Gene Name: kallikrein-related peptidase 9
  Uniprot ID: Q9UKQ9
  ENSP ID: ENSP00000469417

SEQ ID NO: 42552 - protein, 436 aa, Homo sapiens
  Payload ID: 8654
  Gene Symbol: KPTN
  Gene Name: kaptin (actin binding protein)
  Uniprot ID: Q9Y664
  ENSP ID: ENSP00000337850
MMGEAAVAAGPCPLREDSFTRFSSQSNVYGLAGGAGGRGELLAATLKGKVLGFRYQDLRQKIRPVAKELQFNYIPVDAEIVSIDTFNKSPPKRGLVVGITFIKDSGDKGSPFLNIYCDYEPGSEYNLDSIAQSCLNLELQFTPFQLCHAEVQVGDQLETVFLLSGNDPAIHLYKENEGLHQFEEQPVENLFPELTNLTSSVLWLDVHNFPGTSRRLSALGCQSGYVRVAHVDQRSREVLQMWSVLQDGPISRVIVFSLSAAKETKDRPLQDEYSVLVASMLEPAVVYRDLLNRGLEDQLLLPGSDQFDSVLCSLVTDVDLDGRPEVLVATYGQELLCYKYRGPESGLPEAQHGFHLLWQRSFSSPLLAMAHVDLTGDGLQELAVVSLKGVHILQHSLIQASELVLTRLRHQVEQRRRRLQGLEDGAGAGPAENAAS

SEQ ID NO: 42553 - protein, 263 aa, Homo sapiens
  Payload ID: 8654
  Gene Symbol: KPTN
  Gene Name: kaptin (actin binding protein)
  ENSP ID: ENSP00000469446
MMGEAAVAAGPCPLREDSFTRFSSQSNVYGLAGGAGGRGELLAATLKGKVLGFRYQDLRQKIRPVAKELQFNYIPESCLNLELQFTPFQLCHAEVQVGDQLETVFLLSGNDPAIHLYKENEGLHQFEEQPVENLFPELTNLTSSVLWLDVHNFPGTSRRLSALGCQSGYVRVAHVDQRSREVLQMWSVLQDGPISRVIVFSLSAAKETKDRPLQDEYSVLVASMLEPAVVYRDLLNRGLEDQLLLPGSDQFDSVLCSLVTDVD

SEQ ID NO: 42554 - protein, 150 aa, Homo sapiens
  Payload ID: 8654
  Gene Symbol: KPTN
  Gene Name: kaptin (actin binding protein)
  ENSP ID: ENSP00000470364
MMGEAAVAAGPCPLREDSFTRFSSQSNVYGLAGGAGGRGELLAATLKGKVLGFRYQDLRQKIRPVAKELQFNYIPVDAEIVSIDTFNKSPPKRGLVVGITFIKDSGDKGSPFLNIYCDYEPGSEYNLDSIAQSCLNLELQFTPFQLCHAE

SEQ ID NO: 42555 - protein, 42 aa, Homo sapiens
  Payload ID: 8654
  Gene Symbol: KPTN
  Gene Name: kaptin (actin binding protein)
  ENSP ID: ENSP00000472291
MWSVLQDGPISRVIVFSLSAAKETKDRPLQDEYSVLVASMLE

SEQ ID NO: 42556 - protein, 876 aa, Homo sapiens
  Payload ID: 8655
  Gene Symbol: KPNB1
  Gene Name: karyopherin (importin) beta 1
  Uniprot ID: Q14974
  ENSP ID: ENSP00000290158
MELITILEKTVSPDRLELEAAQKFLERAAVENLPTFLVELSRVLANPGNSQVARVAAGLQIKNSLTSKDPDIKAQYQQRWLAIDANARREVKNYVLQTLGTETYRPSSASQCVAGIACAEIPVNQWPELIPQLVANVTNPNSTEHMKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 42557 - protein, 731 aa, Homo sapiens
  Payload ID: 8655
  Gene Symbol: KPNB1
  Gene Name: karyopherin (importin) beta 1
  Uniprot ID: Q14974
  ENSP ID: ENSP00000438253
MKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 42558 - protein, 731 aa, Homo sapiens; identical to SEQ ID NO: 42557
  Payload ID: 8655
  Gene Symbol: KPNB1
  Gene Name: karyopherin (importin) beta 1
  Uniprot ID: Q14974
  ENSP ID: ENSP00000438964

SEQ ID NO: 42559 - protein, 22 aa, Homo sapiens
  Payload ID: 8655
  Gene Symbol: KPNB1
  Gene Name: karyopherin (importin) beta 1
  ENSP ID: ENSP00000462243
  MOD_RES (1)..(1): Any amino acid
XNKAKTLATWATKELRKLKNQA

SEQ ID NO: 42560 - protein, 690 aa, Homo sapiens
  Payload ID: 8655
  Gene Symbol: KPNB1
  Gene Name: karyopherin (importin) beta 1
  ENSP ID: ENSP00000463066
  MOD_RES (1)..(1): Any amino acid
XACAEIPVNQWPELIPQLVANVTNPNSTEHMKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFADENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 42561 - protein, 248 aa, Homo sapiens
  Payload ID: 8655
  Gene Symbol: KPNB1
  Gene Name: karyopherin (importin) beta 1
  ENSP ID: ENSP00000463190
  MOD_RES (1)..(1): Any amino acid
XLEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDSRDRVSPCWTGWSRSPDPRDPPAFAPQSARITGMSHHARPTTIFLYRMKNLGPDGHQNNLRSSAYESLMEIVKNSAKDCYPAVQKTTLVIMERLQQVLQMESHIQSTSDRIQFNDLQSLLCATLQ

SEQ ID NO: 42562 - protein, 148 aa, Homo sapiens
  Payload ID: 8655
  Gene Symbol: KPNB1
  Gene Name: karyopherin (importin) beta 1
  ENSP ID: ENSP00000464042
MELITILEKTVSPDRLELEAAQKFLERAAVENLPTFLVELSRVLANPGNSQVARVAAGLQIKNSLTSKDPDIKAQYQQRWLAIDANARREVKNYVLQTLGTETYRPSSASQCVAGIACAEIPVNQWPELIPQLVANVTNPNSTEHMKE

SEQ ID NO: 42563 - protein, 60 aa, Homo sapiens
  Payload ID: 8655
  Gene Symbol: KPNB1
  Gene Name: karyopherin (importin) beta 1
  ENSP ID: ENSP00000464200
MKESTLEAIGYICQDIDPEQLQDKSNEILTAIIQGMRKEEPSNNVKLAATNALLNSLEFT

SEQ ID NO: 42564 - protein, 538 aa, Homo sapiens
  Payload ID: 8656
  Gene Symbol: KPNA1
  Gene Name: karyopherin alpha 1 (importin alpha 5)
  Uniprot ID: P52294
  ENSP ID: ENSP00000343701
MTTPGKENFRLKSYKNKSLNPDEMRRRREEEGLQLRKQKREEQLFKRRNVATAEEETEEEVMSDGGFHEAQISNMEMAPGGVITSDMIEMIFSKSPEQQLSATQKFRKLLSKEPNPPIDEVISTPGVVARFVEFLKRKENCTLQFESAWVLTNIASGNSLQTRIVIQAGAVPIFIELLSSEFEDVQEQAVWALGNIAGDSTMCRDYVLDCNILPPLLQLFSKQNRLTMTRNAVWALSNLCRGKSPPPEFAKVSPCLNVLSWLLFVSDTDVLADACWALSYLSDGPNDKIQAVIDAGVCRRLVELLMHNDYKVVSPALRAVGNIVTGDDIQTQVILNCSALQSLLHLLSSPKESIKKEACWTISNITAGNRAQIQTVIDANIFPALISILQTAEFRTRKEAAWAITNATSGGSAEQIKYLVELGCIKPLCDLLTVMDSKIVQVALNGLENILRLGEQEAKRNGTGINPYCALIEEAYGLDKIEFLQSHENQEIYQKAFDLIEHYFGTEDEDSSIAPQVDLNQQQYIFQQCEAPMEGFQL

SEQ ID NO: 42565 - protein, 214 aa, Homo sapiens
  Payload ID: 8656
  Gene Symbol: KPNA1
  Gene Name: karyopherin alpha 1 (importin alpha 5)
  ENSP ID: ENSP00000417166
MTTPGKENFRLKSYKNKSLNPDEMRRRREEEGLQLRKQKREEQLFKRRNVATAEEETEEEVMSDGGFHEAQISNMEMAPGGVITSDMIEMIFSKSPEQQLSATQKFRKLLSKEPNPPIDEVISTPGVVARFVEFLKRKENCTLQFESAWVLTNIASGNSLQTRIVIQAGAVPIFIELLSSEFEDVQEQAVWALGNIAGDSTMCRDYVLDCNILP

SEQ ID NO: 42566 - protein, 169 aa, Homo sapiens
  Payload ID: 8656
  Gene Symbol: KPNA1
  Gene Name: karyopherin alpha 1 (importin alpha 5)
  ENSP ID: ENSP00000417319
MTTPGKENFRLKSYKNKSLNPDEMRRRREEEGLQLRKQKREEQLFKRRNVATAEEETEEEVMSDGGFHEAQISNMEMAPGGVITSDMIEMIFSKSPEQQLSATQKFRKLLSKEPNPPIDEVISTPGVVARFVEFLKRKENCTLQAVWALGNIAGDSTMCRDYVLDCNIL

SEQ ID NO: 42567 - protein, 182 aa, Homo sapiens
  Payload ID: 8656
  Gene Symbol: KPNA1
  Gene Name: karyopherin alpha 1 (importin alpha 5)
  ENSP ID: ENSP00000418394
MTTPGKENFRLKSYKNKSLNPDEMRRRREEEGLQLRKQKREEQLFKRRNVATAEEETEEEVMSDGGFHEAQISNMEMAPGGVITSDMIEMIFSKSPEQQLSATQKFRKLLSKEPNPPIDEVISTPGVVARFVEFLKRKENCTLQVSLAFARNQSGTGKVASNRVLIQMEKGNQAYLNLEWET

SEQ ID NO: 42568 - protein, 174 aa, Homo sapiens
  Payload ID: 8656
  Gene Symbol: KPNA1
  Gene Name: karyopherin alpha 1 (importin alpha 5)
  ENSP ID: ENSP00000419257
MTTPGKENFRLKSYKNKSLNPDEMRRRREEEGLQLRKQKREEQLFKRRNVATAEEETEEEVMSDGGFHEAQISNMEMAPGGVITSDMIEMIFSKSPEQQLSATQKFRKLLSKEPNPPIDEVISTPGVVARFVEFLKRKENCTLQFESAWVLTNIASGNSLQTRIVIQAGAVPIF

SEQ ID NO: 42569 - protein, 328 aa, Homo sapiens
  Payload ID: 8656
  Gene Symbol: KPNA1
  Gene Name: karyopherin alpha 1 (importin alpha 5)
  ENSP ID: ENSP00000419890
MTTPGKENFRLKSYKNKSLNPDEMRRRREEEGLQLRKQKREEQLFKRRNVATAEEETEEEVMSDGGFHEAQISNMEMAPGGVITSDMIEMIFSKSPEQQLSATQKFRKLLSKEPNPPIDEVISTPGVVARFVEFLKRKENCTLQFESAWVLTNIASGNSLQTRIVIQAGAVPIFIELLSSEFEDVQEQAVWALGNIAGDSTMCRDYVLDCNILPPLLQLFSKQNRLTMTRNAVWALSNLCRGKSPPPEFAKVSPCLNVLSWLLFVSDTDVLADACWALSYLSDGPNDKIQAVIDAGVCRRLVELLMHNDYKVVSPALRAVGNIVTGDD

SEQ ID NO: 42570 - protein, 182 aa, Homo sapiens; identical to SEQ ID NO: 42567
  Payload ID: 8656
  Gene Symbol: KPNA1
  Gene Name: karyopherin alpha 1 (importin alpha 5)
  ENSP ID: ENSP00000420013

SEQ ID NO: 42571 - protein, 529 aa, Homo sapiens [sequence omitted]

SEQ ID NO: 42572 - protein, 529 aa, Homo sapiens [sequence omitted]

SEQ ID NO: 42573 - protein, 143 aa, Homo sapiens
  Payload ID: 8657
  Gene Symbol: KPNA2
  Gene Name: karyopherin alpha 2 (RAG cohort 1, importin alpha 1)
  ENSP ID: ENSP00000462331
MSTNENANTPAARLHRFKNKGKDSTEMRRRRIEVNVELRKAKKDDQMLKRRNVSSFPDDATSPLQENRNNQGTVNWSVDDIVKGINSSNVENQLQATQAARKLLSREKQPPIDNIIRAGLIPKFVSFLGRTDCSPIQFESAWA

SEQ ID NO: 42574 - protein, 50 aa, Homo sapiens
  Payload ID: 8657
  Gene Symbol: KPNA2
  Gene Name: karyopherin alpha 2 (RAG cohort 1, importin alpha 1)
  ENSP ID: ENSP00000463320
MSTNENANTPAARLHRFKNKGKDSTVKRHVIFSQGNEASQNRGQCGAEES

SEQ ID NO: 42575 - protein, 134 aa, Homo sapiens
  Payload ID: 8657
  Gene Symbol: KPNA2
  Gene Name: karyopherin alpha 2 (RAG cohort 1, importin alpha 1)
  ENSP ID: ENSP00000463602
MSTNENANTPAARLHRFKNKGKDSTEMRRRRIEVNVELRKAKKDDQMLKRRNVSSFPDDATSPLQENRNNQGTVNWSVDDIVKGINSSNVENQLQATQAARKLLSREKQPPIDNIIRAGLIPKFVSFLGRTDCS

SEQ ID NO: 42576 - protein, 521 aa, Homo sapiens
  Payload ID: 8658
  Gene Symbol: KPNA3
  Gene Name: karyopherin alpha 3 (importin alpha 4)
  Uniprot ID: O00505
  ENSP ID: ENSP00000261667
MAENPSLENHRIKSFKNKGRDVETMRRHRNEVTVELRKNKRDEHLLKKRNVPQEESLEDSDVDADFKAQNVTLEAILQNATSDNPVVQLSAVQAARKLLSSDRNPPIDDLIKSGILPILVKCLERDDNPSLQFEAAWALTNIASGTSAQTQAVVQSNAVPLFLRLLRSPHQNVCEQAVWALGNIIGDGPQCRDYVISLGVVKPLLSFISPSIPITFLRNVTWVIVNLCRNKDPPPPMETVQEILPALCVLIYHTDINILVDTVWALSYLTDGGNEQIQMVIDSGVVPFLVPLLSHQEVKVQTAALRAVGNIVTGTDEQTQVVLNCDVLSHFPNLLSHPKEKINKEAVWFLSNITAGNQQQVQAVIDAGLIPMIIHQLAKGDFGTQKEAAWAISNLTISGRKDQVEYLVQQNVIPPFCNLLSVKDSQVVQVVLDGLKNILIMAGDEASTIAEIIEECGGLEKIEVLQQHENEDIYKLAFEIIDQYFSGDDIDEDPCLIPEATQGGTYNFDPTANLQTKEFNF

SEQ ID NO: 42577 - protein, 91 aa, Homo sapiens
  Payload ID: 8658
  Gene Symbol: KPNA3
  Gene Name: karyopherin alpha 3 (importin alpha 4)
  ENSP ID: ENSP00000393869
  MOD_RES (1)..(1): Any amino acid
XPFCNLLSVKDSQVVQVVLDGLKNILIMAGDEASTIAEIIEECGGLEKIEVLQQHENEDIYKLAFEIIDQYFSGDDIDEDPCLIPEATQGG

SEQ ID NO: 42578 - protein, 521 aa, Homo sapiens
  Payload ID: 8659
  Gene Symbol: KPNA4
  Gene Name: karyopherin alpha 4 (importin alpha 3)
  Uniprot ID: O00629
  ENSP ID: ENSP00000334373
MADNEKLDNQRLKNFKNKGRDLETMRRQRNEVVVELRKNKRDEHLLKRRNVPHEDICEDSDIDGDYRVQNTSLEAIVQNASSDNQGIQLSAVQAARKLLSSDRNPPIDDLIKSGILPILVHCLERDDNPSLQFEAAWALTNIASGTSEQTQAVVQSNAVPLFLRLLHSPHQNVCEQAVWALGNIIGDGPQCRDYVISLGVVKPLLSFISPSIPITFLRNVTWVMVNLCRHKDPPPPMETIQEILPALCVLIHHTDVNILVDTVWALSYLTDAGNEQIQMVIDSGIVPHLVPLLSHQEVKVQTAALRAVGNIVTGTDEQTQVVLNCDALSHFPALLTHPKEKINKEAVWFLSNITAGNQQQVQAVIDANLVPMIIHLLDKGDFGTQKEAAWAISNLTISGRKDQVAYLIQQNVIPPFCNLLTVKDAQVVQVVLDGLSNILKMAEDEAETIGNLIEECGGLEKIEQLQNHENEDIYKLAYEIIDQFFSSDDIDEDPSLVPEAIQGGTFGFNSSANVPTEGFQF

SEQ ID NO: 42579 - protein, 170 aa, Homo sapiens
  Payload ID: 8659
  Gene Symbol: KPNA4
  Gene Name: karyopherin alpha 4 (importin alpha 3)
  ENSP ID: ENSP00000417172
QEVKVQTAALRAVGNIVTGTDEQTQVVLNCDALSHFPALLTHPKEKINKEAVWFLSNITAGNQQQVQAVIDANLVPMIIHLLDKVAYLIQQNVIPPFCNLLTVKDAQVVQVVLDGLSNILKMAEDEAETIGNLIEECGGLEKIEQLQNHENEDIYKLAYEIIDQFFSSDD

SEQ ID NO: 42580 - protein, 539 aa, Homo sapiens
  Payload ID: 8660
  Gene Symbol: KPNA5
  Gene Name: karyopherin alpha 5 (importin alpha 6)
  Uniprot ID: O15131
  ENSP ID: ENSP00000348704
MDAMASPGKDNYRMKSYKNKALNPQEMRRRREEEGIQLRKQKREEQLFKRRNVYLPRNDESMLESPIQDPDISSTVPIPEEEVVTTDMVQMIFSNNADQQLTATQKFRKLLSKEPNPPIDQVIQKPGVVQRFVKFLERNENCTLQFEAAWALTNIASGTFLHTKVVIETGAVPIFIKLLNSEHEDVQEQAVWALGNIAGDNAECRDFVLNCEILPPLLELLTNSNRLTTTRNAVWALSNLCRGKNPPPNFSKVSPCLNVLSRLLFSSDPDVLADVCWALSYLSDGPNDKIQAVIDSGVCRRLVELLMHNDYKVVSPALRAVGNIVTGDDIQTQVILNCSALPCLLHLLSSPKESIRKEACWTVSNITAGNRAQIQAVIDANIFPVLIEILQKAEFRTRKEAAWAITNATSGGTPEQIRYLVALGCIKPLCDLLTVMDSKIVQVALNGLENILRLGEQESKQNGIGINPYCALIEEAYGLDKIEFLQSHENQEIYQKAFDLIEHYFGVEEDDPSIVPQVDENQQQFIFQQQEAPMDGFQL

SEQ ID NO: 42581 - protein, 539 aa, Homo sapiens; identical to SEQ ID NO: 42580
  Payload ID: 8660
  Gene Symbol: KPNA5
  Gene Name: karyopherin alpha 5 (importin alpha 6)
  Uniprot ID: O15131
  ENSP ID: ENSP00000357552

SEQ ID NO: 42582 - protein, 122 aa, Homo sapiens
  Payload ID: 8660
  Gene Symbol: KPNA5
  Gene Name: karyopherin alpha 5 (importin alpha 6)
  ENSP ID: ENSP00000376302
  MOD_RES (1)..(1): Any amino acid
XYLVALGCIKPLCDLLTVMDSKIVQVALNGLENILRLGEQESKQNGIGINPYCALIEEAYGLDKIEFLQSHENQEIYQKAFDLIEHYFGVEEDDPSIVPQVDENQQQFIFQQQEAPMDGFQL

SEQ ID NO: 42583 - protein, 142 aa, Homo sapiens
  Payload ID: 8660
  Gene Symbol: KPNA5
  Gene Name: karyopherin alpha 5 (importin alpha 6)
  ENSP ID: ENSP00000396791
MASPGKDNYRMKSYKNKALNPQEMRRRREEEGIQLRKQKREEQLFKRRNVYLPRNDESMLESPIQDPDISSTVPIPEEEVVTTDMVQMIFSNNADQQLTATQKFRKLLSKEPNPPIDQVIQKPGVVQRFVKFLERNENCTLQ

SEQ ID NO: 42584 - protein, 536 aa, Homo sapiens
  Payload ID: 8661
  Gene Symbol: KPNA6
  Gene Name: karyopherin alpha 6 (importin alpha 7)
  Uniprot ID: O60684
  ENSP ID: ENSP00000362728
METMASPGKDNYRMKSYKNNALNPEEMRRRREEEGIQLRKQKREQQLFKRRNVELINEEAAMFDSLLMDSYVSSTTGESVITREMVEMLFSDDSDLQLATTQKFRKLLSKEPSPPIDEVINTPRVVDRFVEFLKRNENCTLQFEAAWALTNIASGTSQQTKIVIEAGAVPIFIELLNSDFEDVQEQAVWALGNIAGDSSVCRDYVLNCSILNPLLTLLTKSTRLTMTRNAVWALSNLCRGKNPPPEFAKVSPCLPVLSRLLFSSDSDLLADACWALSYLSDGPNEKIQAVIDSGVCRRLVELLMHNDYKVASPALRAVGNIVTGDDIQTQVILNCSALPCLLHLLSSPKESIRKEACWTISNITAGNRAQIQAVIDANIFPVLIEILQKAEFRTRKEAAWAITNATSGGTPEQIRYLVSLGCIKPLCDLLTVMDSKIVQVALNGLENILRLGEQEGKRSGSGVNPYCGLIEEAYGLDKIEFLQSHENQEIYQKAFDLIEHYFGVEDDDSSLAPQVDETQQQFIFQQPEAPMEGFQL

SEQ ID NO: 42585 - protein, 321 aa, Homo sapiens
  Payload ID: 8661
  Gene Symbol: KPNA6
  Gene Name: karyopherin alpha 6 (importin alpha 7)
  ENSP ID: ENSP00000415677
RRNVELINEEAAMFDSLLMDSYVSSTTGESVITREMVEMLFSDDSDLQLATTQKFRKLLSKEPSPPIDEVINTPRVVDRFVEFLKRNENCTLQAVWALGNIAGDSSVCRDYVLNCSILNPLLTLLTKSTRLTMTRNAVWALSNLCRGKNPPPEFAKVSPCLPVLSRLLFSSDSDLLADACWALSYLSDGPNEKIQAVIDSGVCRRLVELLMHNDYKVASPALRAVGNIVTGDDIQTQVILNCSALPCLLHLLSSPKESIRKEACWTISNITAGNRAQIQAVIDANIFPVLIEILQKAEFRTRKEAAWAITNATSGGTPEQI

SEQ ID NO: 42586 - protein, 186 aa, Homo sapiens
  Payload ID: 8661
  Gene Symbol: KPNA6
  Gene Name: karyopherin alpha 6 (importin alpha 7)
  ENSP ID: ENSP00000474234
METMASPGKDNYRMKSYKNNALNPEEMRRRREEEGIQLRKQKREQQLFKRRNVELINEEAAMFDSLLMDSYESVITREMVEMLFSDDSDLQLATTQKFRKLLSKEPSPPIDEVINTPRVVDRFVEFLKRNENCTLQFEAAWALTNIASGTSQQTKIVIEAGAVPIFIELLNSDFEDVQEQSGHWET

SEQ ID NO: 42587 - protein, 516 aa, Homo sapiens
  Payload ID: 8662
  Gene Symbol: KPNA7
  Gene Name: karyopherin alpha 7 (importin alpha 8)
  Uniprot ID: A9QM74
  ENSP ID: ENSP00000330878
MPTLDAPEERRRKFKYRGKDVSLRRQQRMAVSLELRKAKKDEQTLKRRNITSFCPDTPSEKTAKGVAVSLTLGEIIKGVNSSDPVLCFQATQTARKMLSQEKNPPLKLVIEAGLIPRMVEFLKSSLYPCLQFEAAWALTNIASGTSEQTRAVVEGGAIQPLIELLSSSNVAVCEQAVWALGNIAGDGPEFRDNVITSNAIPHLLALISPTLPITFLRNITWTLSNLCRNKNPYPCDTAVKQILPALLHLLQHQDSEVLSDACWALSYLTDGSNKRIGQVVNTGVLPRLVVLMTSSELNVLTPSLRTVGNIVTGTDEQTQMAIDAGMLNVLPQLLQHNKPSIQKEAAWALSNVAAGPCHHIQQLLAYDVLPPLVALLKNGEFKVQKEAVWMVANFATGATMDQLIQLVHSGVLEPLVNLLTAPDVKIVLIILDVISCILQAAEKRSEKENLCLLIEELGGIDRIEALQLHENRQIGQSALNIIEKHFGEEEDESQTLLSQVIDQDYEFIDYECLAKK

SEQ ID NO: 42588 - protein, 1105 aa, Homo sapiens
  Payload ID: 8663
  Gene Symbol: KANSL1
  Gene Name: KAT8 regulatory NSL complex subunit 1
  Uniprot ID: Q7Z3B3
  ENSP ID: ENSP00000262419
MAAMAPALTDAAAEAHHIRFKLAPPSSTLSPGSAENNGNANILIAANGTKRKAIAAEDPSLDFRNNPTKEDLGKLQPLVASYLCSDVTSVPSKESLKLQGVFSKQTVLKSHPLLSQSYELRAELLGRQPVLEFSLENLRTMNTSGQTALPQAPVNGLAKKLTKSSTHSDHDNSTSLNGGKRALTSSALHGGEMGGSESGDLKGGMTNCTLPHRSLDVEHTTLYSNNSTANKSSVNSMEQPALQGSSRLSPGTDSSSNLGGVKLEGKKSPLSSILFSALDSDTRITALLRRQADIESRARRLQKRLQVVQAKQVERHIQHQLGGFLEKTLSKLPNLESLRPRSQLMLTRKAEAALRKAASETTTSEGLSNFLKSNSISEELERFTASGIANLRCSEQAFDSDVTDSSSGGESDIEEEELTRADPEQRHVPLRRRSEWKWAADRAAIVSRWNWLQAHVSDLEYRIRQQTDIYKQIRANKGLIVLGEVPPPEHTTDLFLPLSSEVKTDHGTDKLIESVSQPLENHGAPIIGHISESLSTKSCGALRPVNGVINTLQPVLADHIPGDSSDAEEQLHKKQRLNLVSSSSDGTCVAARTRPVLSCKKRRLVRPNSIVPLSKKVHRNSTIRPGCDVNPSCALCGSGSINTMPPEIHYEAPLLERLSQLDSCVHPVLAFPDDVPTSLHFQSMLKSQWQNKPFDKIKPPKKLSLKHRAPMPGSLPDSARKDRHKLVSSFLTTAKLSHHQTRPDRTHRQHLDDVGAVPMVERVTAPKAERLLNPPPPVHDPNHSKMRLRDHSSERSEVLKHHTDMSSSSYLAATHHPPHSPLVRQLSTSSDSPAPASSSSQVTASTSQQPVRRRRGESSFDINNIVIPMSVAATTRVEKLQYKEILTPSWREVDLQSLKGSPDEENEEIEDLSDAAFAALHAKCEEMERARWLWTTSVPPQRRGSRSYRSSDGRTTPQLGSANPSTPQPASPDVSSSHSLSEYSHGQSPRSPISPELHSAPLTPVARDTPRHLASEDTRCSTPELGLDEQSVQPWERRTFPLAHSPQAECEDQLDAQERAARCTRRTSGSKTGRETEAAPTSPPIVPLKSRHLVAAATAQRPTHR

SEQ ID NO: 42589 - protein, 1104 aa, Homo sapiens
  Payload ID: 8663
  Gene Symbol: KANSL1
  Gene Name: KAT8 regulatory NSL complex subunit 1
  Uniprot ID: Q7Z3B3
  ENSP ID: ENSP00000387393
MAAMAPALTDAAAEAHHIRFKLAPPSSTLSPGSAENNGNANILIAANGTKRKAIAAEDPSLDFRNNPTKEDLGKLQPLVASYLCSDVTSVPSKESLKLQGVFSKQTVLKSHPLLSQSYELRAELLGRQPVLEFSLENLRTMNTSGQTALPQAPVNGLAKKLTKSSTHSDHDNSTSLNGGKRALTSSALHGGEMGGSESGDLKGGMTNCTLPHRSLDVEHTTLYSNNSTANKSSVNSMEQPALQGSSRLSPGTDSSSNLGGVKLEGKKSPLSSILFSALDSDTRITALLRRQADIESRARRLQKRLQVVQAKQVERHIQHQLGGFLEKTLSKLPNLESLRPRSQLMLTRKAEAALRKAASETTTSEGLSNFLKSNSISEELERFTASGIANLRCSEQAFDSDVTDSSSGGESDIEEEELTRADPEQRHVPLRRRSEWKWAADRAAIVSRWNWLQAHVSDLEYRIRQQTDIYKQIRANKGLIVLGEVPPPEHTTDLFLPLSSEVKTDHGTDKLIESVSQPLENHGAPIIGHISESLSTKSCGALRPVNGVINTLQPVLADHIPGDSSDAEEQLHKKQRLNLVSSSSDGTCVAARTRPVLSCKKRRLVRPNSIVPLSKKVHRNSTIRPGCDVNPSCALCGSGSINTMPPEIHYEAPLLERLSQLDSCVHPVLAFPDDVPTSLHFQSMLKSQWQNKPFDKIKPPKKLSLKHRAPMPGSLPDSARKDRHKLVSSFLTTAKLSHHQTRPDRTHRQHLDDVGAVPMVERVTAPKAERLLNPPPPVHDPNHSKMRLRDHSSERSEVLKHHTDMSSSSYLAATHHPPHSPLVRQLSTSSDSPAPASSSSQVTASTSQPVRRRRGESSFDINNIVIPMSVAATTRVEKLQYKEILTPSWREVDLQSLKGSPDEENEEIEDLSDAAFAALHAKCEEMERARWLWTTSVPPQRRGSRSYRSSDGRTTPQLGSANPSTPQPASPDVSSSHSLSEYSHGQSPRSPISPELHSAPLTPVARDTPRHLASEDTRCSTPELGLDEQSVQPWERRTFPLAHSPQAECEDQLDAQERAARCTRRTSGSKTGRETEAAPTSPPIVPLKSRHLVAAATAQRPTHR

SEQ ID NO: 42590 - protein, 122 aa, Homo sapiens
  Payload ID: 8663
  Gene Symbol: KANSL1
  Gene Name: KAT8 regulatory NSL complex subunit 1
  ENSP ID: ENSP00000459330
MAAMAPALTDAAAEAHHIRFKLAPPSSTLSPGSAENNGNANILIAANGTKRKAIAAEDPSLDFRNNPTKEDLGKLQPLVASYLCSDVTSVPSKESLKLQGVFSKQTVLKSHPLLSQSYELRA

SEQ ID NO: 42591 - protein, 139 aa, Homo sapiens
  Payload ID: 8663
  Gene Symbol: KANSL1
  Gene Name: KAT8 regulatory NSL complex subunit 1
  ENSP ID: ENSP00000459359
MAAMAPALTDAAAEAHHIRFKLAPPSSTLSPGSAENNGNANILIAANGTKRKAIAAEDPSLDFRNNPTKEDLGKLQPLVASYLCSDVTSVPSKESLKLQGVFSKQTVLKSHPLLSQSYELRAELLGRQPVLEFSLENLR

SEQ ID NO: 42592 - protein, 9 aa, Homo sapiens
  Payload ID: 8663
  Gene Symbol: KANSL1
  Gene Name: KAT8 regulatory NSL complex subunit 1
  ENSP ID: ENSP00000459627
MAAMAPALT

SEQ ID NO: 42593 - protein, 1041 aa, Homo sapiens
  Payload ID: 8663
  Gene Symbol: KANSL1
  Gene Name: KAT8 regulatory NSL complex subunit 1
  ENSP ID: ENSP00000461299
MAAMAPALTDAAAEAHHIRFKLAPPSSTLSPGSAENNGNANILIAANGTKRKAIAAEDPSLDFRNNPTKEDLGKLQPLVASYLCSDVTSVPSKESLKLQGVFSKQTVLKSHPLLSQSYELRAELLGRQPVLEFSLENLRTMNTSGQTALPQAPVNGLAKKLTKSSTHSDHDNSTSLNGGKRALTSSALHGGEMGGSESGDLKGGMTNCTLPHRSLDVEHTTLYSNNSTANKSSVNSMEQPALQGSSRLSPGTDSSSNLGGVKLEGKKSPLSSILFSALDSDTRITALLRRQADIESRARRLQKRLQVVQAKQVERHIQHQLGGFLEKTLSKLPNLESLRPRSQLMLTRKAEAALRKAASETTTSEGLSNFLKSNSISEELERFTASGIANLRCSEQAFDSDVTDSSSGGESDIEEEELTRADPEQRHVPLRRRSEWKWAADRAAIVSRWNWLQAHVSDLEYRIRQQTDIYKQIRANKGLIVLGEVPPPEHTTDLFLPLSSEVKTDHGTDKLIESVSQPLENHGAPIIGHISESLSTKSCGALRPVNGVINTLQPVLADHIPGDSSDAEEQLHKKQRLNLVSSSSDGTCVAARTRPVLSCKKRRLVRPNSIVPLSKKVHRNSTIRPGCDVNPSCALCGSGSINTMPPEIHYEAPLLERLSQLDSCVHPVLAFPDDVPTSLHFQSMLKSQWQNKPFDKIKPPKKLSLKHRAPMPGSLPDSARKDRHKLVSSFLTTAMLKHHTDMSSSSYLAATHHPPHSPLVRQLSTSSDSPAPASSSSQVTASTSQPVRRRRGESSFDINNIVIPMSVAATTRVEKLQYKEILTPSWREVDLQSLKGSPDEENEEIEDLSDAAFAALHAKCEEMERARWLWTTSVPPQRRGSRSYRSSDGRTTPQLGSANPSTPQPASPDVSSSHSLSEYSHGQSPRSPISPELHSAPLTPVARDTPRHLASEDTRCSTPELGLDEQSVQPWERRTFPLAHSPQAECEDQLDAQERAARCTRRTSGSKTGRETEAAPTSPPIVPLKSRHLVAAATAQRPTHR

SEQ ID NO: 42594 - protein, 1105 aa, Homo sapiens; identical to SEQ ID NO: 42588
  Payload ID: 8663
  Gene Symbol: KANSL1
  Gene Name: KAT8 regulatory NSL complex subunit 1
  Uniprot ID: Q7Z3B3
  ENSP ID: ENSP00000461484

SEQ ID NO: 42595 - protein, 1105 aa, Homo sapiens; identical to SEQ ID NO: 42588
  Payload ID: 8663
  Gene Symbol: KANSL1
  Gene Name: KAT8 regulatory NSL complex subunit 1
  Uniprot ID: Q7Z3B3
  ENSP ID: ENSP00000461812

SEQ ID NO: 42596 - protein, 1105 aa, Homo sapiens
  Payload ID: 8663
  Gene Symbol: KANSL1
  Gene Name: KAT8 regulatory NSL complex subunit 1
  ENSP ID: ENSP00000479863
MAAMAPALTDAAAEAHHIRFKLAPPSSTLSPGSAENNGNANILIAANGTKRKAIAAEDPSLDFRNNPTKEDLGKLQPLVASYLCSDVTSVPSKESLKLQGVFSKQTVLKSHPLLSQSYELRAELLGRQPVLEFSLENLRTMNTSGQTALPQAPVNGLAKKLTKSSTHSDHDNSTSLNGGKRALTSSALHGGEMGGSESGDLKGGMTNCTLPHRSLDVEHTTLYSNNSTANKSSVNSMEQPALQGSSRLSPGTDSSSNLGGVKLEGKKSPLSSILFSALDSDTRITALLRRQADIESRARRLQKRLQVVQAKQVERHIQHQLGGFLEKTLSKLPNLESLRPRSQLMLTRKAEAALRKAASETTTSEGLSNFLKSNSISEELERFTASGIANLRCSEQAFDSDVTDSSSGGESDIEEEELTRADPEQRHVPLRRRSEWKWAADRAAIVSRWNWLQAHVSDLEYRIRQQTDIYKQIRANKGLIVLGEVPPPEHTTDLFLPLSSEVKTDHGTDKLIESVSQPLENHGAPIIGHISESLSTKSCGALRPVNGVINTLQPVLADHIPGDSSDAEEQLHKKQRLNLVSSSSDGTCVAARTRPVLSCKKRRLVRPNSIVPLSKKVHRNSTIRPGCDVNPSCALCGSGSINTMPPEIHYEAPLLERLSQLDSCVHPVLAFPDDVPTSLHFQSMLKSQWQNKPFDKIKPPKKLSLKHRAPMPGSLPDPARKDRHKLVSSFLTTAKLSHHQTRPDRTHRQHLDDVGAVPMVERVTAPKAERLLNPPPPVHDPNHSKMRLRDHSSERSEVLKHHTDMSSSSYLAATHHPPHSPLVRQLSTSSDSPAPASSSSQVTASTSQQPVRRRRGESSFDINNIVIPMSVAATTRVEKLQYKEILTPSWREVDLQSLKGSPDEENEEIEDLSDAAFAALHAKCEEMERARWLWTTSVPPQRRGSRSYRSSDGRTTPQLGSANPSTPQPASPDVSSSHSLSEYSHGQSPRSPISPELHSAPLTPVARDTPRHLASEDTRCSTPELGLDEQSVQPWERRTFPLAHSPQAECEDQLDAQERAARCTRRTSGSKTGRETEAAPTSPPTVPLKSRHLVAAATAQRPTHR

SEQ ID NO: 42597 - protein, 1104 aa, Homo sapiens
  Payload ID: 8663
  Gene Symbol: KANSL1
  Gene Name: KAT8 regulatory NSL complex subunit 1
  ENSP ID: ENSP00000480995
MAAMAPALTDAAAEAHHIRFKLAPPSSTLSPGSAENNGNANILIAANGTKRKAIAAEDPSLDFRNNPTKEDLGKLQPLVASYLCSDVTSVPSKESLKLQGVFSKQTVLKSHPLLSQSYELRAELLGRQPVLEFSLENLRTMNTSGQTALPQAPVNGLAKKLTKSSTHSDHDNSTSLNGGKRALTSSALHGGEMGGSESGDLKGGMTNCTLPHRSLDVEHTTLYSNNSTANKSSVNSMEQPALQGSSRLSPGTDSSSNLGGVKLEGKKSPLSSILFSALDSDTRITALLRRQADIESRARRLQKRLQVVQAKQVERHIQHQLGGFLEKTLSKLPNLESLRPRSQLMLTRKAEAALRKAASETTTSEGLSNFLKSNSISEELERFTASGIANLRCSEQAFDSDVTDSSSGGESDIEEEELTRADPEQRHVPLRRRSEWKWAADRAAIVSRWNWLQAHVSDLEYRIRQQTDIYKQIRANKGLIVLGEVPPPEHTTDLFLPLSSEVKTDHGTDKLIESVSQPLENHGAPIIGHISESLSTKSCGALRPVNGVINTLQPVLADHIPGDSSDAEEQLHKKQRLNLVSSSSDGTCVAARTRPVLSCKKRRLVRPNSIVPLSKKVHRNSTIRPGCDVNPSCALCGSGSINTMPPEIHYEAPLLERLSQLDSCVHPVLAFPDDVPTSLHFQSMLKSQWQNKPFDKIKPPKKLSLKHRAPMPGSLPDSARKDRHKLVSSFLTTAKLSHHQTRPDRTHRQHLDDVGAVPMVERVTAPKAERLLNPPPPVHDPNHSKMRLRDHSSERSEVLKHHTDMSSSSYLAATHHPPHSPLVRQLSTSSDSPAPASSSSQVTASTSQPVRRRRGESSFDINNIVIPMSVAATTRVEKLQYKEILTPSWREVDLQSLKGSPDEENEEIEDLSDAAFAALHAKCEEMERARWLWTTSVPPQRRGSRSYRSSDGRTTPQLGSANPSTPQPASPDVSSSHSLSEYSHGQSPRSPISPELHSAPLTPVARDTLRHLASEDTRCSTPELGLDEQSVQPWERRTFPLAHSPQAECEDQLDAQERAARCTRRTSGSKTGRETEAAPTSPPIVPLKSRHLVAAATAQRPTHR

SEQ ID NO: 42598 - protein, 1105 aa, Homo sapiens
  Payload ID: 8663
  Gene Symbol: KANSL1
  Gene Name: KAT8 regulatory NSL complex subunit 1
  ENSP ID: ENSP00000482074
MAAMAPALTDAAAEAHHIRFKLAPPSSTLSPGSAENNGNANILIAANGTKRKAIAAEDPSLDFRNNPTKEDLGKLQPLVASYLCSDVTSVPSKESLKLQGVFSKQTVLKSHPLLSQSYELRAELLGRQPVLEFSLENLRTMNTSGQTALPQAPVNGLAKKLTKSSTHSDHDNSTSLNGGKRALTSSALHGGEMGGSESGDLKGGMTNCTLPHRSLDVEHTTLYSNNSTANKSSVNSMEQPALQGSSRLSPGTDSSSNLGGVKLEGKKSPLSSILFSALDSDTRITALLRRQADIESRARRLQKRLQVVQAKQVERHIQHQLGGFLEKTLSKLPNLESLRPRSQLMLTRKAEAALRKAASETTTSEGLSNFLKSNSISEELERFTASGIANLRCSEQAFDSDVTDSSSGGESDIEEEELTRADPEQRHVPLRRRSEWKWAADRAAIVSRWNWLQAHVSDLEYRIRQQTDIYKQIRANKGLIVLGEVPPPEHTTDLFLPLSSEVKTDHGTDKLIESVSQPLENHGAPIIGHISESLSTKSCGALRPVNGVINTLQPVLADHIPGDSSDAEEQLHKKQRLNLVSSSSDGTCVAARTRPVLSCKKRRLVRPNSIVPLSKKVHRNSTIRPGCDVNPSCALCGSGSINTMPPEIHYEAPLLERLSQLDSCVHPVLAFPDDVPTSLHFQSMLKSQWQNKPFDKIKPPKKLSLKHRAPMPGSLPDSARKDRHKLVSSFLTTAKLSHHQTRPDRTHRQHLDDVGAVPMVERVTAPKAERLLNPPPPVHDPNHSKMRLRDHSSERSEVLKHHTDMSSSSYLAATHHPPHSPLVRQLSTSSDSPAPASSSSQVTASTSQQPVRRRRGESSFDINNIVIPMSVAATTRVEKLQYKEILTPSWREVDLQSLKGSPDEENEEIEDLSDAAFAALHAKCEEMERARWLWTTSVPPQRRGSRSYRSSDGRTTPQLGSANPSTPQPASPDVSSSHSLSEYSHGQSPRSPISPELHSAPLTPVARDTLRHLASEDTRCSTPELGLDEQSVQPWERRTFPLAHSPQAECEDQLDAQERAARCTRRTSGSKTGRETEAAPTSPPIVPLKSRHLVAAATAQRPTHR

SEQ ID NO: 42599 - protein, 1105 aa, Homo sapiens; identical to SEQ ID NO: 42598
  Payload ID: 8663
  Gene Symbol: KANSL1
  Gene Name: KAT8 regulatory NSL complex subunit 1
  ENSP ID: ENSP00000484212

SEQ ID NO: 42600 - protein, 1105 aa, Homo sapiens; identical to SEQ ID NO: 42596
  Payload ID: 8663
  Gene Symbol: KANSL1
  Gene Name: KAT8 regulatory NSL complex subunit 1
  ENSP ID: ENSP00000485807

SEQ ID NO: 42601 - protein, 1041 aa, Homo sapiens
  Payload ID: 8663
  Gene Symbol: KANSL1
  Gene Name: KAT8 regulatory NSL complex subunit 1
  ENSP ID: ENSP00000485811
MAAMAPALTDAAAEAHHIRFKLAPPSSTLSPGSAENNGNANILIAANGTKRKAIAAEDPSLDFRNNPTKEDLGKLQPLVASYLCSDVTSVPSKESLKLQGVFSKQTVLKSHPLLSQSYELRAELLGRQPVLEFSLENLRTMNTSGQTALPQAPVNGLAKKLTKSSTHSDHDNSTSLNGGKRALTSSALHGGEMGGSESGDLKGGMTNCTLPHRSLDVEHTTLYSNNSTANKSSVNSMEQPALQGSSRLSPGTDSSSNLGGVKLEGKKSPLSSILFSALDSDTRITALLRRQADIESRARRLQKRLQVVQAKQVERHIQHQLGGFLEKTLSKLPNLESLRPRSQLMLTRKAEAALRKAASETTTSEGLSNFLKSNSISEELERFTASGIANLRCSEQAFDSDVTDSSSGGESDIEEEELTRADPEQRHVPLRRRSEWKWAADRAAIVSRWNWLQAHVSDLEYRIRQQTDIYKQIRANKGLIVLGEVPPPEHTTDLFLPLSSEVKTDHGTDKLIESVSQPLENHGAPIIGHISESLSTKSCGALRPVNGVINTLQPVLADHIPGDSSDAEEQLHKKQRLNLVSSSSDGTCVAARTRPVLSCKKRRLVRPNSIVPLSKKVHRNSTIRPGCDVNPSCALCGSGSINTMPPEIHYEAPLLERLSQLDSCVHPVLAFPDDVPTSLHFQSMLKSQWQNKPFDKIKPPKKLSLKHRAPMPGSLPDPARKDRHKLVSSFLTTAMLKHHTDMSSSSYLAATHHPPHSPLVRQLSTSSDSPAPASSSSQVTASTSQPVRRRRGESSFDINNIVIPMSVAATTRVEKLQYKEILTPSWREVDLQSLKGSPDEENEEIEDLSDAAFAALHAKCEEMERARWLWTTSVPPQRRGSRSYRSSDGRTTPQLGSANPSTPQPASPDVSSSHSLSEYSHGQSPRSPISPELHSAPLTPVARDTPRHLASEDTRCSTPELGLDEQSVQPWERRTFPLAHSPQAECEDQLDAQERAARCTRRTSGSKTGRETEAAPTSPPTVPLKSRHLVAAATAQRPTHR

SEQ ID NO: 42602 - protein, 1105 aa, Homo sapiens; identical to SEQ ID NO: 42596
  Payload ID: 8663
  Gene Symbol: KANSL1
  Gene Name: KAT8 regulatory NSL complex subunit 1
  ENSP ID: ENSP00000486009

SEQ ID NO: 42603 - protein, 9 aa, Homo sapiens
  Payload ID: 8663
  Gene Symbol: KANSL1
  Gene Name: KAT8 regulatory NSL complex subunit 1
  ENSP ID: ENSP00000486043
MAAMAPALT

SEQ ID NO: 42604 - protein, 1105 aa, Homo sapiens; identical to SEQ ID NO: 42596
  Payload ID: 8663
  Gene Symbol: KANSL1
  Gene Name: KAT8 regulatory NSL complex subunit 1
  ENSP ID: ENSP00000486326

SEQ ID NO: 42605 - protein, 139 aa, Homo sapiens; identical to SEQ ID NO: 42591
  Payload ID: 8663
  Gene Symbol: KANSL1
  Gene Name: KAT8 regulatory NSL complex subunit 1
  ENSP ID: ENSP00000486338

SEQ ID NO: 42606 - protein, 122 aa, Homo sapiens; identical to SEQ ID NO: 42590
  Payload ID: 8663
  Gene Symbol: KANSL1
  Gene Name: KAT8 regulatory NSL complex subunit 1
  ENSP ID: ENSP00000487137

SEQ ID NO: 42607 - protein, 1041 aa, Homo sapiens
  Payload ID: 8663
  Gene Symbol: KANSL1
  Gene Name: KAT8 regulatory NSL complex subunit 1
  ENSP ID: ENSP00000487644
MAAMAPALTDAAAEAHHIRFKLAPPSSTLSPGSAENNGNANILIAANGTKRKAIAAEDPSLDFRNNPTKEDLGKLQPLVASYLCSDVTSVPSKESLKLQGVFSKQTVLKSHPLLSQSYELRAELLGRQPVLEFSLENLRTMNTSGQTALPQAPVNGLAKKLTKSSTHSDHDNSTSLNGGKRALTSSALHGGEMGGSESGDLKGGMTNCTLPHRSLDVEHTTLYSNNSTANKSSVNSMEQPALQGSSRLSPGTDSSSNLGGVKLEGKKSPLSSILFSALDSDTRITALLRRQADIESRARRLQKRLQVVQAKQVERHIQHQLGGFLEKTLSKLPNLESLRPRSQLMLTRKAEAALRKAASETTTSEGLSNFLKSNSISEELERFTASGIANLRCSEQAFDSDVTDSSSGGESDIEEEELTRADPEQRHVPLRRRSEWKWAADRAAIVSRWNWLQAHVSDLEYRIRQQTDIYKQIRANKGLIVLGEVPPPEHTTDLFLPLSSEVKTDHGTDKLIESVSQPLENHGAPIIGHISESLSTKSCGALRPVNGVINTLQPVLADHIPGDSSDAEEQLHKKQRLNLVSSSSDGTCVAARTRPVLSCKKRRLVRPNSIVPLSKKVHRNSTIRPGCDVNPSCALCGSGSINTMPPEIHYEAPLLERLSQLDSCVHPVLAFPDDVPTSLHFQSMLKSQWQNKPFDKIKPPKKLSLKHRAPMPGSLPDSARKDRHKLVSSFLTTAMLKHHTDMSSSSYLAATHHPPHSPLVRQLSTSSDSPAPASSSSQVTASTSQPVRRRRGESSFDINNIVIPMSVAATTRVEKLQYKEILTPSWREVDLQSLKGSPDEENEEIEDLSDAAFAALHAKCEEMERARWLWTTSVPPQRRGSRSYRSSDGRTTPQLGSANPSTPQPASPDVSSSHSLSEYSHGQSPRSPISPELHSAPLTPVARDTLRHLASEDTRCSTPELGLDEQSVQPWERRTFPLAHSPQAECEDQLDAQERAARCTRRTSGSKTGRETEAAPTSPPIVPLKSRHLVAAATAQRPTHR

SEQ ID NO: 42608 - protein, 139 aa, Homo sapiens; identical to SEQ ID NO: 42591
  Payload ID: 8663
  Gene Symbol: KANSL1
  Gene Name: KAT8 regulatory NSL complex subunit 1
  ENSP ID: ENSP00000487645

SEQ ID NO: 42609 - protein, 1105 aa, Homo sapiens; identical to SEQ ID NO: 42598
  Payload ID: 8663
  Gene Symbol: KANSL1
  Gene Name: KAT8 regulatory NSL complex subunit 1
  ENSP ID: ENSP00000487763

SEQ ID NO: 42610 - protein, 122 aa, Homo sapiens; identical to SEQ ID NO: 42590
  Payload ID: 8663
  Gene Symbol: KANSL1
  Gene Name: KAT8 regulatory NSL complex subunit 1
  ENSP ID: ENSP00000488307

SEQ ID NO: 42611 - protein, 9 aa, Homo sapiens
  Payload ID: 8663
  Gene Symbol: KANSL1
  Gene Name: KAT8 regulatory NSL complex subunit 1
  ENSP ID: ENSP00000488578
MAAMAPALT

SEQ ID NO: 42612 - protein, 987 aa, Homo sapiens
  Payload ID: 8664
  Gene Symbol: KANSL1L
  Gene Name: KAT8 regulatory NSL complex subunit 1-like
  Uniprot ID: A0AUZ9
  ENSP ID: ENSP00000281772
MTPALREATAKGISFSSLPSTMESDKMLYMESPRTVDEKLKGDTFSQMLGFPTPEPTLNTNFVNLKHFGSPQSSKHYQTVFLMRSNSTLNKHNENYKQKKLGEPSCNKLKNILYNGSNIQLSKICLSHSEEFIKKEPLSDTTSQCMKDVQIILDSNITKDTNVDKVQLQNCKWYQENALLDKVTDAEIKKGLLHCTQKKIVPGHSNVPVSSSAAEKEEEVHARLLHCVSKQKILLSQARRTQKHLQMLLAKHVVKHYGQQMKLSMKHQLPKMKTFHEPTTILGNSLPKCTEIKPEVNTLTAENKLWDDAKNGFARCTAAEIQRFAFSATGLLSHVEEGLDSDATDSSSDDDLDEYTLRKNVAVNCSTEWKWLVDRARVGSRWTWLQAQISDLECKIQQLTDIHRQIRASKGIVVLEECQLPKDILKKQMQFADQAASLNILGNPQVPQECQDPVPEQDFEMSPSSPTLLLRNIEKQSAQLTEIINSLIAPLNLSPTSSPLSSKSCSHKCLANGIYRSASENLDELSSSSSWLLNQKHSKKKRKDRTRLKSSSLTFMSTSARTRPLQSFHKRKLYRLSPTFYWTPQTLPSKETAFLNTTQMPCLQSASTWSSYEHNSESYLLREHVSELDSSFHSVLSLPSDVPLHFHFETLLKKTEIKGNLAENKFVDEYIISPSPVHSTLNQWRNGYSPICKPQIRSESSAQLLQGRKKRHLSETALGERTKLEESDFQHTESGSHSNFTAVSNVNVLSRIQNSSRNTARRRLRSESSYDIDNIVIPMSLVAPAKLEKLQYKEILTPSWRMVVLQPLDEYNLGKEEIEDLSDEVFSLRHKKYEEREQARWSLWEQSKWHRRNSRAYSKNVEGQDLLLKEYPNNFSSSQQCAAASPPGLPSENQDLCAYGLPSLNQSQETKSLWWERRAFPLKGEDMAALLCQDEKKDQVERSSTAFHGEIFGTSVPENGHHPKKQSDGMEEYKTFGLGLTNVKKNR

SEQ ID NO: 42613 - protein, 199 aa, Homo sapiens
  Payload ID: 8664
  Gene Symbol: KANSL1L
  Gene Name: KAT8 regulatory NSL complex subunit 1-like
  ENSP ID: ENSP00000388182
  MOD_RES (1)..(1): Any amino acid
XGNSLPKCTEIKPEVNTLTAENKLWDDAKNGFARCTAAEIQRFAFSATGLLSHVEEGLDSDATDSSSDDDLDEYTLRKNVAVNCSTEWKWLVDRARVGSRWTWLQAQISDLECKIQQLTDIHRQIRASKGIVVLEECQLPKDILKKQMQFADQAASLNILGNPQVPQECQDPVPEQDFEMSPSSPTLLLRNIEKQVKSK

SEQ ID NO: 42614 - protein, 705 aa, Homo sapiens
  Payload ID: 8664
  Gene Symbol: KANSL1L
  Gene Name: KAT8 regulatory NSL complex subunit 1-like
  Uniprot ID: A0AUZ9
  ENSP ID: ENSP00000393432
MTPALREATAKGISFSSLPSTMESDKMLYMESPRTVDEKLKGDTFSQMLGFPTPEPTLNTNFVNLKHFGSPQSSKHYQTVFLMRSNSTLNKHNENYKQKKLGEPSCNKLKNILYNGSNIQLSKICLSHSEEFIKKEPLSDTTSQCMKDVQIILDSNITKDTNVDKVQLQNCKWYQENALLDKVTDAEIKKGLLHCTQKKIVPGHSNVPVSSSAAEKEEEVHARLLHCVSKQKILLSQARRTQKHLQMLLAKHVVKHYGQQMKLSMKHQLPKMKTFHEPTTILGNSLPKCTEIKPEVNTLTAENKLWDDAKNGFARCTAAEIQRFAFSATGLLSHVEEGLDSDATDSSSDDDLDEYTLRKNVAVNCSTEWKWLVDRARVGSRWTWLQAQISDLECKIQQLTDIHRQIRASKGIVVLEECQLPKDILKKQMQFADQAASLNILGNPQVPQECQDPVPEQDFEMSPSSPTLLLRNIEKQSAQLTEIINSLIAPLNLSPTSSPLSSKSCSHKCLANGIYRSASENLDELSSSSSWLLNQKHSKKKRKDRTRLKSSSLTFMSTSARTRPLQSFHKRKLYRLSPTFYWTPQTLPSKETAFLNTTQMPCLQSASTWSSYEHNSESYLLREHVSELDSSFHSVLSLPSDVPLHFHFETLLKKTEIKGNLAENKFVDEYIISPSPGMSHLQFLYSICLFMSLYLLFLHSKKNKI

SEQ ID NO: 42615 - protein, 705 aa, Homo sapiens; identical to SEQ ID NO: 42614
  Payload ID: 8664
  Gene Symbol: KANSL1L
  Gene Name: KAT8 regulatory NSL complex subunit 1-like
  Uniprot ID: A0AUZ9
  ENSP ID: ENSP00000401408

SEQ ID NO: 42616 - protein, 343 aa, Homo sapiens
  Payload ID: 8664
  Gene Symbol: KANSL1L
  Gene Name: KAT8 regulatory NSL complex subunit 1-like
  ENSP ID: ENSP00000402261
  MOD_RES (1)..(1): Any amino acid
XDDAKNGFARCTAAEIQRFAFSATGLLSHVEEGLDSDATDSSSDDDLDEYTLRKNVAVNCSTEWKWLVDRARVGSRWTWLQAQISDLECKIQQLTDIHRQIRASKGIVVLEECQLPKDILKKQMQFADQAASLNILGNPQVPQECQDPVPEQDFEMSPSSPTLLLRNIEKQSAQLTEIINSLIAPLNLSPTSSPLSSKSCSHKCLANGIYRSASENLDELSSSSSWLLNQKHSKKKRKDRTRLKSSSLTFMSTSARTRPLQSFHKRKLYRLSPTFYWTPQTLPSKETAFLNTTQMPCLQSASTWSSYEHNSESYLLREHVSELDSSFHSVLSLPSGKPPCNNF

SEQ ID NO: 42617 - protein, 945 aa, Homo sapiens
  Payload ID: 8664
  Gene Symbol: KANSL1L
  Gene Name: KAT8 regulatory NSL complex subunit 1-like
  Uniprot ID: A0AUZ9
  ENSP ID: ENSP00000405724
MTPALREATAKGISFSSLPSTMESDKMLYMESPRTVDEKLKGDTFSQMLGFPTPEPTLNTNFVNLKHFGSPQSSKHYQTVFLMRSNSTLNKHNENYKQKKLGEPSCNKLKNILYNGSNIQLSKICLSHSEEFIKKEPLSDTTSQCMKDVQIILDSNITKDTNVDKVQLQNCKWYQENALLDKVTDAEIKKGLLHCTQKKIVPGHSNVPVSSSAAEKEEEVHARLLHCVSKQKILLSQARRTQKHLQMLLAKHVVKHYGQQMKLSMKHQLPKMKTFHEPTTILGNSLPKCTEIKPEVNTLTAENKLWDDAKNGFARCTAAEIQRFAFSATGLLSHVEEGLDSDATDSSSDDDLDEYTLRKNVAVNCSTEWKWLVDRARVGSRWTWLQAQISDLECKIQQLTDIHRQIRASKGIVVLEECQLPKDILKKQMQFADQAASLNILGNPQVPQECQDPVPEQDFEMSPSSPTLLLRNIEKQSAQLTEIINSLIAPLNLSPTSSPLSSKSCSHKCLANGIYRSASENLDELSSSSSWLLNQKHSKKKRKDRTRLKSSSLTFMSTSARTRPLQSFHKRKLYRLSPTFYWTPQTLPSKETAFLNTTQMPCLQSASTWSSYEHNSESYLLREHVSELDSSFHSVLSLPSDVPLHFHFETLLKKTEIKGNLAENKFVDEYIISPSPGERTKLEESDFQHTESGSHSNFTAVSNVNVLSRIQNSSRNTARRRLRSESSYDIDNIVIPMSLVAPAKLEKLQYKEILTPSWRMVVLQPLDEYNLGKEEIEDLSDEVFSLRHKKYEEREQARWSLWEQSKWHRRNSRAYSKNVEGQDLLLKEYPNNFSSSQQCAAASPPGLPSENQDLCAYGLPSLNQSQETKSLWWERRAFPLKGEDMAALLCQDEKKDQVERSSTAFHGEIFGTSVPENGHHPKKQSDGMEEYKTFGLGLTNVKKNR

SEQ ID NO: 42618 - protein, 191 aa, Homo sapiens
  Payload ID: 8664
  Gene Symbol: KANSL1L
  Gene Name: KAT8 regulatory NSL complex subunit 1-like
  ENSP ID: ENSP00000407495
  MOD_RES (1)..(1): Any amino acid
XATGLLSHVEEGLDSDATDSSSDDDLDEYTLRKNVAVNCSTEWKWLVDRARVGSRWTWLQAQISDLECKIQQLTDIHRQIRASKGIVVLEECQLPKDILKKQMQFADQAASLNILGNPQVPQECQDPVPEQDFEMSPSSPTLLLRNIEKQSAQLTEIINSLIAPLNLSPTSSPLSSKSCSHKCLANGIYRR

SEQ ID NO: 42619 - protein, 70 aa, Homo sapiens
  Payload ID: 8664
  Gene Symbol: KANSL1L
  Gene Name: KAT8 regulatory NSL complex subunit 1-like
  ENSP ID: ENSP00000489299
  MOD_RES (1)..(1): Any amino acid
XRNTARRRLRSESSYDIDNIVIPMSLVAPAKLEKLQYKEILTPSWRMVVLQPLDEYNLGKEEIFGFWNCR

SEQ ID NO: 42620 - protein, 492 aa, Homo sapiens
  Payload ID: 8665
  Gene Symbol: KANSL2
  Gene Name: KAT8 regulatory NSL complex subunit 2
  Uniprot ID: Q9H9L4
  ENSP ID: ENSP00000415436
MNRIRIHVLPTNRGRITPVPRSQEPLSCAFTHRPCSHPRLEGQEFCIKHILEDKNAPFKQCSYISTKNGKRCPNAAPKPEKKDGVSFCAEHVRRNALALHAQMKKTNPGPVGETLLCQLSSYAKTELGSQTPESSRSEASRILDEDSWSDGEQEPITVDQTWRGDPDSEADSIDSDQEDPLKHAGVYTAEEVALIMREKLIRLQSLYIDQFKRLQHLLKEKKRRYLHNRKVEHEALGSSLLTGPEGLLAKERENLKRLKCLRRYRQRYGVEALLHRQLKERRMLATDGAAQQAHTTRSSQRCLAFVDDVRCSNQSLPMTRHCLTHICQDTNQVLFKCCQGSEEVPCNKPVPVSLSEDPCCPLHFQLPPQMYKPEQVLSVPDDLEAGPMDLYLSAAELQPTESLPLEFSDDLDVVGDGMQCPPSPLLFDPSLTLEDHLVKEIAEDPVDILGQMQMAGDGCRSQGSRNSEKASAPLSQSGLATANGKPEPTSIS

SEQ ID NO: 42621 - protein, 69 aa, Homo sapiens
  Payload ID: 8665
  Gene Symbol: KANSL2
  Gene Name: KAT8 regulatory NSL complex subunit 2
  ENSP ID: ENSP00000446493
MNRIRIHVLPTNRGRITPVPRSQEPLSCAFTHRPCSHPRLEGQEFCIKHILEDKNAPFKQCSYISTKNG

SEQ ID NO: 42622 - protein, 25 aa, Homo sapiens
  Payload ID: 8665
  Gene Symbol: KANSL2
  Gene Name: KAT8 regulatory NSL complex subunit 2
  ENSP ID: ENSP00000447093
  MOD_RES (1)..(1): Any amino acid
XPESSRSEASRILDMLVSTQQKKWP

SEQ ID NO: 42623 - protein, 206 aa, Homo sapiens
  Payload ID: 8665
  Gene Symbol: KANSL2
  Gene Name: KAT8 regulatory NSL complex subunit 2
  ENSP ID: ENSP00000447608
ENLKRLKCLRRYRQRYGVEALLHRQLKERRMLATDGAAQQAHTTRSSQRCLAFVDDVRCSNQSLPMTRHCLTHICQDTNQVLFKCCQGSEEVPCNKPVPVSLSEDPCCPLHFQLPPQMYKPEQDLDVVGDGMQCPPSPLLFDPSLTLEDHLVKEIAEDPVDILGQMQMAGDGCRSQGSRNSEKASAPLSQSGLATANGKPEPTSIS

SEQ ID NO: 42624 - protein, 133 aa, Homo sapiens
  Payload ID: 8665
  Gene Symbol: KANSL2
  Gene Name: KAT8 regulatory NSL complex subunit 2
  ENSP ID: ENSP00000448129
MNRIRIHVLPTNRGRITPVPRVSFCAEHVRRNALALHAQMKKTNPGPVGETLLCQLSSYAKTELGSQTPESSRSEASRILDEDSWSDGEQEPITVDQTWRGDPDSEADSIDSDQEDPLKHAGVYTAEEVALIM

SEQ ID NO: 42625 - protein, 155 aa, Homo sapiens
  Payload ID: 8665
  Gene Symbol: KANSL2
  Gene Name: KAT8 regulatory NSL complex subunit 2
  Uniprot ID: Q9H9L4
  ENSP ID: ENSP00000448131
MNRIRIHVLPTNRGRITPVPRSQEPLSCAFTHRPCSHPRLEGQEFCIKHILEDKNAPFKQCSYISTKNGKRCPNAAPKPEKKDGVSFCAEHVRRNALALHAQMKKTNPGPVGETLLCQLSSYAKTELGSQTPESSRSEASRILDMLVSTQQKKWP

SEQ ID NO: 42626 - protein, 108 aa, Homo sapiens
  Payload ID: 8665
  Gene Symbol: KANSL2
  Gene Name: KAT8 regulatory NSL complex subunit 2
  ENSP ID: ENSP00000448473
MNRIRIHVLPTNRGRITPVPRSQEPLSCAFTHRPCSHPRLEGQEFCIKHILEDKNAPFKQCSYISTKNGKRCPNAAPKPEKKDGVSFCAEHVRRNALALHAQMKKTNP

SEQ ID NO: 42627 - protein, 454 aa, Homo sapiens
  Payload ID: 8665
  Gene Symbol: KANSL2
  Gene Name: KAT8 regulatory NSL complex subunit 2
  ENSP ID: ENSP00000448833
MNRIRIHVLPTNRGRITPVPRSQEPLSCAFTHRPCSHPRLEGQEFCIKHILEDKNAPFKQCSYISTKNGKRCPNAAPKPEKKDGVSFCAEHVRRNALALHAQMKKTNPGPVGETLLCQLSSYAKTELGSQTPESSRSEASRILDEDSWSDGEQEPITVDQTWRGDPDSEADSIDSDQEDPLKHAGVYTAEEVALIMREKLIRLQSLYIDQFKRLQHLLKEKKRRYLHNRKVEHEALGSSLLTGPEGLLAKERENLKRLKCLRRYRQRYGVEALLHRQLKERRMLATDGAAQQAHTTRSSQRCLAFVDDVRCSNQSLPMTRHCLTHICQDTNQVLFKCCQGSEEVPCNKPVPVSLSEDPCCPLHFQLPPQMYKPEQDLDVVGDGMQCPPSPLLFDPSLTLEDHLVKEIAEDPGQMQMAGDGCRSQGSRNSEKASAPLSQSGLATANGKPEPTSIS

SEQ ID NO: 42628 - protein, 74 aa, Homo sapiens
  Payload ID: 8665
  Gene Symbol: KANSL2
  Gene Name: KAT8 regulatory NSL complex subunit 2
  ENSP ID: ENSP00000449126
PNAAPKPEKKDGVSFCAEHVRRNALALHAQMKKTNPGPVGETLLCQLSSYAKTELGSQTPESSRSEASRILGLG

SEQ ID NO: 42629 - protein, 675 aa, Homo sapiens
  Payload ID: 8665
  Gene Symbol: KANSL2
  Gene Name: KAT8 regulatory NSL complex subunit 2
  ENSP ID: ENSP00000449747
MAVLFPLSSCGWAAISLFLSAQSCYSASKQCQSQSPSCRLPGARISGDWSRRTKWRSHRLPRPGPVVRSEAGRDKGGVRGGGVAAAWGWCCRFPSCCSCASPEDTFSVVWFGVGPGMEGHAKGRQSHRCLWRLGEGGGDLRSVPYGDDFCMSFGNCPRDLCGAGIFGKGKGFLVFRLTPQVLVMNRIRIHVLPTNRGRITPVPRSQEPLSCAFTHRPCSHPRLEGQEFCIKHILEDKNAPFKQCSYISTKNGKRCPNAAPKPEKKDGVSFCAEHVRRNALALHAQMKKTNPGPVGETLLCQLSSYAKTELGSQTPESSRSEASRILDEDSWSDGEQEPITVDQTWRGDPDSEADSIDSDQEDPLKHAGVYTAEEVALIMREKLIRLQSLYIDQFKRLQHLLKEKKRRYLHNRKVEHEALGSSLLTGPEGLLAKERENLKRLKCLRRYRQRYGVEALLHRQLKERRMLATDGAAQQAHTTRSSQRCLAFVDDVRCSNQSLPMTRHCLTHICQDTNQVLFKCCQGSEEVPCNKPVPVSLSEDPCCPLHFQLPPQMYKPEQVLSVPDDLEAGPMDLYLSAAELQPTESLPLEFSDDLDVVGDGMQCPPSPLLFDPSLTLEDHLVKEIAEDPVDILGQMQMAGDGCRSQGSRNSEKASAPLSQSGLATANGKPEPTSIS

SEQ ID NO: 42630 - protein, 340 aa, Homo sapiens
  Payload ID: 8665
  Gene Symbol: KANSL2
  Gene Name: KAT8 regulatory NSL complex subunit 2
  ENSP ID: ENSP00000449891
  MOD_RES (1)..(1): Any amino acid
XLPTNRGRITPVPRSQEPLSCAFTHRPCSHPRLEGQEFCIKHILEDKNAPFKQCSYISTKNGKRCPNAAPKPEKKDGVSFCAEHVRRNALALHAQMKKTNPGPVGETLLCQLSSYAKTELGSQTPESSRSEASRILDEDSWSDGEQEPITVDQTWRGDPDSEADSIDSDQEDPLKHAGVYTAEEVALIMREKLIRLQSLYIDQFKRLQHLLKEKKRRYLHNRKVEHEALGSSLLTGPEGLLAKERENLKRLKCLRRYRQRYGVEALLHRQLKERRMLATDGAAQQAHTTRSSQRCLAFVDDVRCSNQSLPMTRHCLTQKDATAIGDLLTLYCGLMETALD

SEQ ID NO: 42631 - protein, 72 aa, Homo sapiens
  Payload ID: 8666
  Gene Symbol: KANSL3
  Gene Name: KAT8 regulatory NSL complex subunit 3
  ENSP ID: ENSP00000346144
MAHRGGERDFQTSARRMGTSLLFQLSVHERELDLVFLDHSYAKPWSAHPDASSARPTRMLFVTPRRQHESTI

SEQ ID NO: 42632 - protein, 93 aa, Homo sapiens
  Payload ID: 8666
  Gene Symbol: KANSL3
  Gene Name: KAT8 regulatory NSL complex subunit 3
  ENSP ID: ENSP00000394476
SESDVPIDVETVTSTPMPLYDNQKARSVMNECERHVIFARTDADAPPPPEDWEEHVNRVSLCHPDCSAVARSQLTTSLDLQDSVSLWTTTLLL

SEQ ID NO: 42633 - protein, 878 aa, Homo sapiens
  Payload ID: 8666
  Gene Symbol: KANSL3
  Gene Name: KAT8 regulatory NSL complex subunit 3
  Uniprot ID: Q9P2N6
  ENSP ID: ENSP00000396749
MAHRGGERDFQTSARRMGTSLLFQLSVHERELDLVFLDHSYAKPWSAHPDASSARPTRMLFVTPRRQHESTIESDVPIDVETVTSTPMPLYDNQKARSVMNECERHVIFARTDADAPPPPEDWEEHVNRTGWTMAQNKLFNKILKALQSDRLARLANEGACNEPVLRRVAVDKCARRVRQALASVSWDTKLIQWLHTTLVETLSLPMLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRISKAKKKSEGLTQSMVDRCIQDEIVDFLTGVLTRAEGHMGSEPRDQDAEKKKKPRDVARRDLAFEVPERGSRPASPAAKLPASPSGSEDLSSVSSSPTSSPKTKVTTVTSAQKSSQIGSSQLLKRHVQRTEAVLTHKQAQVPISSEPPEEGEKEDLRVQLKRHHPSSPLPGSKTSKRPKIKVSLISQGDTAGGPCAPSQGSAPEAAGGKPITMTLGQASAGAKELTGLLTTAKSSSSEGGVSASPVPSVVSSSTAPSALHTLQSRLVATSPGSSLPGATSASSLLQGLSFSLQDISSKTSGLPANPSPGPAPQATSVKLPTPMQSLGAITTGTSTIVRTIPVATTLSSLGATPGGKPTAIHQLLTNGGLAKLASSLPGLAQISNQASGLKVPTTITLTLRGQPSRITTLSPMGSGAAPSEESSSQVLPSSSQRLPPAP

SEQ ID NO: 42634 - protein, 76 aa, Homo sapiens
  Payload ID: 8666
  Gene Symbol: KANSL3
  Gene Name: KAT8 regulatory NSL complex subunit 3
  ENSP ID: ENSP00000397994
MAHRGGERDFQTSARRMGTSLLFQLSVHERELDLVFLDHSYAKPWSAHPDASSARPTRMLFVTPRRQHESTMLCTK

SEQ ID NO: 42635 - protein, 172 aa, Homo sapiens
  Payload ID: 8666
  Gene Symbol: KANSL3
  Gene Name: KAT8 regulatory NSL complex subunit 3
  ENSP ID: ENSP00000405988
MLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSNFYLIWRLSWDGIP

SEQ ID NO: 42636 - protein, 75 aa, Homo sapiens
  Payload ID: 8666
  Gene Symbol: KANSL3
  Gene Name: KAT8 regulatory NSL complex subunit 3
  ENSP ID: ENSP00000410775
MAHRGGERDFQTSARRMGTSLLFQLSVHERELDLVFLDHSYAKPWSAHPDASSARPTRMLFVTPRRQHESTISQP

SEQ ID NO: 42637 - protein, 72 aa, Homo sapiens; identical to SEQ ID NO: 42631
  Payload ID: 8666
  Gene Symbol: KANSL3
  Gene Name: KAT8 regulatory NSL complex subunit 3
  ENSP ID: ENSP00000413229

SEQ ID NO: 42638 - protein, 780 aa, Homo sapiens
  Payload ID: 8666
  Gene Symbol: KANSL3
  Gene Name: KAT8 regulatory NSL complex subunit 3
  Uniprot ID: Q9P2N6
  ENSP ID: ENSP00000414426
MAHRGGERDFQTSARRMGTSLLFQLSVHERELDLVFLDHSYAKPWSAHPDASSARPTRMLFVTPRRQHESTIESDVPIDVETVTSTPMPLYDNQKARSVMNECERHVIFARTDADAPPPPEDWEEHVNRTGWTMAQNKLFNKILKALQSDRLARLANEGACNEPVLRRVAVDKCARRVRQALASVSWDTKLIQWLHTTLVETLSLPMLAAYLDALQTLKGKIPTLIDRMLVSSNTKTGAAGAEALSLLLKRPWDPAVGVLSHNKPSKLPGSPLILIASSGPSSSVFPTSRRHRFWQSQLSCLGKVIPVATHLLNNGSGVGVLQCLEHMIGAVRSKVLEIHSHFPHKPIILIGWNTGALVACHVSVMEYVTAVVCLGFPLLTVDGPRGDVDDPLLDMKTPVLFVIGQNSLQCHPEAMEDFREKIRAENSLVVVGGADDNLRISKAKKKSEGLTQSMVDRCIQDEIVDFLTGVLTRAEGHMGSEPRDQDAEKKKKPRDVARRDLAFEVPERGSRPASPAAKLPASPSGSEDLSSVSSSPTSSPKTKVTTVTSAQKSSQIGSSQLLKRHVQRTEAVLTHKQAQAQFAAFLKQNMLVRKALPPGTSSCLFVPISSEPPEEGEKEDLRVQLKRHHPSSPLPGSKTSKRPKIKVSLISQGDTAGGPCAPSQGSAPEAAGGKPITMTLGQASAGAKELTGLLTTAKSSSSEGGVSASPVPSVVSSSTAPSALHTLQSRLVATSPGSSLPGATSASSLLQGLSFSLQDISSKTSGLPANPSPGPAPQA

SEQ ID NO: 42639 - protein, 154 aa, Homo sapiens
  Payload ID: 8666
  Gene Symbol: KANSL3
  Gene Name: KAT8 regulatory NSL complex subunit 3
  ENSP ID: ENSP00000415041
MAHRGGERDFQTSARRMGTSLLFQLSVHERELDLVFLDHSYAKPWSAHPDASSARPTRMLFVTPRRQHESTIESDVPIDVETVTSTPMPLYDNQKARSVMNECERHVIFARTDADAPPPPEDWEEHVNRLVMSQCCAVLLWTSVQGECGRLWQV

SEQ ID NO: 42640 - protein, 67 aa, Homo sapiens
  Payload ID: 8666
  Gene Symbol: KANSL3
  Gene Name: KAT8 regulatory NSL complex subunit 3
  ENSP ID: ENSP00000415236
MPLYDNQKARSVMNECERHVIFARTDADAPPPPEDWEEHVNRLVMSQCCAVLLWTSVQGECGRLWQV

SEQ ID NO: 42641 - protein, 132 aa, Homo sapiens
  Payload ID: 8666
  Gene Symbol: KANSL3
  Gene Name: KAT8 regulatory NSL complex subunit 3
  ENSP ID: ENSP00000415403
MAHRGGERDFQTSARRMGTSLLFQLSVHERELDLVFLDHSYAKPWSAHPDASSARPTRMLFVTPRRQHESTIESDVPIDVETVTSTPMPLYDNQKARSVMNECERHVIFARTDADAPPPPEDWEEHVNRSQP

SEQ ID NO: 42642 - protein, 154 aa, Homo sapiens; identical to SEQ ID NO: 42639
  Payload ID: 8666
  Gene Symbol: KANSL3
  Gene Name: KAT8 regulatory NSL complex subunit 3
  ENSP ID: ENSP00000473116

SEQ ID NO: 42643 - protein, 491 aa, Homo sapiens
  Payload ID: 8667
  Gene Symbol: KATNA1
  Gene Name: katanin p60 (ATPase containing) subunit A 1
  Uniprot ID: O75449
  ENSP ID: ENSP00000335106
MSLLMISENVKLAREYALLGNYDSAMVYYQGVLDQMNKYLYSVKDTYLQQKWQQVWQEINVEAKHVKDIMKTLESFKLDSTPLKAAQHDLPASEGEVWSMPVPVERRPSPGPRKRQSSQYSDPKSHGNRPSTTVRVHRSSAQNVHNDRGKAVRCREKKEQNKGREEKNKSPAAVTEPETNKFDSTGYDKDLVEALERDIISQNPNVRWDDIADLVEAKKLLKEAVVLPMWMPEFFKGIRRPWKGVLMVGPPGTGKTLLAKAVATECKTTFFNVSSSTLTSKYRGESEKLVRLLFEMARFYSPATIFIDEIDSICSRRGTSEEHEASRRVKAELLVQMDGVGGTSENDDPSKMVMVLAATNFPWDIDEALRRRLEKRIYIPLPSAKGREELLRISLRELELADDVDLASIAENMEGYSGADITNVCRDASLMAMRRRIEGLTPEEIRNLSKEEMHMPTTMEDFEMALKKVSKSVSAADIERYEKWIFEFGSC

SEQ ID NO: 42644 - protein, 311 aa, Homo sapiens
  Payload ID: 8667
  Gene Symbol: KATNA1
  Gene Name: katanin p60 (ATPase containing) subunit A 1
  Uniprot ID: O75449
  ENSP ID: ENSP00000335180
MSLLMISENVKLAREYALLGNYDSAMVYYQGVLDQMNKYLYSVKDTYLQQKWQQVWQEINVEAKHVKDIMKTLESFKLDSTPLKAAQHDLPASEGEVWSMPVPVERRPSPGPRKRQSSQYSDPKSHGNRPSTTVRVHRSSAQNVHNDRGKAVRCREKKEQNKGREEKGVLMVGPPGTGKTLLAKAVATECKTTFFNVSSSTLTSKYRGESEKLVRLLFEMARFYSPATIFIDEIDSICSRRGTSEEHEASRRVKAELLVQMDGVGGTSENDDPSKMVMVLAATNFPWDIDEALRRRLEKRIYIPLPSGMRP

SEQ ID NO: 42645 - protein, 491 aa, Homo sapiens; identical to SEQ ID NO: 42643
  Payload ID: 8667
  Gene Symbol: KATNA1
  Gene Name: katanin p60 (ATPase containing) subunit A 1
  Uniprot ID: O75449
  ENSP ID: ENSP00000356381

SEQ ID NO: 42646 - protein, 280 aa, Homo sapiens
  Payload ID: 8667
  Gene Symbol: KATNA1
  Gene Name: katanin p60 (ATPase containing) subunit A 1
  ENSP ID: ENSP00000390322
MSLLMISENVKLAREYALLGNYDSAMVYYQGVLDQMNKYLYSVKDTYLQQKWQQVWQEINVEAKHVKDIMKTLESFKLDSTPLKAAQHDLPASEGEVWSMPVPVERRPSPGPRKRQSSQYSDPKSHGNRPSTTVRVHRSSAQNVHNDRGKAVRCREKKEQNKGREEKNKSPAAVTEPETNKFDSTGYDKDLVEALERDIISQNPNVRWDDIADLVEAKKLLKEAVVLPMWMPEFFKGIRRPWKGVLMVGPPGTGKTLLAKAVATECKTTFFNVSSSTLTS

SEQ ID NO: 42647 - protein, 211 aa, Homo sapiens
  Payload ID: 8667
  Gene Symbol: KATNA1
  Gene Name: katanin p60 (ATPase containing) subunit A 1
  ENSP ID: ENSP00000398993
MSLLMISENVKLAREYALLGNYDSAMVYYQGVLDQMNKYLYSVKDTYLQQKWQQVWQEINVEAKHVKDIMKTLESFKLDSTPLKAAQHDLPASEGEVWSMPVPVERRPSPGPRKRQSSQYSDPKSHGNRPSTTVRVHRSSAQNVHNDRGKAVRCREKKEQNKGREEKNKSPAAVTEPETNKFDSTGYDKDLVEALERDIISQNPNVRWDDI

SEQ ID NO: 42648 - protein, 490 aa, Homo sapiens
  Payload ID: 8668
  Gene Symbol: KATNAL1
  Gene Name: katanin p60 subunit A-like 1
  Uniprot ID: Q9BW62
  ENSP ID: ENSP00000369989
MNLAEICDNAKKGREYALLGNYDSSMVYYQGVMQQIQRHCQSVRDPAIKGKWQQVRQELLEEYEQVKSIVSTLESFKIDKPPDFPVSCQDEPFRDPAVWPPPVPAEHRAPPQIRRPNREVRPLRKEMAGVGARGPVGRAHPISKSEKPSTSRDKDYRARGRDDKGRKNMQDGASDGEMPKFDGAGYDKDLVEALERDIVSRNPSIHWDDIADLEEAKKLLREAVVLPMWMPDFFKGIRRPWKGVLMVGPPGTGKTMLAKAVATECGTTFFNVSSSTLTSKYRGESEKLVRLLFEMARFYAPTTIFIDEIDSICSRRGTSDEHEASRRVKSELLIQMDGVGGALENDDPSKMVMVLAATNFPWDIDEALRRRLEKRIYIPLPTAKGRAELLKINLREVELDPDIQLEDIAEKIEGYSGADITNVCRDASLMAMRRRINGLSPEEIRALSKEELQMPVTKGDFELALKKIAKSVSAADLEKYEKWMVEFGSA

SEQ ID NO: 42649 - protein, 490 aa, Homo sapiens; identical to SEQ ID NO: 42648
  Payload ID: 8668
  Gene Symbol: KATNAL1
  Gene Name: katanin p60 subunit A-like 1
  Uniprot ID: Q9BW62
  ENSP ID: ENSP00000369991

SEQ ID NO: 42650 - protein, 153 aa, Homo sapiens
  Payload ID: 8668
  Gene Symbol: KATNAL1
  Gene Name: katanin p60 subunit A-like 1
  ENSP ID: ENSP00000397776
MNLAEICDNAKKGREYALLGNYDSSMVYYQGVMQQIQRHCQSVRDPAIKGKWQQVRQELLEEYEQVKSIVSTLESFKIDKPPDFPVSCQDEPFRDPAVWPPPVPAEHRAPPQIRRPNREVRPLRKEMAGVGARGPVGRAHPISKSEKPSTSRD

SEQ ID NO: 42651 - protein, 150 aa, Homo sapiens
  Payload ID: 8668
  Gene Symbol: KATNAL1
  Gene Name: katanin p60 subunit A-like 1
  ENSP ID: ENSP00000407792
MNLAEICDNAKKGREYALLGNYDSSMVYYQGVMQQIQRHCQSVRDPAIKGKWQQVRQELLEEYEQVKSIVSTLESFKIDKPPDFPVSCQDEPFRDPAVWPPPVPAEHRAPPQIRRPNREVRPLRKEMAGVGARGPVGRAHPISKSEKPST

SEQ ID NO: 42652 - protein, 466 aa, Homo sapiens
  Payload ID: 8669
  Gene Symbol: KATNAL2
  Gene Name: katanin p60 subunit A-like 2
  Uniprot ID: Q8IYT4
  ENSP ID: ENSP00000245121
MEYESYYFVKFQKYPKIVKKSSDTAENNLPQRSRGKTRRMMNDSCQNLPKINQQRPRSKTTAGKTGDTKSLNKEHPNQEVVDNTRLESANFGLHISRIRKDSGEENAHPRRGQIIDFQGLLTDAIKGATSELALNTFDHNPDPSERLLKPLSAFIGMNSEMRELAAVVSRDIYLHNPNIKWNDIIGLDAAKQLVKEAVVYPIRYPQLFTGILSPWKGLLLYGPPGTGKTLLAKAVATECKTTFFNISASTIVSKWRGDSEKLVRVLFELARYHAPSTIFLDELESVMSQRGTASGGEHEGSLRMKTELLVQMDGLARSEDLVFVLAASNLPWELDCAMLRRLEKRILVDLPSREARQAMIYHWLPPVSKSRALELHTELEYSVLSQETEGYSGSDIKLVCREAAMRPVRKIFDALENHQSESSDLPRIQLDIVTTADFLDVLTHTKPSAKNLAQRYSDWQREFESV

SEQ ID NO: 42653 - protein, 538 aa, Homo sapiens
  Payload ID: 8669
  Gene Symbol: KATNAL2
  Gene Name: katanin p60 subunit A-like 2
  Uniprot ID: Q8IYT4
  ENSP ID: ENSP00000348478
MELSYQTLKFTHQAREACEMRTEARRKNLLILISHYLTQEGYIDTANALEQETKLGLRRFEVCDNIDLETILMEYESYYFVKFQKYPKIVKKSSDTAENNLPQRSRGKTRRMMNDSCQNLPKINQQRPRSKTTAGKTGDTKSLNKEHPNQEVVDNTRLESANFGLHISRIRKDSGEENAHPRRGQIIDFQGLLTDAIKGATSELALNTFDHNPDPSERLLKPLSAFIGMNSEMRELAAVVSRDIYLHNPNIKWNDIIGLDAAKQLVKEAVVYPIRYPQLFTGILSPWKGLLLYGPPGTGKTLLAKAVATECKTTFFNISASTIVSKWRGDSEKLVRVLFELARYHAPSTIFLDELESVMSQRGTASGGEHEGSLRMKTELLVQMDGLARSEDLVFVLAASNLPWELDCAMLRRLEKRILVDLPSREARQAMIYHWLPPVSKSRALELHTELEYSVLSQETEGYSGSDIKLVCREAAMRPVRKIFDALENHQSESSDLPRIQLDIVTTADFLDVLTHTKPSAKNLAQRYSDWQREFESV

SEQ ID NO: 42654 - protein, 341 aa, Homo sapiens
  Payload ID: 8669
  Gene Symbol: KATNAL2
  Gene Name: katanin p60 subunit A-like 2
  ENSP ID: ENSP00000464779
  MOD_RES (1)..(1): Any amino acid
XMMNDSCQNLPKINQQRPRSKTTAGKTGDTKSLNKEHPNQEVVDNTRLESANFGLHISRIRKDSGEENAHPRRGQIIDFQGLLTDAIKGATSELALNTFDHNPDPSERLLKPLSAFIGMNSEMRELAAVVSRYPQLFTGILSPWKGLLLYGPPGTGKTLLAKAVATECKTTFFNISASTIVSKWRGDSEKLVRVLFELARYHAPSTIFLDELESVMSQRGTASGGEHEGSLRMKTELLVQMDGLARSEDLVFVLAASNLPWELDCAMLRRLEKRILVDLPSREARQAMIYHWLPPVSKSRALELHTELEYSVLSQTEGYSGSDIKLVCREAAMRPVRKIFD

SEQ ID NO: 42655 - protein, 128 aa, Homo sapiens
  Payload ID: 8669
  Gene Symbol: KATNAL2
  Gene Name: katanin p60 subunit A-like 2
  ENSP ID: ENSP00000466302
PQLFTGILSPWKGLLLYGPPGTGKTLLAKAVATECKTTFFNISASTIVSKWRGDSEKLVRVLFELARYHAPSTIFLDELESVMSQRGTASGGEHEGSLRMKTELLVQMDGLARSEDLVFVLAASNLPW

SEQ ID NO: 42656 - protein, 222 aa, Homo sapiens
  Payload ID: 8669
  Gene Symbol: KATNAL2
  Gene Name: katanin p60 subunit A-like 2
  ENSP ID: ENSP00000466674
MRTEARRKNLLILISHYLTQEGYIDTANALEQETKLGLRRFEVCDNIDLETILMEYESYYFVKFQKYPKIVKKSSDTENNLPQRSRGKTRRMMNDSCQNLPKINQQRPRSKTTAGKTGDTKSLNKEHPNQEVVDNTRLESANFGLHISRIRKDSGEENAHPRRGQIIDFQGLLTDAIKGATSELALNTFDHNPDPSERLLKPLSAFIGMNSEMRELAAVVSR

SEQ ID NO: 42657 - protein, 154 aa, Homo sapiens
  Payload ID: 8669
  Gene Symbol: KATNAL2
  Gene Name: katanin p60 subunit A-like 2
  ENSP ID: ENSP00000467488
EKLVRVLFELARYHAPSTIFLDELESVMSQRGTASGGEHEGSLRMKTELLVQMDGLARSEDLVFVLAASNLPCLKAIALQPGDRARLRLKKKKSVLVHFHAAGEDISKTGKKKKLTGLTVSHGWGASESWRGAKDTSYMVAARENEEDARSGNP

SEQ ID NO: 42658 - protein, 105 aa, Homo sapiens
  Payload ID: 8669
  Gene Symbol: KATNAL2
  Gene Name: katanin p60 subunit A-like 2
  ENSP ID: ENSP00000467610
MELSYQTLKFTHQAREAVLFELARYHAPSTIFLDELESVMSQRGTASGGEHEGSLRMKTELLVQMDGLARSEDLVFVLAASNLPCNHMHFWAPGRSCPPCLQSRS

SEQ ID NO: 42659 - protein, 655 aa, Homo sapiens
  Payload ID: 8670
  Gene Symbol: KATNB1
  Gene Name: katanin p80 (WD repeat containing) subunit B 1
  Uniprot ID: Q9BVA0
  ENSP ID: ENSP00000368982
MATPVVTKTAWKLQEIVAHASNVSSLVLGKASGRLLATGGDDCRVNLWSINKPNCIMSLTGHTSPVESVRLNTPEELIVAGSQSGSIRVWDLEAAKILRTLMGHKANICSLDFHPYGEFVASGSQDTNIKLWDIRRKGCVFRYRGHSQAVRCLRFSPDGKWLASAADDHTVKLWDLTAGKMMSEFPGHTGPVNVVEFHPNEYLLASGSSDRTIRFWDLEKFQVVSCIEGEPGPVRSVLFNPDGCCLYSGCQDSLRVYGWEPERCFDVVLVNWGKVADLAICNDQLIGVAFSQSNVSSYVVDLTRVTRTGTVARDPVQDHRPLAQPLPNPSAPLRRIYERPSTTCSKPQRVKQNSESERRSPSSEDDRDERESRAEIQNAEDYNEIFQPKNSISRTPPRRSEPFPAPPEDDAATAKEAAKPSPAMDVQFPVPNLEVLPRPPVVASTPAPKAEPAIIPATRNEPIGLKASDFLPAVKIPQQAELVDEDAMSQIRKGHDTMCVVLTSRHKNLDTVRAVWTMGDIKTSVDSAVAINDLSVVVDLLNIVNQKASLWKLDLCTTVLPQIEKLLQSKYESYVQTGCTSLKLILQRFLPLITDMLAAPPSVGVDISREERLHKCRLCYKQLKSISGLVKSKSGLSGRHGSTFRELHLLMASLD

SEQ ID NO: 42660 - protein, 208 aa, Homo sapiens
  Payload ID: 8670
  Gene Symbol: KATNB1
  Gene Name: katanin p80 (WD repeat containing) subunit B 1
  ENSP ID: ENSP00000455270
MIQDRDRCAQAAAVAAVEEIVAHASNVSSLVLGKASGRLLATGGDDCRVNLWSINKPNCIMSLTGHTSPVESVRLNTPEELIVAGSQSGSIRVWDLEAAKILRTLMGHKANICSLDFHPYGEFVASGSQDTNIKLWDIRRKGCVFRYRGHSQAVRCLRFSPDGKWLASAADDHTVKLWDLTAGKMMSEFPGHTGPVNVVEFHPNEYLL

SEQ ID NO: 42661 - protein, 210 aa, Homo sapiens
  Payload ID: 8670
  Gene Symbol: KATNB1
  Gene Name: katanin p80 (WD repeat containing) subunit B 1
  ENSP ID: ENSP00000455350
MATPVVTKTAWKLQEIVAHASNVSSLVLGKASGRLLATGGDDCRVNLWSINKPNCIMSLTGHTSPVESVRLNTPEELIVAGSQSGSIRVWDLEAAKILRTLMGHKANICSLDFHPYGEFVASGSQDTNIKLWDIRRKGCVFRYRGHSQAVRCLRFSPDGKWLASAADDHTVKLWDLTAGKMMSEFPGHTGPVNVVEFHPNEYLLASGSSD

SEQ ID NO: 42662 - protein, 117 aa, Homo sapiens
  Payload ID: 8670
  Gene Symbol: KATNB1
  Gene Name: katanin p80 (WD repeat containing) subunit B 1
  ENSP ID: ENSP00000457046
MATPVVTKTAWKLQEIVAHASNVSSLVLGKASGRLLATGGDDCRVNLWSINKPNCIMSLTGHTSPVESVRLNTPEELIVAGSQSGSIRVWDLEAAKTLGHQEERLCLPIQGAQPGRA

SEQ ID NO: 42663 - protein, 276 aa, Homo sapiens
  Payload ID: 8670
  Gene Symbol: KATNB1
  Gene Name: katanin p80 (WD repeat containing) subunit B 1
  ENSP ID: ENSP00000457334
  MOD_RES (1)..(1): Any amino acid
XRAEIQNAEDYNEIFQPKNSISRTPPRRSEPFPAPPEDDAATAKEAAKPSPAMDVQFPVPNLEVLPRPPVVASTPAPKAEPAIIPATRNEPIGLKASDFLPAVKIPQQAELVDEDAMSQIRKGHDTMCVVLTSRHKNLDTVRAVWTMGDIKGHTVPHCPTPDGALFAQTSVDSAVAINDLSVVVDLLNIVNQKASLWKLDLCTTVLPQIEKLLQSKYESYVQTGCTSLKLILQRFLPLITDMLAAPPSVGVDISREERLHKCRLCYKQLKSISGLV

SEQ ID NO: 42664 - protein, 79 aa, Homo sapiens
  Payload ID: 8670
  Gene Symbol: KATNB1
  Gene Name: katanin p80 (WD repeat containing) subunit B 1
  ENSP ID: ENSP00000457347
MATPVVTKTAWKLQEIVAHASNVSSLVLGKASGRLLATGGDDCRVNLWSINKPNCIMSLTGHTSPVESVRLNTPEELIV

SEQ ID NO: 42665 - protein, 304 aa, Homo sapiens
  Payload ID: 8671
  Gene Symbol: KATNBL1
  Gene Name: katanin p80 subunit B-like 1
  Uniprot ID: Q9H079
  ENSP ID: ENSP00000256544
MASETHNVKKRNFCNKIEDHFIDLPRKKISNFTNKNMKEVKKSPKQLAAYINRTVGQTVKSPDKLRKVIYRRKKVHHPFPNPCYRKKQSPGSGGCDMANKENELACAGHLPEKLHHDSRTYLVNSSDSGSSQTESPSSKYSGFFSEVSQDHETMAQVLFSRNMRLNVALTFWRKRSISELVAYLLRIEDLGVVVDCLPVLTNCLQEEKQYISLGCCVDLLPLVKSLLKSKFEEYVIVGLNWLQAVIKRWWSELSSKTEIINDGNIQILKQQLSGLWEQENHLTLVPGYTGNIAKDVDAYLLQLH

SEQ ID NO: 42666 - protein, 178 aa, Homo sapiens
  Payload ID: 8671
  Gene Symbol: KATNBL1
  Gene Name: katanin p80 subunit B-like 1
  ENSP ID: ENSP00000452963
MASETHNVKKRNFCNKIEDHFIDLPRKKISNFTNKNMKEVKKSPKQLAAYINRTVGQTVKSPDKLRKVIYRRKKVHHPFPNPCYRKKQSPGSGGCDMANKENELACAGHLPEKLHHDSRTYLVNSSDSGSSQTESPSSKYSGFFSEVSQDHETMAQVLFSRNMRLNVALTFWRKRSIS

SEQ ID NO: 42667 - protein, 168 aa, Homo sapiens
  Payload ID: 8671
  Gene Symbol: KATNBL1
  Gene Name: katanin p80 subunit B-like 1
  ENSP ID: ENSP00000453072
KSPDKLRKVIYRRKKVHHPFPNPCYRKKQSPGSGGCDMANKENELACAGHLPEKLHHDSRTYLVNSSDSGSSQTESPSSKYSGFFSEVSQDHETMAQVLFSRNMRLNVALTFWRKRSISELVAYLLRNIQILKQQLSGLWEQENHLTLVPGYTGNIAKDVDAYLLQLH

SEQ ID NO: 42668 - protein, 39 aa, Homo sapiens
  Payload ID: 8671
  Gene Symbol: KATNBL1
  Gene Name: katanin p80 subunit B-like 1
  ENSP ID: ENSP00000453283
MASETHNVKKRNFCNKIEDHFIDLPRKKISNFTNKNMKE

SEQ ID NO: 42669 - protein, 111 aa, Homo sapiens
  Payload ID: 8671
  Gene Symbol: KATNBL1
  Gene Name: katanin p80 subunit B-like 1
  ENSP ID: ENSP00000453383
  MOD_RES (1)..(1): Any amino acid
XSKFEEYVIVGLNWLQAVIKRWWSELSSKTEIINDGNIQILKQQLSGLWEQENHLTLVPGYTGNIAKKLKEEGRARWLMPVIPVLWEAKVGRSRAQEIETIPANMVKPHLY

SEQ ID NO: 42670 - protein, 152 aa, Homo sapiens
  Payload ID: 8671
  Gene Symbol: KATNBL1
  Gene Name: katanin p80 subunit B-like 1
  ENSP ID: ENSP00000453713
VSQDHETMAQVLFSRNMRLNVALTFWRKRSISELVAYLLRIEDLGVVVDCLPVLTNCLQEEKQYISLGCCVDLLPLVKSLLKSKFEEYVIVGLNWLQAVIKRWWSELSSKTEIINDGNIQILKQQLSGLWEQENHLTLVPGYTGNIAKVLCV

SEQ ID NO: 42671 - protein, 74 aa, Homo sapiens
  Payload ID: 8671
  Gene Symbol: KATNBL1
  Gene Name: katanin p80 subunit B-like 1
  ENSP ID: ENSP00000453991
MASETHNVKKRNFCNKIEDHFIDLPRKKISNFTNKNMKEVKKSPKQLAAYINRTVGQTVKSPDKLRKVIYRRKK

SEQ ID NO: 42672 - protein, 177 aa, Homo sapiens
  Payload ID: 8671
  Gene Symbol: KATNBL1
  Gene Name: katanin p80 subunit B-like 1
  ENSP ID: ENSP00000453996
MASETHNVKKRNFCNKIEDHFIDLPRKKISNFTNKNMKEVKKSPKQLAAYINRTVGQTVKSPDKLRKVIYRRKKVHHPFPNPCYRKKQSPGSGGCDMANKENELACAGHLPEKLHHDSRTYLVNSSDSGSSQTESPSSKYSGFFSEVSQDHETMAQVLFSRNMRLNVALTFWRKRSI

SEQ ID NO: 42673 - protein, 81 aa, Homo sapiens
  Payload ID: 8671
  Gene Symbol: KATNBL1
  Gene Name: katanin p80 subunit B-like 1
  ENSP ID: ENSP00000454010
MANKENELACAGHLPEKLHHDSRTYLVNSSDSGSSQTESPSSKYSGFFSEVSQDHETMAQVLFSRNMRLNVALTFWRKRSI

SEQ ID NO: 42674 - protein, 126 aa, Homo sapiens
  Payload ID: 8671
  Gene Symbol: KATNBL1
  Gene Name: katanin p80 subunit B-like 1
  ENSP ID: ENSP00000454181
MANKENELACAGHLPEKLHHDSRTYLVNSSDSGSSQTESPSSKYSGFFSEVSQDHETMAQVLFSRNMRLNVALTFWRKRSISELVAYLLRIEDLGVVVDCLPVLTNCLQEEKQYISLGCCVDLLPL

SEQ ID NO: 42675 - protein, 304 aa, Homo sapiens
  Payload ID: 8672
  Gene Symbol: KAZALD1
  Gene Name: Kazal-type serine peptidase inhibitor domain 1
  Uniprot ID: Q96I82
  ENSP ID: ENSP00000359219
MLPPPRPAAALALPVLLLLLVVLTPPPTGARPSPGPDYLRRGWMRLLAEGEGCAPCRPEECAAPRGCLAGRVRDACGCCWECANLEGQLCDLDPSAHFYGHCGEQLECRLDTGGDLSRGEVPEPLCACRSQSPLCGSDGHTYSQICRLQEAARARPDANLTVAHPGPCESGPQIVSHPYDTWNVTGQDVIFGCEVFAYPMASIEWRKDGLDIQLPGDDPHISVQFRGGPQRFEVTGWLQIQAVRPSDEGTYRCLGRNALGQVEAPASLTVLTPDQLNSTGIPQLRSLNLVPEEEAESEENDDYY

SEQ ID NO: 42676 - protein, 415 aa, Homo sapiens
  Payload ID: 8673
  Gene Symbol: KAZN
  Gene Name: kazrin, periplakin interacting protein
  Uniprot ID: Q674X7
  ENSP ID: ENSP00000354727
MRAADSGSWERVRQLAAQGEPAPSCGAGAGPARPPGPAACEQCVDAAGPGDRPRAGVPRVRADGDCSQPVLLREEVSRLQEEVHLLRQMKEMLAKDLEESQGGKSSEVLSATELRVQLAQKEQELARAKEALQAMKADRKRLKGEKTDLVSQMQQLYATLESREEQLRDFIRNYEQHRKESEDAVKALAKEKDLLEREKWELRRQAKEATDHATALRSQLDLKDNRMKELEAELAMAKQSLATLTKDVPKRHSLAMPGETVLNGNQEWVVQADLPLTAAIRQSQQTLYHSHPPHPADRQAVRVSPCHSRQPSVISDASAAEGDRSSTPSDINSPRHRTHSLCNGDSPGPVQKNLHNPIVQSLEDLEDQKRKKKKEKMGFGSISRVFARGKQRKSLDPGLFDGTAPDYYIEEDADW

SEQ ID NO: 42677 - protein, 166 aa, Homo sapiens
  Payload ID: 8673
  Gene Symbol: KAZN
  Gene Name: kazrin, periplakin interacting protein
  ENSP ID: ENSP00000365196
MKEMLAKDLEESQGGKSSEVLSATELRVQLAQKEQELARAKEALQAMKADRKRLKGEKTDLVSQMQQLYATLESREEQLRDFIRNYEQHRKESEDAVKALAKEKDLLEREKWELRRQAKEATDHATALRSQLDLKDNRMKELEAELAMAKQSLATLTKDVPKRHSL

SEQ ID NO: 42678 - protein, 775 aa, Homo sapiens
  Payload ID: 8673
  Gene Symbol: KAZN
  Gene Name: kazrin, periplakin interacting protein
  Uniprot ID: Q674X7
  ENSP ID: ENSP00000365198
MMEDNKQLALRIDGAVQSASQEVTNLRAELTATNRRLAELSGGGGPGPGPGAAASASAAGDSAATNMENPQLGAQVLLREEVSRLQEEVHLLRQMKEMLAKDLEESQGGKSSEVLSATELRVQLAQKEQELARAKEALQAMKADRKRLKGEKTDLVSQMQQLYATLESREEQLRDFIRNYEQHRKESEDAVKALAKEKDLLEREKWELRRQAKEATDHATALRSQLDLKDNRMKELEAELAMAKQSLATLTKDVPKRHSLAMPGETVLNGNQEWVVQADLPLTAAIRQSQQTLYHSHPPHPADRQAVRVSPCHSRQPSVISDASAAEGDRSSTPSDINSPRHRTHSLCNGDSPGPVQKNLHNPIVQSLEDLEDQKRKKKKEKMGFGSISRVFARGKQRKSLDPGLFDDSDSQCSPTRQSLSLSEGEEQMDRLQQVELVRTTPMSHWKAGTVQAWLEVVMAMPMYVKACTENVKSGKVLLSLSDEDLQLGLGVCSSLHRRKLRLAIEDYRDAEAGRSLSKAAELDHHWVAKAWLNDIGLSQYSQAFQNHLVDGRMLNSLMKRDLEKHLNVSKKFHQVSILLGIELLYQVNFSREALQERRARCETQNIDPVVWTNQRVLKWVRDIDLKEYADNLTNSGVHGAVLVLEPTFNAEAMATALGIPSGKHILRRHLAEEMSAVFHPANSTGIREAERFGTPPGRASSVTRAGKEENSSGLKYKAGRLPLGKIGRGFSSKDPDFHDDYGSLQNEDCGDDDPQSRLEQCRLEGYNSLEVTNV

SEQ ID NO: 42679 - protein, 327 aa, Homo sapiens
  Payload ID: 8673
  Gene Symbol: KAZN
  Gene Name: kazrin, periplakin interacting protein
  Uniprot ID: Q674X7
  ENSP ID: ENSP00000383601
MKEMLAKDLEESQGGKSSEVLSATELRVQLAQKEQELARAKEALQAMKADRKRLKGEKTDLVSQMQQLYATLESREEQLRDFIRNYEQHRKESEDAVKALAKEKDLLEREKWELRRQAKEATDHATALRSQLDLKDNRMKELEAELAMAKQSLATLTKDVPKRHSLAMPGETVLNGNQEWVVQADLPLTAAIRQSQQTLYHSHPPHPADRQAVRVSPCHSRQPSVISDASAAEGDRSSTPSDINSPRHRTHSLCNGDSPGPVQKNLHNPIVQSLEDLEDQKRKKKKEKMGFGSISRVFARGKQRKSLDPGLFDGTAPDYYIEEDADW

SEQ ID NO: 42680 - protein, 327 aa, Homo sapiens; identical to SEQ ID NO: 42679
  Payload ID: 8673
  Gene Symbol: KAZN
  Gene Name: kazrin, periplakin interacting protein
  Uniprot ID: Q674X7
  ENSP ID: ENSP00000383602

SEQ ID NO: 42681 - protein, 421 aa, Homo sapiens
  Payload ID: 8673
  Gene Symbol: KAZN
  Gene Name: kazrin, periplakin interacting protein
  Uniprot ID: Q674X7
  ENSP ID: ENSP00000426015
MMEDNKQLALRIDGAVQSASQEVTNLRAELTATNRRLAELSGGGGPGPGPGAAASASAAGDSAATNMENPQLGAQVLLREEVSRLQEEVHLLRQMKEMLAKDLEESQGGKSSEVLSATELRVQLAQKEQELARAKEALQAMKADRKRLKGEKTDLVSQMQQLYATLESREEQLRDFIRNYEQHRKESEDAVKALAKEKDLLEREKWELRRQAKEATDHATALRSQLDLKDNRMKELEAELAMAKQSLATLTKDVPKRHSLAMPGETVLNGNQEWVVQADLPLTAAIRQSQQTLYHSHPPHPADRQAVRVSPCHSRQPSVISDASAAEGDRSSTPSDINSPRHRTHSLCNGDSPGPVQKNLHNPIVQSLEDLEDQKRKKKKEKMGFGSISRVFARGKQRKSLDPGLFDGTAPDYYIEEDADW

SEQ ID NO: 42682 - protein, 132 aa, Homo sapiens
  Payload ID: 8674
  Gene Symbol:
  Gene Name: KCNE1B
  ENSP ID: ENSP00000477875
MPRMILSNTTAVTPFLTKLWQETVQQGGNMSGLARRSPRSGDGKLEALYVLMVLGFFGFFTLGIMLSYIRSKKLEHSNDPFNVYIESNAWQEKDKAYVQARVLESYRSCYVVENHLAIEQPNTHLPETKPSP

SEQ ID NO: 42683 - protein, 129 aa, Homo sapiens
  Payload ID: 8674
  Gene Symbol:
  Gene Name: KCNE1B
  ENSP ID: ENSP00000478461
MILSNTTAVTPFLTKLWQETVQQGGNMSGLARRSPRSGDGKLEALYVLMVLGFFGFFTLGIMLSYIRSKKLEHSNDPFNVYIESNAWQEKDKAYVQARVLESYRSCYVVENHLAIEQPNTHLPETKPSP

SEQ ID NO: 42684 - protein, 90 aa, Homo sapiens
  Payload ID: 8674
  Gene Symbol:
  Gene Name: KCNE1B
  ENSP ID: ENSP00000480511
MPRMILSNTTAVTPFLTKLWQETVQQGGNMSGLARRSPRSGDGKLEALYVLMVLGFFGFFTLGIMLSYIRSKKLEHSNDPFNVYIESNAW

SEQ ID NO: 42685 - protein, 132 aa, Homo sapiens; identical to SEQ ID NO: 42682
  Payload ID: 8674
  Gene Symbol:
  Gene Name: KCNE1B
  ENSP ID: ENSP00000485125

SEQ ID NO: 42686 - protein, 502 aa, Homo sapiens
  Payload ID: 8675
  Gene Symbol: KDELC1
  Gene Name: KDEL (Lys-Asp-Glu-Leu) containing 1
  Uniprot ID: Q6UW63
  ENSP ID: ENSP00000365172
MFGTLLLYCFFLATVPALAETGGERQLSPEKSEIWGPGLKADVVLPARYFYIQAVDTSGNKFTSSPGEKVFQVKVSAPEEQFTRVGVQVLDRKDGSFIVRYRMYASYKNLKVEIKFQGQHVAKSPYILKGPVYHENCDCPLQDSAAWLREMNCPETIAQIQRDLAHFPAVDPEKIAVEIPKRFGQRQSLCHYTLKDNKVYIKTHGEHVGFRIFMDAILLSLTRKVKMPDVELFVNLGDWPLEKKKSNSNIHPIFSWCGSTDSKDIVMPTYDLTDSVLETMGRVSLDMMSVQANTGPPWESKNSTAVWRGRDSRKERLELVKLSRKHPELIDAAFTNFFFFKHDENLYGPIVKHISFFDFFKHKYQINIDGTVAAYRLPYLLVGDSVVLKQDSIYYEHFYNELQPWKHYIPVKSNLSDLLEKLKWAKDHDEEAKKIAKAGQEFARNNLMGDDIFCYYFKLFQEYANLQVSEPQIREGMKRVEPQTEDDLFPCTCHRKKTKDEL

SEQ ID NO: 42687 - protein, 507 aa, Homo sapiens
  Payload ID: 8676
  Gene Symbol: KDELC2
  Gene Name: KDEL (Lys-Asp-Glu-Leu) containing 2
  Uniprot ID: Q7Z4H8
  ENSP ID: ENSP00000315386
MRRLPRALLLQLRLALLVAAGAPEVLVSAPRSLVWGPGLQAAVVLPVRYFYLQAVNSEGQNLTRSPAGETPFKVVVKSLSPKELVRIHVPKPLDRNDGTFLMRYRMYETVDEGLKIEVLYGDEHVAQSPYILKGPVYHEYCECPEDPQAWQKTLSCPTKEPQIAKDFASFPSINLQQMLKEVPKRFGDERGAIVHYTILNNHVYRRSLGKYTDFKMFSDEILLSLTRKVLLPDLEFYVNLGDWPLEHRKVNGTPSPIPIISWCGSLDSRDVVLPTYDITHSMLEAMRGVTNDLLSIQGNTGPSWINKTERAFFRGRDSREERLQLVQLSKENPQLLDAGITGYFFFQEKEKELGKAKLMGFFDFFKYKYQVNVDGTVAAYRYPYLMLGDSLVLKQDSPYYEHFYMALEPWKHYVPIKRNLSDLLEKVKWAKENDEEAKKIAKEGQLMARDLLQPHRLYCYYYQVLQKYAERQSSKPEVRDGMELVPQPEDSTAICQCHRKKPSREEL

SEQ ID NO: 42688 - protein, 451 aa, Homo sapiens
  Payload ID: 8676
  Gene Symbol: KDELC2
  Gene Name: KDEL (Lys-Asp-Glu-Leu) containing 2
  Uniprot ID: Q7Z4H8
  ENSP ID: ENSP00000413429
MVELFIFLFLLGETPFKVVVKSLSPKELVRIHVPKPLDRNDGTFLMRYRMYETVDEGLKIEVLYGDEHVAQSPYILKGPVYHEYCECPEDPQAWQKTLSCPTKEPQIAKDFASFPSINLQQMLKEVPKRFGDERGAIVHYTILNNHVYRRSLGKYTDFKMFSDEILLSLTRKVLLPDLEFYVNLGDWPLEHRKVNGTPSPIPIISWCGSLDSRDVVLPTYDITHSMLEAMRGVTNDLLSIQGNTGPSWINKTERAFFRGRDSREERLQLVQLSKENPQLLDAGITGYFFFQEKEKELGKAKLMGFFDFFKYKYQVNVDGTVAAYRYPYLMLGDSLVLKQDSPYYEHFYMALEPWKHYVPIKRNLSDLLEKVKWAKENDEEAKKIAKEGQLMARDLLQPHRLYCYYYQVLQKYAERQSSKPEVRDGMELVPQPEDSTAICQCHRKKPSREEL

SEQ ID NO: 42689 - protein, 409 aa, Homo sapiens
  Payload ID: 8676
  Gene Symbol: KDELC2
  Gene Name: KDEL (Lys-Asp-Glu-Leu) containing 2
  Uniprot ID: Q7Z4H8
  ENSP ID: ENSP00000431796
MVELFIFLFLLGETPFKVVVKSLSPKELVRIHVPKPLDRNDGTFLMRYRMYETVDEGLKIEVLYGDEHVAQSPYILKGPVYHEYCECPEDPQAWQKTLSCPTKEPQIAKDFASFPSINLQQMLKEVPKRFGDERGAIVHYTILNNHVYRRSLGKYTDFKMFSDEILLSLTRKVLLPDLEFYVNLGDWPLEHRKVNGTPSPIPIISWCGSLDSRDVVLPTYDITHSMLEAMRGVTNDLLSIQGNTGPSWINKTERAFFRGRDSREERLQLVQLSKENPQLLDAGITGYFFFQEKEKELGKAKLMGFFDFFKYKYQVNVDGTVAAYRYPYLMLGDSLVLKQDSPYYEHFYMALEPWKHYVPIKRNLSDLLEKVKWAKSFTLSPRLECSGTISTHCNLCLPGSRNFVPQPPE

SEQ ID NO: 42690 - protein, 160 aa, Homo sapiens
  Payload ID: 8676
  Gene Symbol: KDELC2
  Gene Name: KDEL (Lys-Asp-Glu-Leu) containing 2
  ENSP ID: ENSP00000436147
  MOD_RES (1)..(1): Any amino acid
XEAMRGVTNDLLSIQGNTGPSWINKTERAFFRGRDSREERLQLVQLSKENPQLLDAGITGYFFFQEKEKELGKAKLMGFFDFFKENDEEAKKIAKEGQLMARDLLQPHRLYCYYYQVLQKYAERQSSKPEVRDGMELVPQPEDSTAICQCHRKKPSREEL

SEQ ID NO: 42691 - protein, 212 aa, Homo sapiens
  Payload ID: 8677
  Gene Symbol: KDELR1
  Gene Name: KDEL (Lys-Asp-Glu-Leu) endoplasmic reticulum protein retention receptor 1
  Uniprot ID: P24390
  ENSP ID: ENSP00000329471
MNLFRFLGDLSHLLAIILLLLKIWKSRSCAGISGKSQVLFAVVFTARYLDLFTNYISLYNTCMKVVYIACSFTTVWLIYSKFKATYDGNHDTFRVEFLVVPTAILAFLVNHDFTPLEILWTFSIYLESVAILPQLFMVSKTGEAETITSHYLFALGVYRTLYLFNWIWRYHFEGFFDLIAIVAGLVQTVLYCDFFYLYITKVLKGKKLSLPA

SEQ ID NO: 42692 - protein, 150 aa, Homo sapiens
  Payload ID: 8677
  Gene Symbol: KDELR1
  Gene Name: KDEL (Lys-Asp-Glu-Leu) endoplasmic reticulum protein retention receptor 1
  Uniprot ID: P24390
  ENSP ID: ENSP00000470841
MKVVYIACSFTTVWLIYSKFKATYDGNHDTFRVEFLVVPTAILAFLVNHDFTPLEILWTFSIYLESVAILPQLFMVSKTGEAETITSHYLFALGVYRTLYLFNWIWRYHFEGFFDLIAIVAGLVQTVLYCDFFYLYITKVLKGKKLSLPA

SEQ ID NO: 42693 - protein, 220 aa, Homo sapiens
  Payload ID: 8677
  Gene Symbol: KDELR1
  Gene Name: KDEL (Lys-Asp-Glu-Leu) endoplasmic reticulum protein retention receptor 1
  ENSP ID: ENSP00000472182
MNLFRFLGDLSHLLAIILLLLKIWKSRSCAGISGKSQVLFAVVFTARYLDLFTNYISLYNTCMKVVYIACSFTTVWLIYSKFKATYDGNHDTFRVEFLVVPTAILAFLVNHDFTPLEEDRPGWPDVLIFSTEAIIQEFSDPLDLLHLPGVSGHLAAAVHGEQDRRGGDHHQPLLVCARRLPHALSLQLDLALPFRGLLRPHRHCGRPGPDSPLLRFLLPL

SEQ ID NO: 42694 - protein, 212 aa, Homo sapiens
  Payload ID: 8678
  Gene Symbol: KDELR2
  Gene Name: KDEL (Lys-Asp-Glu-Leu) endoplasmic reticulum protein retention receptor 2
  Uniprot ID: P33947
  ENSP ID: ENSP00000258739
MNIFRLTGDLSHLAAIVILLLKIWKTRSCAGISGKSQLLFALVFTTRYLDLFTSFISLYNTSMKVIYLACSYATVYLIYLKFKATYDGNHDTFRVEFLVVPVGGLSFLVNHDFSPLEILWTFSIYLESVAILPQLFMISKTGEAETITTHYLFFLGLYRALYLVNWIWRFYFEGFFDLIAVVAGVVQTILYCDFFYLYITKVLKGKKLSLPA

SEQ ID NO: 42695 - protein, 38 aa, Homo sapiens
  Payload ID: 8678
  Gene Symbol: KDELR2
  Gene Name: KDEL (Lys-Asp-Glu-Leu) endoplasmic reticulum protein retention receptor 2
  ENSP ID: ENSP00000371702
MNIFRLTGDLSHLAAIVILLLKIWKTRSCAGLACLLGT

SEQ ID NO: 42696 - protein, 186 aa, Homo sapiens
  Payload ID: 8678
  Gene Symbol: KDELR2
  Gene Name: KDEL (Lys-Asp-Glu-Leu) endoplasmic reticulum protein retention receptor 2
  Uniprot ID: P33947
  ENSP ID: ENSP00000420501
MNIFRLTGDLSHLAAIVILLLKIWKTRSCAGISGKSQLLFALVFTTRYLDLFTSFISLYNTSMKVIYLACSYATVYLIYLKFKATYDGNHDTFRVEFLVVPVGGLSFLVNHDFSPLEYSRERSSVCQHKCQRPSPASVLQGARTEFLPQQRHKMLDTENQKLNSFVADSHQWLCKNAEEKSQKVSV

SEQ ID NO: 42697 - protein, 214 aa, Homo sapiens
  Payload ID: 8679
  Gene Symbol: KDELR3
  Gene Name: KDEL (Lys-Asp-Glu-Leu) endoplasmic reticulum protein retention receptor 3
  Uniprot ID: O43731
  ENSP ID: ENSP00000216014
MNVFRILGDLSHLLAMILLLGKIWRSKCCKGISGKSQILFALVFTTRYLDLFTNFISIYNTVMKVVFLLCAYVTVYMIYGKFRKTFDSENDTFRLEFLLVPVIGLSFLENYSFTLLEILWTFSIYLESVAILPQLFMISKTGEAETITTHYLFFLGLYRALYLANWIRRYQTENFYDQIAVVSGVVQTIFYCDFFYLYVTKVLKGKKLSLPMPI

SEQ ID NO: 42698 - protein, 220 aa, Homo sapiens
  Payload ID: 8679
  Gene Symbol: KDELR3
  Gene Name: KDEL (Lys-Asp-Glu-Leu) endoplasmic reticulum protein retention receptor 3
  Uniprot ID: O43731
  ENSP ID: ENSP00000386918
MNVFRILGDLSHLLAMILLLGKIWRSKCCKGISGKSQILFALVFTTRYLDLFTNFISIYNTVMKVVFLLCAYVTVYMIYGKFRKTFDSENDTFRLEFLLVPVIGLSFLENYSFTLLEILWTFSIYLESVAILPQLFMISKTGEAETITTHYLFFLGLYRALYLANWIRRYQTENFYDQIAVVSGVVQTIFYCDFFYLYVTKGRSWDDSNADTGLRSYSSI

SEQ ID NO: 42699 - protein, 406 aa, Homo sapiens
  Payload ID: 8680
  Gene Symbol: KLHDC1
  Gene Name: kelch domain containing 1
  Uniprot ID: Q8N7A1
  ENSP ID: ENSP00000352282
MADSQLFCVAEERSGHCAVVDGNFLYVWGGYVSIEDNEVYLPNDEIWTYDIDSGLWRMHLMEGELPASMSGSCGACINGKLYIFGGYDDKGYSNRLYFVNLRTRDETYIWEKITDFEGQPPTPRDKLSCWVYKDRLIYFGGYGCRRHSELQDCFDVHDASWEEQIFWGWHNDVHIFDTKTQTWFQPEIKGGVPPQPRAAHTCAVLGNKGYIFGGRVLQTRMNDLHYLNLDTWTWSGRITINGESPKHRSWHTLTPIADDKLFLCGGLSADNIPLSDGWIHNVTTNCWKQLTHLPKTRPRLWHTACLGKENEIMVFGGSKDDLLALDTGHCNDLLIFQTQPYSLLRSCLDCIGKNSIMLESQISLLPPKLLQQVLKKITFWAAANHREEQRVQKEETENKYQWISSN

SEQ ID NO: 42700 - protein, 96 aa, Homo sapiens
  Payload ID: 8680
  Gene Symbol: KLHDC1
  Gene Name: kelch domain containing 1
  ENSP ID: ENSP00000450595
MADSQLFCVAEERSGHCAVVDGNFLYVWGGYVSIEDNEVYLPNDEIWTYDIDSGLWRMHLMEGELPASMSGSCGACINGKLYIFGGYDDKGYSNRR

SEQ ID NO: 42701 - protein, 196 aa, Homo sapiens
  Payload ID: 8680
  Gene Symbol: KLHDC1
  Gene Name: kelch domain containing 1
  ENSP ID: ENSP00000451407
MADSQLFCVAEERSGHCAVVDGNFLYVWGGYVEEQIFWGWHNDVHIFDTKTQTWFQPEIKGGVPPQPRAAHTCAVLGNKGYIFGGRVLQTRMNDLHYLNLDTWTWSGRITINGESPKHRSWHTLTPIADDKLFLCGGLSADNIPLSDGWIHNVTTNCWKQLTHLPKTRPRLWHTACLGKENEIMVFGGSKDDLLAL

SEQ ID NO: 42702 - protein, 67 aa, Homo sapiens
  Payload ID: 8680
  Gene Symbol: KLHDC1
  Gene Name: kelch domain containing 1
  ENSP ID: ENSP00000451819
MADSQLFCVAEERSGHCAVVDGNFLYVWGGYVMESRSCPGWSAVARSRLTATSASQVQPILLPQPPE

SEQ ID NO: 42703 - protein, 190 aa, Homo sapiens
  Payload ID: 8680
  Gene Symbol: KLHDC1
  Gene Name: kelch domain containing 1
  ENSP ID: ENSP00000452543
MADSQLFCVAEERSGHCAVVDGNFLYVWGGYVSIEDNEVYLPNDEIWTYDIDSGLWRMHLMEGELPASMSGSCGACINGKLYIFGGYDDKGYSNRLYFVNLRTRDETYIWEKITDFEGQPPTPRDKLSCWVYKDRKSRYSGDGIMMSTYLTQRHRLGFNQKLKVEFHHSHEPRIHVQFLEIRVISLADVF

SEQ ID NO: 42704 - protein, 442 aa, Homo sapiens
  Payload ID: 8681
  Gene Symbol: KLHDC10
  Gene Name: kelch domain containing 10
  Uniprot ID: Q6PID8
  ENSP ID: ENSP00000334140
MSAAQGWDRNRRRGGGAAGAGGGGSGAGGGSGGSGGRGTGQLNRFVQLSGRPHLPGKKKIRWDPVRRRFIQSCPIIRIPNRFLRGHRPPPARSGHRCVADNTNLYVFGGYNPDYDESGGPDNEDYPLFRELWRYHFATGVWHQMGTDGYMPRELASMSLVLHGNNLLVFGGTGIPFGESNGNDVHVCNVKYKRWALLSCRGKKPSRIYGQAMAIINGSLYVFGGTTGYIYSTDLHKLDLNTREWTQLKPNNLSCDLPEERYRHEIAHDGQRIYILGGGTSWTAYSLNKIHAYNLETNAWEEIATKPHEKIGFPAARRCHSCVQIKNDVFICGGYNGEVILGDIWKLNLQTFQWVKLPATMPEPVYFHCAAVTPAGCMYIHGGVVNIHENKRTGSLFKIWLVVPSLLELAWEKLLAAFPNLANLSRTQLLHLGLTQGLIERLK

SEQ ID NO: 42705 - protein, 144 aa, Homo sapiens
  Payload ID: 8681
  Gene Symbol: KLHDC10
  Gene Name: kelch domain containing 10
  ENSP ID: ENSP00000420034
MGTDGYMPRELASMSLVLHGNNLLVFGGTGIPFGESNGNDVHVCNVKYKRWALLSCRGKKPSRIYGQAMAIINGSLYVFGGTTGYIYSTDLHKLDLNTREWTQLKPNNLSCDLPEERYRHEIAHDGQRIYILGGGTSWTAYSLN

SEQ ID NO: 42706 - protein, 136 aa, Homo sapiens
  Payload ID: 8681
  Gene Symbol: KLHDC10
  Gene Name: kelch domain containing 10
  ENSP ID: ENSP00000420083
MSAAQGWDRNRRRGGGAAGAGGGGSGAGGGSGGSGGRGTGQLNRFVQLSGRPHLPGHRPPPARSGHRCVADNTNLYVFGGYNPDYDESGGPDNEDYPLFRELWRYHFATGVWHQMGTDGYMPRELASMSLVLHGNN

SEQ ID NO: 42707 - protein, 406 aa, Homo sapiens
  Payload ID: 8682
  Gene Symbol: KLHDC2
  Gene Name: kelch domain containing 2
  Uniprot ID: Q9Y2U9
  ENSP ID: ENSP00000298307
MADGNEDLRADDLPGPAFESYESMELACPAERSGHVAVSDGRHMFVWGGYKSNQVRGLYDFYLPREELWIYNMETGRWKKINTEGDVPPSMSGSCAVCVDRVLYLFGGHHSRGNTNKFYMLDSRSTDRVLQWERIDCQGIPPSSKDKLGVWVYKNKLIFFGGYGYLPEDKVLGTFEFDETSFWNSSHPRGWNDHVHILDTETFTWSQPITTGKAPSPRAAHACATVGNRGFVFGGRYRDARMNDLHYLNLDTWEWNELIPQGICPVGRSWHSLTPVSSDHLFLFGGFTTDKQPLSDAWTYCISKNEWIQFNHPYTEKPRLWHTACASDEGEVIVFGGCANNLLVHHRAAHSNEILIFSVQPKSLVRLSLEAVICFKEMLANSWNCLPKHLLHSVNQRFGSNNTSGS

SEQ ID NO: 42708 - protein, 249 aa, Homo sapiens
  Payload ID: 8682
  Gene Symbol: KLHDC2
  Gene Name: kelch domain containing 2
  Uniprot ID: Q9Y2U9
  ENSP ID: ENSP00000450539
MADGNEDLRADDLPGPAFESYESMELACPAERSGHVAVSDGRHMFVWGGYKSNQVRGLYDFYLPREELWIYNMETGRWKKINTEGDVPPSMSGSCAVCVDRVLYLFGGHHSRGNTNKFYMLDSRSTDRVLQWERIDCQGIPPSSKDKLGVWVYKNKLIFFGGYGYLPEDKVLGTFEFDETSFWNSSHPRGWNDHVHILDTETFTWSQPITTGKAPSPRAAHACATVGNRGFVFGGRYRVSIQTTSMTCF

SEQ ID NO: 42709 - protein, 307 aa, Homo sapiens
  Payload ID: 8682
  Gene Symbol: KLHDC2
  Gene Name: kelch domain containing 2
  ENSP ID: ENSP00000450658
MADGNEDLRADDLPGPAFESYESMELACPAERSGHVAVSDGRHMFVWGGYKSNQVRGLYDFYLPREELWIYNMETGRWKKINTEGDVPPSMSGSCAVCVDRVLYLFGGHHSRGNTNKFYMLDSRSTDRVLQWERIDCQGIPPSSKDKLGVWVYKNKLIFFGGYGYLPEDKVLGTFEFDETSFWNSSHPRGWNDHVHILDTETFTWSQPITTGKAPSPRAAHACATVGNRGFVFGGRYRDARMNDLHYLNLDTWEWNELIPQGICPVGRSWHSLTPVSSDHLFLFGGFTTDKQPLSYGTQLVPAMKEK

SEQ ID NO: 42710 - protein, 249 aa, Homo sapiens; identical to SEQ ID NO: 42708
  Payload ID: 8682
  Gene Symbol: KLHDC2
  Gene Name: kelch domain containing 2
  Uniprot ID: Q9Y2U9
  ENSP ID: ENSP00000450944

SEQ ID NO: 42711 - protein, 357 aa, Homo sapiens
  Payload ID: 8682
  Gene Symbol: KLHDC2
  Gene Name: kelch domain containing 2
  ENSP ID: ENSP00000451439
MADGNEDLRADDLPGPAFESYESMELACPAERSGHVAVSDGRHMFVWGGYKSNQVRGLYDFYLPREELWIYNMETGRWKKINTEGDVPPSMSGSCAVCVDRVLYLFGGHHSRGNTNKFYMLDSRSTDRVLQWERIDCQGIPPSSKDKLGVWVYKNKLIFFGGYGYLPEDKVLGTFEFDETSFWNSSHPRGWNDHVHILDTETFTWSQPITTGKAPSPRAAHACATVGNRGFVFGGRYRDARMNDLHYLNLDTWEWNELIPQGICPVGRSWHSLTPVSSDHLFLFGGFTTDKQPLSDAWTYCISKNEWIQFNHPYTEKPRLWHTACASDEGEVIVFGGCANNLLVHHRAAKLRSSHLL

SEQ ID NO: 42712 - protein, 248 aa, Homo sapiens
  Payload ID: 8683
  Gene Symbol: KLHDC3
  Gene Name: kelch domain containing 3
  ENSP ID: ENSP00000244670
MTPKGPAMCSMPLTSADCFSNDIHKLDTSTMTWTLICTKGSPARWRDFHSATMLGSHMYVFGGRADRFGPFHSNNEIYCNRIRVFDTRTEAWLDCPPTPVLPEGRRSHSAFGYNGELYIFGGYNARLNRHFHDLWKFNPVSFTWKKIEPKGKGPCPRRRQCCCIVGDKIVLFGGTSPSPEEGLGDEFDLIDHSDLHILDFSPSLKTLCKLAVIQYNLDQSCLPHDIRWELNAMTTNSNISRPIVSSHG

SEQ ID NO: 42713 - protein, 382 aa, Homo sapiens
  Payload ID: 8683
  Gene Symbol: KLHDC3
  Gene Name: kelch domain containing 3
  Uniprot ID: Q9BQ90
  ENSP ID: ENSP00000313995
MLRWTVHLEGGPRRVNHAAVAVGHRVYSFGGYCSGEDYETLRQIDVHIFNAVSLRWTKLPPVKSAIRGQAPVVPYMRYGHSTVLIDDTVLLWGGRNDTEGACNVLYAFDVNTHKWFTPRVSGTVPGARDGHSACVLGKIMYIFGGYEQQADCFSNDIHKLDTSTMTWTLICTKGSPARWRDFHSATMLGSHMYVFGGRADRFGPFHSNNEIYCNRIRVFDTRTEAWLDCPPTPVLPEGRRSHSAFGYNGELYIFGGYNARLNRHFHDLWKFNPVSFTWKKIEPKGKGPCPRRRQCCCIVGDKIVLFGGTSPSPEEGLGDEFDLIDHSDLHILDFSPSLKTLCKLAVIQYNLDQSCLPHDIRWELNAMTTNSNISRPIVSSHG

SEQ ID NO: 42714 - protein, 389 aa, Homo sapiens [sequence omitted]

SEQ ID NO: 42715 - protein, 463 aa, Homo sapiens
  Payload ID: 8684
  Gene Symbol: KLHDC4
  Gene Name: kelch domain containing 4
  Uniprot ID: Q8TBB5
  ENSP ID: ENSP00000262530
MGKKGKKEKKGRGAEKTAAKMEKKVSKRSRKEETFLYNELYVYNTRKDTWTKVDIPSPPPRRCAHQAVVVPQGGGQLWVFGGEFASPNGEQFYHYKDLWVLHLATKTWEQVKSTGGPSGRSGHRMVAWKRQLILFGGFHESTRDYIYYNDVYAFNLDTFTWSKLSPSGTGPTPRSGCQMSVTPQGGIVVYGGYSKQRVKKDVDKGTRHSDMFLLKPEDGREDKWVWTRMNPSGVKPTPRSGFSVAMAPNHQTLFFGGVCDEEEEESLSGEFFNDLYFYDATRNRWFEGQLKGPKSEKKKRRRGRKEEPEGGSRPACGGAGTQGPVQLVKEVVAEDGTVVTIKQVLTAPGSAGQPRSEDEDSLEEAGSPAPGPCPRSNAMLAVKHGVLYVYGGMFEAGDRQVTLSDLHCLDLHRMEAWKALVEMDPETQEWLEETDSEEDSEEVEGAEGGVDDEDSGEESGAED

SEQ ID NO: 42716 - protein, 520 aa, Homo sapiens
  Payload ID: 8684
  Gene Symbol: KLHDC4
  Gene Name: kelch domain containing 4
  Uniprot ID: Q8TBB5
  ENSP ID: ENSP00000270583
MGKKGKKEKKGRGAEKTAAKMEKKVSKRSRKEEEDLEALIAHFQTLDAKRTQTVELPCPPPSPRLNASLSVHPEKDELILFGGEYFNGQKTFLYNELYVYNTRKDTWTKVDIPSPPPRRCAHQAVVVPQGGGQLWVFGGEFASPNGEQFYHYKDLWVLHLATKTWEQVKSTGGPSGRSGHRMVAWKRQLILFGGFHESTRDYIYYNDVYAFNLDTFTWSKLSPSGTGPTPRSGCQMSVTPQGGIVVYGGYSKQRVKKDVDKGTRHSDMFLLKPEDGREDKWVWTRMNPSGVKPTPRSGFSVAMAPNHQTLFFGGVCDEEEEESLSGEFFNDLYFYDATRNRWFEGQLKGPKSEKKKRRRGRKEEPEGGSRPACGGAGTQGPVQLVKEVVAEDGTVVTIKQVLTAPGSAGQPRSEDEDSLEEAGSPAPGPCPRSNAMLAVKHGVLYVYGGMFEAGDRQVTLSDLHCLDLHRMEAWKALVEMDPETQEWLEETDSEEDSEEVEGAEGGVDDEDSGEESGAED

SEQ ID NO: 42717 - protein, 489 aa, Homo sapiens
  Payload ID: 8684
  Gene Symbol: KLHDC4
  Gene Name: kelch domain containing 4
  Uniprot ID: Q8TBB5
  ENSP ID: ENSP00000325717
MGKKGKKEKKGRGAEKTAAKMEKKVSKRSRKEEEDLEALIAHFQTLDAKRTQTVELPCPPPSPRLNASLSVHPEKDELILFGGEYFNGQKTFLYNELYVYNTRKDTWTKVDIPSPPPRRCAHQAVVVPQGGGQLWVFGGEFASPNGEQFYHYKDLWVLHLATKTWEQVKDYIYYNDVYAFNLDTFTWSKLSPSGTGPTPRSGCQMSVTPQGGIVVYGGYSKQRVKKDVDKGTRHSDMFLLKPEDGREDKWVWTRMNPSGVKPTPRSGFSVAMAPNHQTLFFGGVCDEEEEESLSGEFFNDLYFYDATRNRWFEGQLKGPKSEKKKRRRGRKEEPEGGSRPACGGAGTQGPVQLVKEVVAEDGTVVTIKQVLTAPGSAGQPRSEDEDSLEEAGSPAPGPCPRSNAMLAVKHGVLYVYGGMFEAGDRQVTLSDLHCLDLHRMEAWKALVEMDPETQEWLEETDSEEDSEEVEGAEGGVDDEDSGEESGAED

SEQ ID NO: 42718 - protein, 291 aa, Homo sapiens
  Payload ID: 8684
  Gene Symbol: KLHDC4
  Gene Name: kelch domain containing 4
  ENSP ID: ENSP00000392909
MPGKLLPEKCALMWLHLGTRAPQRPKRESRGFPGWGCRTGQALPCRARPPAPAPSHPSSSLSLTPGPGSPRQTGPPCQTVAALYGLGAWQSHCGGGVGCHGQGRQPLGCQGWWSTLNPYLLESPGLFHTRSCGKLWDPKAVLISGVTSSHSSLGSPGTRPGVSLCKELPGCWAELCCRPRKMTKKDRAEPHLPLLGGPEGARAQQSPILHSLGSKRLPRCGWQLLTSSGGAAGGLCPMGHRREKDGGRVCTLGRTGGRHRPEQVAWAHEKGVSETGCLSQMPGVDEADEWQ

SEQ ID NO: 42719 - protein, 44 aa, Homo sapiens
  Payload ID: 8684
  Gene Symbol: KLHDC4
  Gene Name: kelch domain containing 4
  ENSP ID: ENSP00000454681
MGKKGKKEKKGRGAEKTAAKMEKKVSKRSRKEERANNHHSSPEQ

SEQ ID NO: 42720 - protein, 86 aa, Homo sapiens
  Payload ID: 8684
  Gene Symbol: KLHDC4
  Gene Name: kelch domain containing 4
  ENSP ID: ENSP00000455214
MGKKGKKEKKGRGAEKTAAKMEKKVSKRSRKEEEDLEALIAHFQTLDAKRTQTVELPCPPPSPRLNASLSVHPEKDELILFGDFFV

SEQ ID NO: 42721 - protein, 105 aa, Homo sapiens
  Payload ID: 8684
  Gene Symbol: KLHDC4
  Gene Name: kelch domain containing 4
  ENSP ID: ENSP00000455666
MGKKGKKEKKGRGAEKTAAKMEKKVSKRSRKEEEDLEALIAHFQTLDAKRTQTVELPCPPPSPRLNASLSVHPEKDELILFGERTPGPKLTSPVHLRGAVLTRRW

SEQ ID NO: 42722 - protein, 334 aa, Homo sapiens
  Payload ID: 8684
  Gene Symbol: KLHDC4
  Gene Name: kelch domain containing 4
  ENSP ID: ENSP00000455780
MGKKGKKEKKGRGAEKTAAKMEKKVSKRSRKEEAVVVPQGGGQLWVFGGEFASPNGEQFYHYKDLWVLHLATKTWEQVKSTGGPSGRSGHRMVAWKRQLILFGGFHESTRDYIYYNDVYAFNLDTFTWSKLSPSGTGPTPRSGCQMSVTPQGGIVVYGGYSKQRVKKDVDKGTRHSDMFLLKPEDGREDKWVWTRMNPSGVKPTPRSGFSVAMAPNHQTLFFGGVCDEEEEESLSGEFFNDLYFYDATRNRWFEGQLKGPKSEKKKRRRGRKEEPEGGSRPACGGAGTQGPVQLVKEVVAEDGTVVTIKQVLTAPGSAGQPRSEDEDSLEEAGS

SEQ ID NO: 42723 - protein, 99 aa, Homo sapiens
  Payload ID: 8684
  Gene Symbol: KLHDC4
  Gene Name: kelch domain containing 4
  ENSP ID: ENSP00000455824
MGKKGKKEKKGRGAEKTAAKMEKKVSKRSRKEEEDLEALIAHFQTLDAKRTQTVELPCPPPSPRLFCITSSMSTIPERTPGPKLTSPVHLRGAVLTRRW

SEQ ID NO: 42724 - protein, 38 aa, Homo sapiens
  Payload ID: 8684
  Gene Symbol: KLHDC4
  Gene Name: kelch domain containing 4
  ENSP ID: ENSP00000457098
MGKKGKKEKKGRGAEKTAAKMEKKVSKRSRKEETWKRS

SEQ ID NO: 42725 - protein, 520 aa, Homo sapiens; identical to SEQ ID NO: 42716
  Payload ID: 8684
  Gene Symbol: KLHDC4
  Gene Name: kelch domain containing 4
  Uniprot ID: Q8TBB5
  ENSP ID: ENSP00000457570

SEQ ID NO: 42726 - protein, 44 aa, Homo sapiens; identical to SEQ ID NO: 42719
  Payload ID: 8684
  Gene Symbol: KLHDC4
  Gene Name: kelch domain containing 4
  ENSP ID: ENSP00000457857

SEQ ID NO: 42727 - protein, 173 aa, Homo sapiens
  Payload ID: 8684
  Gene Symbol: KLHDC4
  Gene Name: kelch domain containing 4
  ENSP ID: ENSP00000457990
MGKKGKKEKKGRGAEKTAAKMEKKVSKRSRKEEPGVCRRIRPDLGVECSAAAAHGFPNRGQFYGLPCARHSSLGFTPHEQEDLEALIAHFQTLDAKRTQTVELPCPPPSPRLNASLSVHPEKDELILFGGEYFNGQKTFLYNELYVYNTRKDTWTKVDIPSPPPRRCAHQAVV

SEQ ID NO: 42728 - protein, 258 aa, Homo sapiens
  Payload ID: 8684
  Gene Symbol: KLHDC4
  Gene Name: kelch domain containing 4
  ENSP ID: ENSP00000482433
MVAWKRQLILFGGFHESTRDYIYYNDVYAFNLDTFTWSKLSPSGTGPTPRSGCQMSVTPQGGIVVYGGYSKQRVKKDVDKGTRHSDMFLLKPEDGREDKWVWTRMNPSGVKPTPRSGFSVAMAPNHQTLFFGGVCDEEEEESLSGEFFNDLYFYDATRNRWFEGQLKKLRSGWRRRTRKRTVRRLRAPRVGSTTKTAERRAVRRTESPCQGRLASAVPTSAQDPAVLSEALGASVRPDAQERAEGGWPRPGCELSPMV

SEQ ID NO: 42729 - protein, 777 aa, Homo sapiens
  Payload ID: 8685
  Gene Symbol: KLHDC7A
  Gene Name: kelch domain containing 7A
  Uniprot ID: Q5VTJ3
  ENSP ID: ENSP00000383505
MFPRGAEAQDWHLDMQLTGKVVLSAAALLLVTVAYRLYKSRPAPAQRWGGNGQAEAKEEAEGSGQPAVQEASPGVLLRGPRRRRSSKRAEAPQGCSCENPRGPYVLVTGATSTDRKPQRKGSGEERGGQGSDSEQVPPCCPSQETRTAVGSNPDPPHFPRLGSEPKSSPAGLIAAADGSCAGGEPSPWQDSKPREHPGLGQLEPPHCHYVAPLQGSSDMNQSWVFTRVIGVSREEAGALEAASDVDLTLHQQEGAPNSSYTFSSIARVRMEEHFIQKAEGVEPRLKGKVYDYYVESTSQAIFQGRLAPRTAALTEVPSPRPPPGSLGTGAASGGQAGDTKGAAERAASPQTGPWPSTRGFSRKESLLQIAENPELQLQPDGFRLPAPPCPDPGALPGLGRSSREPHVQPVAGTNFFHIPLTPASAPQVRLDLGNCYEVLTLAKRQNLEALKEAAYKVMSENYLQVLRSPDIYGCLSGAERELILQRRLRGRQYLVVADVCPKEDSGGLCCYDDEQDVWRPLARMPPEAVSRGCAICSLFNYLFVVSGCQGPGHQPSSRVFCYNPLTGIWSEVCPLNQARPHCRLVALDGHLYAIGGECLNSVERYDPRLDRWDFAPPLPSDTFALAHTATVRAKEIFVTGGSLRFLLFRFSAQEQRWWAGPTGGSKDRTAEMVAVNGFLYRFDLNRSLGIAVYRCSASTRLWYECATYRTPYPDAFQCAVVDNLIYCVGRRSTLCFLADSVSPRFVPKELRSFPAPQGTLLPTVLTLPTPDLPQTRV

SEQ ID NO: 42730 - protein, 594 aa, Homo sapiens
  Payload ID: 8686
  Gene Symbol: KLHDC7B
  Gene Name: kelch domain containing 7B
  Uniprot ID: Q96G42
  ENSP ID: ENSP00000379034
MVLRSHPFPRQDRPQGSVPRAVPGSPVGPSTSTHSEDRHGPSSSVGTVIGTGTGGLVEAGGQPQPRSSETNGSPSPDPPPGLRGEGTREKSLDPLPQAAMPRGPAQPPAQRPPGPAASSSARRSQPVPQLRKRSRCEIAPSSEQEVRPAASGDPQGEAPGEGGSPAGRSGALTEKQEEARKLMVFLQRPGGWGVVEGPRKPSSRALEPATAAALRRRLDLGSCLDVLAFAQQHGEPGLAQETYALMSDNLLRVLGDPCLYRRLSAADRERILSLRTGRGRAVLGVLVLPSLYQGGRSGLPRGPRGEEPPAAAPVSLPLPAHLHVFNPRENTWRPLTQVPEEAPLRGCGLCTMHNYLFLAGGIRGSGAKAVCSNEVFCYNPLTNIWSQVRPMQQARAQLKLVALDGLLYAIGGECLYSMECYDPRTDAWTPRAPLPAGTFPVAHEAVACRGDIYVTGGHLFYRLLRYSPVKDAWDECPYSASHRRSSDIVALGGFLYRFDLLRGVGAAVMRYNTVTGSWSRAASLPLPAPAPLHCTTLGNTIYCLNPQVTATFTVSGGTAQFQAKELQPFPLGSTGVLSPFILTLPPEDRLQTSL

SEQ ID NO: 42731 - protein, 350 aa, Homo sapiens
  Payload ID: 8687
  Gene Symbol: KLHDC8A
  Gene Name: kelch domain containing 8A
  Uniprot ID: Q8IYD2
  ENSP ID: ENSP00000356123
MEVPNVKDFQWKRLAPLPSRRVYCSLLETGGQVYAIGGCDDNGVPMDCFEVYSPEADQWTALPRLPTARAGVAVTALGKRIMVIGGVGTNQLPLKVVEMYNIDEGKWKKRSMLREAAMGISVTAKDYRVYAAGGMGLDLRPHNHLQHYDMLKDMWVSLAPMPTPRYAATSFLRGSKIYVLGGRQSKYAVNAFEVFDIETRSWTKFPNIPYKRAFSSFVTLDNHLYSLGGLRQGRLYRQPKFLRTMDVFDMEQGGWLKMERSFFLKKRRADFVAGSLSGRVIVAGGLGNQPTVLETAEAFHPGKNKWEILPAMPTPRCACSSIVVKNCLLAVGGVNQGLSDAVEALCVSDS

SEQ ID NO: 42732 - protein, 350 aa, Homo sapiens; identical to SEQ ID NO: 42731
  Payload ID: 8687
  Gene Symbol: KLHDC8A
  Gene Name: kelch domain containing 8A
  Uniprot ID: Q8IYD2
  ENSP ID: ENSP00000356124

SEQ ID NO: 42733 - protein, 350 aa, Homo sapiens; identical to SEQ ID NO: 42731
  Payload ID: 8687
  Gene Symbol: KLHDC8A
  Gene Name: kelch domain containing 8A
  Uniprot ID: Q8IYD2
  ENSP ID: ENSP00000442229

SEQ ID NO: 42734 - protein, 79 aa, Homo sapiens
  Payload ID: 8687
  Gene Symbol: KLHDC8A
  Gene Name: kelch domain containing 8A
  ENSP ID: ENSP00000475290
MEVPNVKDFQWKRLAPLPSRRVYCSLLETGGQVYAIGGCDDNGVPMDCFEVYSPEADQWTALPRLPTARAGVAVTALGK

SEQ ID NO: 42735 - protein, 66 aa, Homo sapiens
  Payload ID: 8687
  Gene Symbol: KLHDC8A
  Gene Name: kelch domain containing 8A
  ENSP ID: ENSP00000475334
MEVPNVKDFQWKRLAPLPSRRVYCSLLETGGQVYAIGGCDDNGVPMDCFEVYSPEADQWTALPRLP

SEQ ID NO: 42736 - protein, 175 aa, Homo sapiens
  Payload ID: 8687
  Gene Symbol: KLHDC8A
  Gene Name: kelch domain containing 8A
  ENSP ID: ENSP00000475745
MGLDLRPHNHLQHYDMLKDMWVSLAPMPTPRYAATSFLRGSKIYVLGGRQSKYAVNAFEVFDIETRSWTKFPNIPYKRAFSSFVTLDNHLYSLGGLRQGRLYRQPKFLRTMDVFDMEQGGWLKMERSFFLKKRRADFVAGSLSGRVIVAGGLGNQPTVLETAEAFHPGKNKWEIL

SEQ ID NO: 42737 - protein, 216 aa, Homo sapiens
  Payload ID: 8687
  Gene Symbol: KLHDC8A
  Gene Name: kelch domain containing 8A
  ENSP ID: ENSP00000475871
MGLDLRPHNHLQHYDMLKDMWVSLAPMPTPRYAATSFLRGSKIYVLGGRQSKYAVNAFEVFDIETRSWTKFPNIPYKRAFSSFVTLDNHLYSLGGLRQGRLYRQPKFLRTMDVFDMEQGGWLKMERSFFLKKRRADFVAGSLSGRVIVAGGLGNQPTVLETAEAFHPGKNKWEILPAMPTPRCACSSIVVKNCLLAVGGVNQGLSDAVEALCVSDS

SEQ ID NO: 42738 - protein, 83 aa, Homo sapiens
  Payload ID: 8687
  Gene Symbol: KLHDC8A
  Gene Name: kelch domain containing 8A
  ENSP ID: ENSP00000475902
MDCFEVYSPEADQWTALPRLPTARAGVAVTALGKRIMVIGGVGTNQLPLKVVEMYNIDEGKWKKRSMLREAAMGISVTAKDYR

SEQ ID NO: 42739 - protein, 26 aa, Homo sapiens
  Payload ID: 8687
  Gene Symbol: KLHDC8A
  Gene Name: kelch domain containing 8A
  ENSP ID: ENSP00000475955
MEVPNVKDFQWKRLAPLPSRRVYCSL

SEQ ID NO: 42740 - protein, 354 aa, Homo sapiens
  Payload ID: 8688
  Gene Symbol: KLHDC8B
  Gene Name: kelch domain containing 8B
  Uniprot ID: Q8IXV7
  ENSP ID: ENSP00000327468
MSAGGGRAFAWQVFPPMPTCRVYGTVAHQDGHLLVLGGCGRAGLPLDTAETLDMASHTWLALAPLPTARAGAAAVVLGKQVLVVGGVDEVQSPVAAVEAFLMDEGRWERRATLPQAAMGVATVERDGMVYALGGMGPDTAPQAQVRVYEPRRDCWLSLPSMPTPCYGASTFLHGNKIYVLGGRQGKLPVTAFEAFDLEARTWTRHPSLPSRRAFAGCAMAEGSVFSLGGLQQPGPHNFYSRPHFVNTVEMFDLEHGSWTKLPRSLRMRDKRADFVVGSLGGHIVAIGGLGNQPCPLGSVESFSLARRRWEALPAMPTARCSCSSLQAGPRLFVIGGVAQGPSQAVEALCLRDGV

SEQ ID NO: 42741 - protein, 349 aa, Homo sapiens
  Payload ID: 8689
  Gene Symbol: KLHDC9
  Gene Name: kelch domain containing 9
  Uniprot ID: Q8NEP7
  ENSP ID: ENSP00000356990
MAVAVPPGRAAGSGWAWRPVARDALLARAFHSCTELRGRFYLVGGLLAGGAREPSSDTVVFDPARGQAVRLGARGSPPRSHHDAAPVDGRWLCVVGGWDGSRRLATVTALDTERGVWEAWTGTPGDCPPAGLSSHTCTRISDRELQVAGREGGIHTQRRYGSIYTLRLDPSARTYCYKQEGCHTASRSGHCAALLQTPGPHPGHQLLLFGGCNLAEPEVAGHWSHGKIKEEPPVAPHLMEQLARLVSSGQGSQKGPHGLRHHSCSVVGPFAVLFGGETLTRARDTICNDLYIYDTRTSPPLWFHFPCADRGMKRMGHRTCLWNDQLYLVGGFGEDGRTASPQVCILDFI

SEQ ID NO: 42742 - protein, 288 aa, Homo sapiens
  Payload ID: 8689
  Gene Symbol: KLHDC9
  Gene Name: kelch domain containing 9
  Uniprot ID: Q8NEP7
  ENSP ID: ENSP00000376030
MAVAVPPGRAAGSGWAWRPVARDALLARAFHSCTELRGRFYLVGGLLAGGAREPSSDTVVFDPARGQAVRLGARGSPPRSHHDAAPVDGRWLCVVGGWDGSRRLATVTALDTERGVWEAWTGTPGDCPPAGLSSHTCTRISDRELQVAGREGGIHTQRRYGSIYTLRLDPSARTYCYKQEGCHTASRSGHCAALLQTPGPHPGHQLLLFGGCNLAEPEVAGHWSHGKIKSFLSPQGGTTCCSSFDGTACKACEQWAGVPEGAPWTTASLMFCGRALCCAVWWRNSDQS

SEQ ID NO: 42743 - protein, 623 aa, Homo sapiens
  Payload ID: 8690
  Gene Symbol: KBTBD11
  Gene Name: kelch repeat and BTB (POZ) domain containing 11
  Uniprot ID: O94819
  ENSP ID: ENSP00000321544
MEHAVAPCVLYPGTEPGAAGESESEGAASPAQTPCSLGASLCFSSGEESPPQSLASAAEGAATSPPSSGGPRVVERQWEAGSAGAASPEELASPEERACPEEPAAPSPEPRVWLEDPASPEEPGEPAPVPPGFGAVYGEPDLVLEVSGRRLRAHKAVLAARSDYFRARASRDVLRVQGVSLTALRLLLADAYSGRMAGVRPDNVAEVVAGARRLQLPGAAQRATDAVGPQLSLANCYEVLSAAKRQRLNELRDAAYCFMSDHYLEVLREPAVFGRLSGAERDLLLRRRLRAGRAHLLAAALGPAGERAGSRPQSPSGDADARGDAAVYCFHAAAGEWRELTRLPEGAPARGCGLCVLYNYLFVAGGVAPAGPDGRARPSDQVFCYNPATDSWSAVRPLRQARSQLRLLALDGHLYAVGGECLLSVERYDPRADRWAPVAPLPRGAFAVAHEATTCHGEIYVSGGSLFYRLLKYDPRRDEWQECPCSSSRERSADMVALDGFIYRFDLSGSRGEAQAAGPSGVSVSRYHCLAKQWSPCVAPLRLPGGPTGLQPFRCAALDGAIYCVSRAGTWRFQPAREGEAGGDAGQGGGFEALGAPLDVRGVLIPFALSLPEKPPRGEQGAP

SEQ ID NO: 42744 - protein, 623 aa, Homo sapiens; identical to SEQ ID NO: 42743
  Payload ID: 8690
  Gene Symbol: KBTBD11
  Gene Name: kelch repeat and BTB (POZ) domain containing 11
  Uniprot ID: O94819
  ENSP ID: ENSP00000481889

SEQ ID NO: 42745 - protein, 198 aa, Homo sapiens
  Payload ID: 8691
  Gene Symbol: KBTBD12
  Gene Name: kelch repeat and BTB (POZ) domain containing 12
  Uniprot ID: Q3ZCT8
  ENSP ID: ENSP00000345478
MIEETSFGKSYAQLNFENSMLWMDLPDEEPDRLSNKLLQYDPSQDQWSVRAPMKYSKYRFSTAVVNSEIYVLGGIGCVGQDKGQVRKCLDVVEIYNPDGDFWREGPPMPSPLLSLRTNSTNAGAVDGKLYVCGGFHGADRHEVISKEILELDPWENQWNVVAINVLMHDSYDVCLVARMNPRDLIPPPSDLVEEGNEH

SEQ ID NO: 42746 - protein, 230 aa, Homo sapiens
  Payload ID: 8691
  Gene Symbol: KBTBD12
  Gene Name: kelch repeat and BTB (POZ) domain containing 12
  ENSP ID: ENSP00000385830
MKIKNQYLITNCVDKYSVERDNWKRVSPLPLQLACHAVVTVNNKLYVIGGWTPQMDLPDEEPDRLSNKLLQYDPSQDQWSVRAPMKYSKYRFSTAVVNSEIYVLGGIGCVGQDKGQVRKCLDVVEIYNPDGDFWREGPPMPSPLLSLRTNSTNAGAVDGKLYVCGGFHGADRHEVISKEILELDPWENQWNVVAINVLMHDSYDVCLVARMNPRDLIPPPSDLVEEGNEH

SEQ ID NO: 42747 - protein, 623 aa, Homo sapiens
  Payload ID: 8691
  Gene Symbol: KBTBD12
  Gene Name: kelch repeat and BTB (POZ) domain containing 12
  Uniprot ID: Q3ZCT8
  ENSP ID: ENSP00000385879
MECKIEGKEKYQHSLNLLNKIQNMKELAEMIDVVLTAEGEKFPCHRLVLAAFSPYFKAMFTCGLLECNQREVILYDITAESVSVLLNYMYNAALEINNANVQTVAMAAYFMQMEEVFSVCQKYMMDHMDASNCLGIYYFAKQIGAEDLSDRSKKYLYQHFAEVSLHEEILEIEVHQFLTLIKSDDLNISREESILDLVLRWVNHNKELRTVHLVELLKQVRLELVNPSFLRQALRRNTMLLCDADCVDIIQNAFKAIKTPQQHSLNLRYGMETTSLLLCIGNNSSGIRSRHRSYGDASFCYDPVSRKTYFISSPKYGEGLGTVCTGVVMENNTIIVAGEASASKLSRQKNKNVEIYRYHDRGNQFWEKLCTAEFRELYALGSIHNDLYVIGGQMKIKNQYLITNCVDKYSVERDNWKRVSPLPLQLACHAVVTVNNKLYVIGGWTPQMDLPDEEPDRLSNKLLQYDPSQDQWSVRAPMKYSKYRFSTAVVNSEIYVLGGIGCVGQDKGQVRKCLDVVEIYNPDGDFWREGPPMPSPLLSLRTNSTNAGAVDGKLYVCGGFHGADRHEVISKEILELDPWENQWNVVAINVLMHDSYDVCLVARMNPRDLIPPPSDLVEEGNEH

SEQ ID NO: 42748 - protein, 623 aa, Homo sapiens; identical to SEQ ID NO: 42747
  Payload ID: 8691
  Gene Symbol: KBTBD12
  Gene Name: kelch repeat and BTB (POZ) domain containing 12
  Uniprot ID: Q3ZCT8
  ENSP ID: ENSP00000385957

SEQ ID NO: 42749 - protein, 458 aa, Homo sapiens
  Payload ID: 8692
  Gene Symbol: KBTBD13
  Gene Name: kelch repeat and BTB (POZ) domain containing 13
  Uniprot ID: C9JR72
  ENSP ID: ENSP00000388723
MARGPQTLVQVWVGGQLFQADRALLVEHCGFFRGLFRSGMRETRAAEVRLGVLSAGGFRATLQVLRGDRPALAAEDELLQAVECAAFLQAPALARFLEHNLTSDNCALLCDAAAAFGLRDVFHSAALFICDGERELAAELALPEARAYVAALRPSSYAAVSTHTPAPGFLEDASRTLCYLDEEEDAWRTLAALPLEASTLLAGVATLGNKLYIVGGVRGASKEVVELGFCYDPDGGTWHEFPSPHQPRYDTALAGFDGRLYAIGGEFQRTPISSVERYDPAAGCWSFVADLPQPAAGVPCAQACGRLFVCLWRPADTTAVVEYAVRTDAWLPVAELRRPQSYGHCMVAHRDSLYVVRNGPSDDFLHCAIDCLNLATGQWTALPGQFVNSKGALFTAVVRGDTVYTVNRMFTLLYAIEGGTWRLLREKAGFPRPGSLQTFLLRLPPGAPGPVTSTTAEL

SEQ ID NO: 42750 - protein, 623 aa, Homo sapiens
  Payload ID: 8693
  Gene Symbol: KBTBD2
  Gene Name: kelch repeat and BTB (POZ) domain containing 2
  Uniprot ID: Q8IY47
  ENSP ID: ENSP00000302586
MSTQDERQINTEYAVSLLEQLKLFYEQQLFTDIVLIVEGTEFPCHKMVLATCSSYFRAMFMSGLSESKQTHVHLRNVDAATLQIIITYAYTGNLAMNDSTVEQLYETACFLQVEDVLQRCREYLIKKINAENCVRLLSFADLFSCEELKQSAKRMVEHKFTAVYHQDAFMQLSHDLLIDILSSDNLNVEKEETVREAAMLWLEYNTESRSQYLSSVLSQIRIDALSEVTQRAWFQGLPPNDKSVVVQGLYKSMPKFFKPRLGMTKEEMMIFIEASSENPCSLYSSVCYSPQAEKVYKLCSPPADLHKVGTVVTPDNDIYIAGGQVPLKNTKTNHSKTSKLQTAFRTVNCFYWFDAQQNTWFPKTPMLFVRIKPSLVCCEGYIYAIGGDSVGGELNRRTVERYDTEKDEWTMVSPLPCAWQWSAAVVVHDCIYVMTLNLMYCYFPRSDSWVEMAMRQTSRSFASAAAFGDKIFYIGGLHIATNSGIRLPSGTVDGSSVTVEIYDVNKNEWKMAANIPAKRYSDPCVRAVVISNSLCVFMRETHLNERAKYVTYQYDLELDRWSLRQHISERVLWDLGRDFRCTVGKLYPSCLEESPWKPPTYLFSTDGTEEFELDGEMVALPPV

SEQ ID NO: 42751 - protein, 4 aa, Homo sapiens
  Payload ID: 8693
  Gene Symbol: KBTBD2
  Gene Name: kelch repeat and BTB (POZ) domain containing 2
  ENSP ID: ENSP00000388236
MSTQ

SEQ ID NO: 42752 - protein, 47 aa, Homo sapiens
  Payload ID: 8693
  Gene Symbol: KBTBD2
  Gene Name: kelch repeat and BTB (POZ) domain containing 2
  ENSP ID: ENSP00000395715
MSTQDERQINTEYAVSLLEQLKLFYEQQLFTDIVLIVEGTEFPCHKM

SEQ ID NO: 42753 - protein, 29 aa, Homo sapiens
  Payload ID: 8693
  Gene Symbol: KBTBD2
  Gene Name: kelch repeat and BTB (POZ) domain containing 2
  ENSP ID: ENSP00000407059
MSTQDERQINTEYAVSLLEQLKLFYEQQL

SEQ ID NO: 42754 - protein, 13 aa, Homo sapiens
  Payload ID: 8693
  Gene Symbol: KBTBD2
  Gene Name: kelch repeat and BTB (POZ) domain containing 2
  ENSP ID: ENSP00000407520
MSTQDERQINTEY

SEQ ID NO: 42755 - protein, 334 aa, Homo sapiens
  Payload ID: 8693
  Gene Symbol: KBTBD2
  Gene Name: kelch repeat and BTB (POZ) domain containing 2
  ENSP ID: ENSP00000481197
MSTQDERQINTEYAVSLLEQLKLFYEQQLFTDIVLIVEGTEFPCHKMVLATCSSYFRAMFMSGLSESKQTHVHLRNVDAATLQIIITYAYTGNLAMNDSTVEQLYETACFLQVEDVLQRCREYLIKKINAENCVRLLSFADLFSCEELKQSAKRMVEHKFTAVYHQDAFMQLSHDLLIDILSSDNLNVEKEETVREAAMLWLEYNTESRSQYLSSVLSQIRIDALSEVTQRAWFQGLPPNDKSVVVQGLYKSMPKFFKPRLGMTKEEMMIFIEASSENPCSLYSSVCYSPQAEKVYKLCSPPADLHKVGTVVTPDNDIYIAGGQVPLKHKNKSQ

SEQ ID NO: 42756 - protein, 533 aa, Homo sapiens
  Payload ID: 8694
  Gene Symbol: KBTBD3
  Gene Name: kelch repeat and BTB (POZ) domain containing 3
  ENSP ID: ENSP00000431910
MFEVNMKERDDGSVTITNLSSKAVKAFLDYAYTGKTKITDDNVEMFFQLSSFLQVSFLSKACSDFLIKSINLVNCLQLLSISDSYGSTSLFDHALHFVQHHFSLLFKSSDFLEMNFGVLQKCLESDELNVPEEEMVLKVVLSWTKHNLESRQKYLPHLIEKVRLHQLSEETLQDCLFNEESLLKSTNCFDIIMDAIKCVQGSGGLFPDARPSTTEKYIFIHKTEENGENQYTFCYNIKSDSWKILPQSHLIDLPGSSLSSYGEKIFLTGGCKGKCCRTVRLHIAESYHDATDQTWCYCPVKNDFFLVSTMKTPRTMHTSVMALDRLFVIGGKTRGSRDIKSLLDVESYNPLSKEWISVSPLPRGIYYPEASTCQNVIYVLGSEVEITDAFNPSLDCFFKYNATTDQWSELVAEFGQFFHATLIKAVPVNCTLYICDLSTYKVYSFCPDTCVWKGEGSFECAGFNAGAIGIEDKIYILGGDYAPDEITDEVQVYHSNRSEWEEVSPMPRALTEFYCQVIQFNKYRDPWFSNLCA

SEQ ID NO: 42757 - protein, 612 aa, Homo sapiens
  Payload ID: 8694
  Gene Symbol: KBTBD3
  Gene Name: kelch repeat and BTB (POZ) domain containing 3
  Uniprot ID: Q8NAB2
  ENSP ID: ENSP00000432163
MELAMDNSYAFNQRSTCNGIPSEKKNNFLVSEDHGQKILSVLQNFREQNVFYDFKIIMKDEIIPCHRCVLAACSDFFRAMFEVNMKERDDGSVTITNLSSKAVKAFLDYAYTGKTKITDDNVEMFFQLSSFLQVSFLSKACSDFLIKSINLVNCLQLLSISDSYGSTSLFDHALHFVQHHFSLLFKSSDFLEMNFGVLQKCLESDELNVPEEEMVLKVVLSWTKHNLESRQKYLPHLIEKVRLHQLSEETLQDCLFNEESLLKSTNCFDIIMDAIKCVQGSGGLFPDARPSTTEKYIFIHKTEENGENQYTFCYNIKSDSWKILPQSHLIDLPGSSLSSYGEKIFLTGGCKGKCCRTVRLHIAESYHDATDQTWCYCPVKNDFFLVSTMKTPRTMHTSVMALDRLFVIGGKTRGSRDIKSLLDVESYNPLSKEWISVSPLPRGIYYPEASTCQNVIYVLGSEVEITDAFNPSLDCFFKYNATTDQWSELVAEFGQFFHATLIKAVPVNCTLYICDLSTYKVYSFCPDTCVWKGEGSFECAGFNAGAIGIEDKIYILGGDYAPDEITDEVQVYHSNRSEWEEVSPMPRALTEFYCQVIQFNKYRDPWFSNLCA

SEQ ID NO: 42758 - protein, 33 aa, Homo sapiens
  Payload ID: 8694
  Gene Symbol: KBTBD3
  Gene Name: kelch repeat and BTB (POZ) domain containing 3
  ENSP ID: ENSP00000433493
MFEVNMKERDDGSVTITNLSSKAVKAFLDYAYT

SEQ ID NO: 42759 - protein, 612 aa, Homo sapiens; identical to SEQ ID NO: 42757
  Payload ID: 8694
  Gene Symbol: KBTBD3
  Gene Name: kelch repeat and BTB (POZ) domain containing 3
  Uniprot ID: Q8NAB2
  ENSP ID: ENSP00000436262

SEQ ID NO: 42760 - protein, 91 aa, Homo sapiens
  Payload ID: 8694
  Gene Symbol: KBTBD3
  Gene Name: kelch repeat and BTB (POZ) domain containing 3
  ENSP ID: ENSP00000475836
MELAMDNSYAFNQRSTCNGIPSEKKNNFLVSEDHGQKILSVLQNFREQNVFYDFKIIMKDEIIPCHRCVLAACSDFFRSSQVSISQSSLEH

SEQ ID NO: 42761 - protein, 518 aa, Homo sapiens
  Payload ID: 8695
  Gene Symbol: KBTBD4
  Gene Name: kelch repeat and BTB (POZ) domain containing 4
  Uniprot ID: Q9NVX7
  ENSP ID: ENSP00000378703
MESPEEPGASMDENYFVNYTFKDRSHSGRVAQGIMKLCLEEELFADVTISVEGREFQLHRLVLSAQSCFFRSMFTSNLKEAHNRVIVLQDVSESVFQLLVDYIYHGTVKLRAEELQEIYEVSDMYQLTSLFEECSRFLARTVQVGNCLQVMWLADRHSDPELYTAAKHCAKTHLAQLQNTEEFLHLPHRLLTDIISDGVPCSQNPTEAIEAWINFNKEEREAFAESLRTSLKEIGENVHIYLIGKESSRTHSLAVSLHCAEDDSISVSGQNSLCHQITAACKHGGDLYVVGGSIPRRMWKCNNATVDWEWCAPLPRDRLQHTLVSVPGKDAIYSLGGKTLQDTLSNAVIYYRVGDNVWTETTQLEVAVSGAAGANLNGIIYLLGGEENDLDFFTKPSRLIQCFDTETDKCHVKPYVLPFAGRMHAAVHKDLVFIVAEGDSLVCYNPLLDSFTRLCLPEAWSSAPSLWKIASCNGSIYVFRDRYKKGDANTYKLDPATSAVTVTRGIKVLLTNLQFVLA

SEQ ID NO: 42762 - protein, 534 aa, Homo sapiens
  Payload ID: 8695
  Gene Symbol: KBTBD4
  Gene Name: kelch repeat and BTB (POZ) domain containing 4
  Uniprot ID: Q9NVX7
  ENSP ID: ENSP00000415106
MKGGNADSWQREKLASMESPEEPGASMDENYFVNYTFKDRSHSGRVAQGIMKLCLEEELFADVTISVEGREFQLHRLVLSAQSCFFRSMFTSNLKEAHNRVIVLQDVSESVFQLLVDYIYHGTVKLRAEELQEIYEVSDMYQLTSLFEECSRFLARTVQVGNCLQVMWLADRHSDPELYTAAKHCAKTHLAQLQNTEEFLHLPHRLLTDIISDGVPCSQNPTEAIEAWINFNKEEREAFAESLRTSLKEIGENVHIYLIGKESSRTHSLAVSLHCAEDDSISVSGQNSLCHQITAACKHGGDLYVVGGSIPRRMWKCNNATVDWEWCAPLPRDRLQHTLVSVPGKDAIYSLGGKTLQDTLSNAVIYYRVGDNVWTETTQLEVAVSGAAGANLNGIIYLLGGEENDLDFFTKPSRLIQCFDTETDKCHVKPYVLPFAGRMHAAVHKDLVFIVAEGDSLVCYNPLLDSFTRLCLPEAWSSAPSLWKIASCNGSIYVFRDRYKKGDANTYKLDPATSAVTVTRGIKVLLTNLQFVLA

SEQ ID NO: 42763 - protein, 173 aa, Homo sapiens
  Payload ID: 8695
  Gene Symbol: KBTBD4
  Gene Name: kelch repeat and BTB (POZ) domain containing 4
  ENSP ID: ENSP00000433124
MKGGNAGYSRWCCFADSWQREKLASMESPEEPGASMDENYFVNYTFKDRSHSGRVAQGIMKLCLEEELFADVTISVEGREFQLHRLVLSAQSCFFRSMFTSNLKEAHNRVIVLQDVSESVFQLLVDYIYHGTVKLRAEELQEIYEVSDMYQLTSLFEECSRFLARTVQVGNCL

SEQ ID NO: 42764 - protein, 518 aa, Homo sapiens; identical to SEQ ID NO: 42761
  Payload ID: 8695
  Gene Symbol: KBTBD4
  Gene Name: kelch repeat and BTB (POZ) domain containing 4
  Uniprot ID: Q9NVX7
  ENSP ID: ENSP00000433340

SEQ ID NO: 42765 - protein, 198 aa, Homo sapiens
  Payload ID: 8695
  Gene Symbol: KBTBD4
  Gene Name: kelch repeat and BTB (POZ) domain containing 4
  ENSP ID: ENSP00000433404
MESPEEPGASMDENYFVNYTFKDRSHSGRVAQGIMKLCLEEELFADVTISVEGREFQLHRLVLSAQSCFFRSMFTSNLKEAHNRVIVLQDVSESVFQLLVDYIYHGTVKLRAEELQEIYEVSDMYQLTSLFEECSRFLARTVQVGNCLQVMWLADRHSDPELYTAAKHCAKTHLAQLQNTEEFLHLPHRLLTDIISGK

SEQ ID NO: 42766 - protein, 161 aa, Homo sapiens
  Payload ID: 8695
  Gene Symbol: KBTBD4
  Gene Name: kelch repeat and BTB (POZ) domain containing 4
  ENSP ID: ENSP00000433653
MESPEEPGASMDENYFVNYTFKDRSHSGRVAQGIMKLCLEEELFADVTISVEGREFQLHRLVLSAQSCFFRSMFTSNLKEAHNRVIVLQDVSESVFQLLVDYIYHGTVKLRAEELQEIYEVSDMYQLTSLFEECSRFLARTVQVGNCLQVMWLADRHSDPE

SEQ ID NO: 42767 - protein, 286 aa, Homo sapiens
  Payload ID: 8695
  Gene Symbol: KBTBD4
  Gene Name: kelch repeat and BTB (POZ) domain containing 4
  ENSP ID: ENSP00000434477
MGLPVPRPGGGWTQVLGRSHRESFERAGKCGGSSSEESKYSWQREKLASMESPEEPGASMDENYFVNYTFKDRSHSGRVAQGIMKLCLEEELFADVTISVEGREFQLHRLVLSAQSCFFRSMFTSNLKEAHNRVIVLQDVSESVFQLLVDYIYHGTVKLRAEELQEIYEVSDMYQLTSLFEECSRFLARTVQVGNCLQVMWLADRHSDPELYTAAKHCAKTHLAQLQNTEEFLHLPHRLLTDIISDGVPCSQNPTEAIEAWINFNKEEREAFAESLRTSLKVRQIS

SEQ ID NO: 42768 - protein, 159 aa, Homo sapiens
  Payload ID: 8695
  Gene Symbol: KBTBD4
  Gene Name: kelch repeat and BTB (POZ) domain containing 4
  ENSP ID: ENSP00000435651
MESPEEPGASMDENYFVNYTFKDRSHSGRVAQGIMKLCLEEELFADVTISVEGREFQLHRLVLSAQSCFFRSMFTSNLKEAHNRVIVLQDVSESVFQLLVDYIYHGTVKLRAEELQEIYEVSDMYQLTSLFEECSRFLARTVQVGNCLQVMWLADRHSD

SEQ ID NO: 42769 - protein, 31 aa, Homo sapiens
  Payload ID: 8695
  Gene Symbol: KBTBD4
  Gene Name: kelch repeat and BTB (POZ) domain containing 4
  ENSP ID: ENSP00000435850
MKGGNADYGCEFLRLLKMVLLCRQLAEREVG

SEQ ID NO: 42770 - protein, 543 aa, Homo sapiens
  Payload ID: 8695
  Gene Symbol: KBTBD4
  Gene Name: kelch repeat and BTB (POZ) domain containing 4
  ENSP ID: ENSP00000436713
MAVNSSGYSRWCCFADSWQREKLASMESPEEPGASMDENYFVNYTFKDRSHSGRVAQGIMKLCLEEELFADVTISVEGREFQLHRLVLSAQSCFFRSMFTSNLKEAHNRVIVLQDVSESVFQLLVDYIYHGTVKLRAEELQEIYEVSDMYQLTSLFEECSRFLARTVQVGNCLQVMWLADRHSDPELYTAAKHCAKTHLAQLQNTEEFLHLPHRLLTDIISDGVPCSQNPTEAIEAWINFNKEEREAFAESLRTSLKEIGENVHIYLIGKESSRTHSLAVSLHCAEDDSISVSGQNSLCHQITAACKHGGDLYVVGGSIPRRMWKCNNATVDWEWCAPLPRDRLQHTLVSVPGKDAIYSLGGKTLQDTLSNAVIYYRVGDNVWTETTQLEVAVSGAAGANLNGIIYLLGGEENDLDFFTKPSRLIQCFDTETDKCHVKPYVLPFAGRMHAAVHKDLVFIVAEGDSLVCYNPLLDSFTRLCLPEAWSSAPSLWKIASCNGSIYVFRDRYKKGDANTYKLDPATSAVTVTRGIKVLLTNLQFVLA

SEQ ID NO: 42771 - protein, 674 aa, Homo sapiens
  Payload ID: 8696
  Gene Symbol: KBTBD6
  Gene Name: kelch repeat and BTB (POZ) domain containing 6
  Uniprot ID: Q86V97
  ENSP ID: ENSP00000368799
MQSREDAPRSRRLASPRGGKRPKKIHKPTVSAFFTGPEELKDTAHSAALLAQLKSFYDARLLCDVTIEVVTPGSGPGTGRLFPCNRNVLAAACPYFKSMFTGGMYESQQASVTMHDVDAESFEVLVDYCYTGRVSLSEANVERLYAASDMLQLEYVREACASFLARRLDLTNCTAILKFADAFGHRKLRSQAQSYIAQNFKQLSHMGSIREETLADLTLAQLLAVLRLDSLDVESEQTVCHVAVQWLEAAPKERGPSAAEVFKCVRWMHFTEEDQDYLEGLLTKPIVKKYCLDVIEGALQMRYGDLLYKSLVPVPNSSSSSSSSNSLVSAAENPPQRLGMCAKEMVIFFGHPRDPFLCCDPYSGDLYKVPSPLTCLAHTRTVTTLAVCISPDHDIYLAAQPRTDLWVYKPAQNSWQQLADRLLCREGMDVAYLNGYIYILGGRDPITGVKLKEVECYNVKRNQWALVAPLPHSFLSFDLMVIRDYLYALNSKRMFCYDPSHNMWLKCVSLKRNDFQEACVFNEEIYCICDIPVMKVYNPVRAEWRQMNNIPLVSETNNYRIIKHGQKLLLITSRTPQWKKNRVTVYEYDIRGDQWINIGTTLGLLQFDSNFFCLSARVYPSCLEPGQSFLTEEEEIPSESSTEWDLGGFSEPDSESGSSSSLSDDDFWVRVAPQ

SEQ ID NO: 42772 - protein, 684 aa, Homo sapiens
  Payload ID: 8697
  Gene Symbol: KBTBD7
  Gene Name: kelch repeat and BTB (POZ) domain containing 7
  Uniprot ID: Q8WVZ9
  ENSP ID: ENSP00000368797
MQSREDVPRSRRLASPRGGRRPKRISKPSVSAFFTGPEELKDTAHSAALLAQLKSFYDARLLCDVTIEVVTPGSGPGTGRLFSCNRNVLAAACPYFKSMFTGGMYESQQASVTMHDVDAESFEVLVDYCYTGRVSLSEANVQRLYAASDMLQLEYVREACASFLARRLDLTNCTAILKFADAFDHHKLRSQAQSYIAHNFKQLSRMGSIREETLADLTLAQLLAVLRLDSLDIESERTVCHVAVQWLEAAAKERGPSAAEVFKCVRWMHFTEEDQDYLEGLLTKPIVKKYCLDVIEGALQMRYGDLLYKSLVPVPNSSSSSSSSNSLVSAAENPPQRLGMCAKEMVIFFGHPRDPFLCYDPYSGDIYTMPSPLTSFAHTKTVTSSAVCVSPDHDIYLAAQPRKDLWVYKPAQNSWQQLADRLLCREGMDVAYLNGYIYILGGRDPITGVKLKEVECYSVQRNQWALVAPVPHSFYSFELIVVQNYLYAVNSKRMLCYDPSHNMWLNCASLKRSDFQEACVFNDEIYCICDIPVMKVYNPARGEWRRISNIPLDSETHNYQIVNHDQKLLLITSTTPQWKKNRVTVYEYDTREDQWINIGTMLGLLQFDSGFICLCARVYPSCLEPGQSFITEEDDARSESSTEWDLDGFSELDSESGSSSSFSDDEVWVQVAPQRNAQDQQGSL

SEQ ID NO: 42773 - protein, 601 aa, Homo sapiens
  Payload ID: 8698
  Gene Symbol: KBTBD8
  Gene Name: kelch repeat and BTB (POZ) domain containing 8
  Uniprot ID: Q8NFY9
  ENSP ID: ENSP00000401878
MAASADLSKSSPTPNGIPSSDPASDAMDPFHACSILKQLKTMYDEGQLTDIVVEVDHGKTFSCHRNVLAAISPYFRSMFTSGLTESTQKEVRIVGVEAESMDLVLNYAYTSRVILTEANVQALFTAASIFQIPSIQDQCAKYMISHLDPQNSIGVFIFADHYGHQELGDRSKEYIRKKFLCVTKEQEFLQLTKDQLISILDSDDLNVDREEHVYESIIRWFEHEQNEREVHLPEIFAKCIRFPLMEDTFIEKIPPQFAQAIAKSCVEKGPSNTNGCTQRLGMTASEMIICFDAAHKHSGKKQTVPCLDIVTGRVFKLCKPPNDLREVGILVSPDNDIYIAGGYRPSSSEVSIDHKAENDFWMYDHSTNRWLSKPSLLRARIGCKLVYCCGKMYAIGGRVYEGDGRNSLKSVECYDSRENCWTTVCAMPVAMEFHNAVEYKEKIYVLQGEFFLFYEPQKDYWGFLTPMTVPRIQGLAAVYKDSIYYIAGTCGNHQRMFTVEAYDIELNKWTRKKDFPCDQSINPYLKLVLFQNKLHLFVRATQVTVEEHVFRTSRKNSLYQYDDIADQWMKVYETPDRLWDLGRHFECAVAKLYPQCLQKVL

SEQ ID NO: 42774 - protein, 166 aa, Homo sapiens
  Payload ID: 8698
  Gene Symbol: KBTBD8
  Gene Name: kelch repeat and BTB (POZ) domain containing 8
  ENSP ID: ENSP00000417341
MFTSGLTESTQKEVRIVGVEAESMDLVLNYAYTSRVILTEANVQALFTAASIFQIPSIQDQCAKYMISHLDPQNSIGVFIFADHYGHQELGDRSKEYIRKKFLCVTKEQEFLQLTKDQLISILDSDDLNVDREEHVYESIIRWFEHEQNEREVHLPEIFAKCIRFP

SEQ ID NO: 42775 - protein, 146 aa, Homo sapiens
  Payload ID: 8698
  Gene Symbol: KBTBD8
  Gene Name: kelch repeat and BTB (POZ) domain containing 8
  ENSP ID: ENSP00000418075
MDPFHACSILKQLKTMYDEGQLTDIVVEVDHGKTFSCHRNVLAAISPYFRSMFTSGLTESTQKEVRIVGVEAESMDLVLNYAYTSRVILTEANVQALFTAASIFQIPSIQDQCAKYMISHLDPQNSIGVFIFADHYGHQELGDRSK

SEQ ID NO: 42776 - protein, 159 aa, Homo sapiens
  Payload ID: 8698
  Gene Symbol: KBTBD8
  Gene Name: kelch repeat and BTB (POZ) domain containing 8
  Uniprot ID: Q8NFY9
  ENSP ID: ENSP00000419738
MAASAGEFFLFYEPQKDYWGFLTPMTVPRIQGLAAVYKDSIYYIAGTCGNHQRMFTVEAYDIELNKWTRKKDFPCDQSINPYLKLVLFQNKLHLFVRATQVTVEEHVFRTSRKNSLYQYDDIADQWMKVYETPDRLWDLGRHFECAVAKLYPQCLQKVL

SEQ ID NO: 42777 - protein, 624 aa, Homo sapiens
  Payload ID: 8699
  Gene Symbol: KEAP1
  Gene Name: kelch-like ECH-associated protein 1
  Uniprot ID: Q14145
  ENSP ID: ENSP00000171111
MQPDPRPSGAGACCRFLPLQSQCPEGAGDAVMYASTECKAEVTPSQHGNRTFSYTLEDHTKQAFGIMNELRLSQQLCDVTLQVKYQDAPAAQFMAHKVVLASSSPVFKAMFTNGLREQGMEVVSIEGIHPKVMERLIEFAYTASISMGEKCVLHVMNGAVMYQIDSVVRACSDFLVQQLDPSNAIGIANFAEQIGCVELHQRAREYIYMHFGEVAKQEEFFNLSHCQLVTLISRDDLNVRCESEVFHACINWVKYDCEQRRFYVQALLRAVRCHSLTPNFLQMQLQKCEILQSDSRCKDYLVKIFEELTLHKPTQVMPCRAPKVGRLIYTAGGYFRQSLSYLEAYNPSDGTWLRLADLQVPRSGLAGCVVGGLLYAVGGRNNSPDGNTDSSALDCYNPMTNQWSPCAPMSVPRNRIGVGVIDGHIYAVGGSHGCIHHNSVERYEPERDEWHLVAPMLTRRIGVGVAVLNRLLYAVGGFDGTNRLNSAECYYPERNEWRMITAMNTIRSGAGVCVLHNCIYAAGGYDGQDQLNSVERYDVETETWTFVAPMKHRRSALGITVHQGRIYVLGGYDGHTFLDSVECYDPDTDTWSEVTRMTSGRSGVGVAVTMEPCRKQIDQQNCTC

SEQ ID NO: 42778 - protein, 624 aa, Homo sapiens; identical to SEQ ID NO: 42777
  Payload ID: 8699
  Gene Symbol: KEAP1
  Gene Name: kelch-like ECH-associated protein 1
  Uniprot ID: Q14145
  ENSP ID: ENSP00000377245

SEQ ID NO: 42779 - protein, 212 aa, Homo sapiens
  Payload ID: 8699
  Gene Symbol: KEAP1
  Gene Name: kelch-like ECH-associated protein 1
  ENSP ID: ENSP00000465024
MQPDPRPSGAGACCRFLPLQSQCPEGAGDAVMYASTECKAEVTPSQHGNRTFSYTLEDHTKQAFGIMNELRLSQQLCDVTLQVKYQDAPAAQFMAHKVVLASSSPVFKAMFTNGLREQGMEVVSIEGIHPKVMERLIEFAYTASISMGEKCVLHVMNGAVMYQIDSVVRACSDFLVQQLDPSNAIGIANFAEQIGCVELHQRAREYIYMHFG

SEQ ID NO: 42780 - protein, 213 aa, Homo sapiens
  Payload ID: 8699
  Gene Symbol: KEAP1
  Gene Name: kelch-like ECH-associated protein 1
  ENSP ID: ENSP00000465126
MQPDPRPSGAGACCRFLPLQSQCPEGAGDAVMYASTECKAEVTPSQHGNRTFSYTLEDHTKQAFGIMNELRLSQQLCDVTLQVKYQDAPAAQFMAHKVVLASSSPVFKAMFTNGLREQGMEVVSIEGIHPKVMERLIEFAYTASISMGEKCVLHVMNGAVMYQIDSVVRACSDFLVQQLDPSNAIGIANFAEQIGCVELHQRAREYIYMHFGE

SEQ ID NO: 42781 - protein, 129 aa, Homo sapiens
  Payload ID: 8699
  Gene Symbol: KEAP1
  Gene Name: kelch-like ECH-associated protein 1
  ENSP ID: ENSP00000466704
  MOD_RES (1)..(1): Any amino acid
XSRWWRAAPRGDIQQRNREMEGTVRRGAWLCAPARCPTPRRRAPGTCGKGGRIAAPFPPRPFRPLPASFSGVPRPLPNRQPRPRRPRSPGAEAPRRRRRPRVPYSQEVCPPRHERCCHVPDRQRCPCLQ

SEQ ID NO: 42782 - protein, 116 aa, Homo sapiens
  Payload ID: 8699
  Gene Symbol: KEAP1
  Gene Name: kelch-like ECH-associated protein 1
  ENSP ID: ENSP00000467601
  MOD_RES (1)..(1): Any amino acid
XLEAYNPSDGTWLRLADLQVPRSGLAGCVVGGLLYAVGGRNNSPDGNTDSSALDCYNPMTNQWSPCAPMSVPRNRIGVGVIDGHIYAVGGSHGCIHHNSVERRLRPAQLYLCCWGL

SEQ ID NO: 42783 - protein, 172 aa, Homo sapiens
  Payload ID: 8699
  Gene Symbol: KEAP1
  Gene Name: kelch-like ECH-associated protein 1
  ENSP ID: ENSP00000468014
  MOD_RES (1)..(1): Any amino acid
XCYNPMTNQWSPCAPMSVPRNRIGVGVIDGHIYAVGGSHGCIHHNSVERYEPERDEWHLVAPMLTRRIGVGVAVLNRLLYAVGGFDGTNRLNSAECYYPERNEWRMITAMNTIRSGAGGYDGHTFLDSVECYDPDTDTWSEVTRMTSGRSGVGVAVTMEPCRKQIDQQNCTC

SEQ ID NO: 42784 - protein, 279 aa, Homo sapiens
  Payload ID: 8699
  Gene Symbol: KEAP1
  Gene Name: kelch-like ECH-associated protein 1
  ENSP ID: ENSP00000468671
MQPDPRPSGAGACCRFLPLQSQCPEGAGDAVMYASTECKAEVTPSQHGNRTFSYTLEDHTKQAFGIMNELRLSQQLCDVTLQVKYQDAPAAQFMAHKVVLASSSPVFKAMFTNGLREQGMEVVSIEGIHPKVMERLIEFAYTASISMGEKCVLHVMNGAVMYQIDSVVRACSDFLVQQLDPSNAIGIANFAEQIGCVELHQRAREYIYMHFGEVAKQEEFFNLSHCQLVTLISRDDLNVRCESEVFHACINWVKYDCEQRRFYVQALLRAVRCHSLTPN

SEQ ID NO: 42785 - protein, 748 aa, Homo sapiens
  Payload ID: 8700
  Gene Symbol: KLHL1
  Gene Name: kelch-like family member 1
  Uniprot ID: Q9NR64
  ENSP ID: ENSP00000367075
MSGSGRKDFDVKHILRLRWKLFSHPSPSTGGPAGGGCLQQDGSGSFEHWGPSQSRLLKSQERSGVSTFWKKPSSSSSSSSSPSSSSSSFNPLNGTLLPVATRLQQGAPGQGTQQPARTLFYVESLEEEVVPGMDFPGPHEKGLVLQELKVEPDNSSQATGEGCGHRLSSTGHSMTPQSDLDSSSSEEFYQAVHHAEQTFRKMESYLKQQQLCDVILIVGNRKIPAHRLVLSSVSDYFAAMFTSDVCEAKQEEIKMEGIDPNALWDLVQFAYTGCLELKEDTIENLLAAACLLQLPQVVEVCCHFLMKLLHPSNCLGIRAFADAQGCIELMKVAHSYTMENIMEVIRNQEFLLLPAEELHKLLASDDVNVPDEETIFHALMMWVKYDMQSRCNDLSMLLAFIRLPLLPPQILADLENHALFKNDLECQKLILEAMKYHLLPERRTLMQSPRTKPRKSTVGTLYAVGGMDNNKGATTIEKYDLRTNLWIQAGMMNGRRLQFGVAVIDDKLFVIGGRDGLKTLNTVECYNPKTKTWTVLPPMSTHRHGLGVTVLEGPIYAVGGHDGWSYLNTVERWDPQSQQWTFVASMSIARSTVGVAALNGKLYSVGGRDGSSCLSSMEYYDPHTNKWNMCAPMCKRRGGVGVATCDGFLYAVGGHDAPASNHCSRLLDYVERYDPKTDTWTMVAPLSMPRDAVGVCLLGDRLYAVGGYDGQTYLNTMESYDPQTNEWTQMASLNIGRAGACVVVIKQP

SEQ ID NO: 42786 - protein, 687 aa, Homo sapiens
  Payload ID: 8700
  Gene Symbol: KLHL1
  Gene Name: kelch-like family member 1
  ENSP ID: ENSP00000439602
MSGSGRKDFDVKHILRLRWKLFSHPSPSTGGPAGGGCLQQDGSGSFEHWGPSQSRLLKSQERSGVSTFWKKPSSSSSSSSSPSSSSSSFNPLNGTLLPVATRLQQGAPGQGTQQPARTLFYVESLEEEVVPGMDFPGPHEKGLVLQELKVEPDNSSQATGEGCGHRLVLSSVSDYFAAMFTSDVCEAKQEEIKMEGIDPNALWDLVQFAYTGCLELKEDTIENLLAAACLLQLPQVVEVCCHFLMKLLHPSNCLGIRAFADAQGCIELMKVAHSYTMENIMEVIRNQEFLLLPAEELHKLLASDDVNVPDEETIFHALMMWVKYDMQSRCNDLSMLLAFIRLPLLPPQILADLENHALFKNDLECQKLILEAMKYHLLPERRTLMQSPRTKPRKSTVGTLYAVGGMDNNKGATTIEKYDLRTNLWIQAGMMNGRRLQFGVAVIDDKLFVIGGRDGLKTLNTVECYNPKTKTWTVLPPMSTHRHGLGVTVLEGPIYAVGGHDGWSYLNTVERWDPQSQQWTFVASMSIARSTVGVAALNGKLYSVGGRDGSSCLSSMEYYDPHTNKWNMCAPMCKRRGGVGVATCDGFLYAVGGHDAPASNHCSRLLDYVERYDPKTDTWTMVAPLSMPRDAVGVCLLGDRLYAVGGYDGQTYLNTMESYDPQTNEWTQMASLNIGRAGACVVVIKQP

SEQ ID NO: 42787 - protein, 608 aa, Homo sapiens
  Payload ID: 8701
  Gene Symbol: KLHL10
  Gene Name: kelch-like family member 10
  Uniprot ID: Q6JEL2
  ENSP ID: ENSP00000293303
MEMESAAASTRFHQPHMERKMSAMACEIFNELRLEGKLCDVVIKVNGFEFSAHKNILCSCSSYFRALFTSGWNNTEKKVYNIPGISPDMMKLIIEYAYTRTVPITPDNVEKLLAAADQFNIMGIVRGCCEFLKSELCLDNCIGICKFTDYYYCPELRQKAYMFILHNFEEMVKVSAEFLELSVTELKDIIEKDELNVKQEDAVFEAILKWISHDPQNRKQHISILLPKVRLALMHAEYFMNNVKMNDYVKDSEECKPVIINALKAMYDLNMNGPSNSDFTNPLTRPRLPYAILFAIGGWSGGSPTNAIEAYDARADRWVNVTCEEESPRAYHGAAYLKGYVYIIGGFDSVDYFNSVKRFDPVKKTWHQVAPMHSRRCYVSVTVLGNFIYAMGGFDGYVRLNTAERYEPETNQWTLIAPMHEQRSDASATTLYGKVYICGGFNGNECLFTAEVYNTESNQWTVIAPMRSRRSGIGVIAYGEHVYAVGGFDGANRLRSAEAYSPVANTWRTIPTMFNPRSNFGIEVVDDLLFVVGGFNGFTTTFNVECYDEKTDEWYDAHDMSIYRSALSCCVVPGLANVEEYAARRDNFPGLALRDEVKYSASTSTLPV

SEQ ID NO: 42788 - protein, 122 aa, Homo sapiens
  Payload ID: 8701
  Gene Symbol: KLHL10
  Gene Name: kelch-like family member 10
  ENSP ID: ENSP00000391983
MEMESAAASTRFHQPHMERKMSAMACEIFNELRLEGKLCDVVIKVNGFEFSAHKNILCSCSSYFRALFTSGWNNTEKKVYNIPGISPDMMKLIIEYAYTRTVPITPDNVEKLLAAADQFNIM

SEQ ID NO: 42789 - protein, 152 aa, Homo sapiens
  Payload ID: 8701
  Gene Symbol: KLHL10
  Gene Name: kelch-like family member 10
  ENSP ID: ENSP00000416221
MEMESAAASTRFHQPHMERKMSAMACEIFNELRLEGKLCDVVIKERNVSVAASFFLFSRALFTSGWNNTEKKVYNIPGISPDMMKLIIEYAYTRTVPITPDNVEKLLAAADQFNIMGIVRGCCEFLKSELCLDNCIGICKFTDYYYCPELRQ

SEQ ID NO: 42790 - protein, 708 aa, Homo sapiens
  Payload ID: 8702
  Gene Symbol: KLHL11
  Gene Name: kelch-like family member 11
  Uniprot ID: Q9NVR0
  ENSP ID: ENSP00000314608
MAAAAVAAAAAAAAAASLQVLEMESMETAAAGSAGLAAEVRGSGTVDFGPGPGISAMEASGGDPGPEAEDFECSSHCSELSWRQNEQRRQGLFCDITLCFGGAGGREFRAHRSVLAAATEYFTPLLSGQFSESRSGRVEMRKWSSEPGPEPDTVEAVIEYMYTGRIRVSTGSVHEVLELADRFLLIRLKEFCGEFLKKKLHLSNCVAIHSLAHMYTLSQLALKAADMIRRNFHKVIQDEEFYTLPFHLIRDWLSDLEITVDSEEVLFETVLKWVQRNAEERERYFEELFKLLRLSQMKPTYLTRHVKPERLVANNEVCVKLVADAVERHALRAENIQSGTCQHPTSHVSLLPRYGQNMDVIMVIGGVSEGGDYLSECVGYFVDEDRWVNLPHIHNHLDGHAVAVTESYVYVAGSMEPGFAKTVERYNPNLNTWEHVCSLMTRKHSFGLTEVKGKLYSIGGHGNFSPGFKDVTVYNPELDKWHNLESAPKILRDVKALAIEDRFVYIAARTPVDRDTEDGLKAVITCYDTETRQWQDVESLPLIDNYCFFQMSVVNSNFYQTASCCPKSYCLENEEAVRKIASQVSDEILESLPPEVLSIEGAAICYYKDDVFIIGGWKNSDDIDKQYRKEAYRYCAERKRWMLLPPMPQPRCRATACHVRIPYRYLHGTQRYPMPQNLMWQKDRIRQMQEIHRHALNMRRVPSSQIEC

SEQ ID NO: 42791 - protein, 315 aa, Homo sapiens
  Payload ID: 8703
  Gene Symbol: KLHL12
  Gene Name: kelch-like family member 12
  ENSP ID: ENSP00000356227
MDVNKFEASVGFLDVKKFLSTWKLQNPRTHFVLSPHCFMGGIMAPKDIMTNTHAKSILNSMNSLRKSNTLCDVTLRVEQKDFPAHRIVLAACSDYFCAMFTSELSEKGKPYVDIQGLTASTMEILLDFVYTETVHVTVENVQELLPAACLLQLKGVKQACCEFLESQLDPSNCLGIRDFAETHNCVDLMQAAEVFSQKHFPEVVQHEEFILLSQGEVEKLIKCDEIQVDSEEPVFEAVINWVKHAKKEREESLPNLLQYVRMPLLTPRYITDVIDAEPFIRCSLQCRDLVDEAKKFHLRPELRSQMQGPRTRARL

SEQ ID NO: 42792 - protein, 204 aa, Homo sapiens
  Payload ID: 8703
  Gene Symbol: KLHL12
  Gene Name: kelch-like family member 12
  ENSP ID: ENSP00000356228
MQGPRTRARLGANEVLLVVGGFGSQQSPIDVVEKYDPKTQEWSFLPSITRKRRYVASVSLHDRIYVIGGYDGRSRLSSVECLDYTADEDGVWYSVAPMNVRRGLAGATTLGDMIYVSGGFDGSRRHTSMERYDPNIDQWSMLGDMQTAREGAGLVVASGVIYCLGGYDGLNILNSVEKYDPHTGHWTNVTPMATKRSDMMVIPC

SEQ ID NO: 42793 - protein, 568 aa, Homo sapiens
  Payload ID: 8703
  Gene Symbol: KLHL12
  Gene Name: kelch-like family member 12
  Uniprot ID: Q53G59
  ENSP ID: ENSP00000356230
MGGIMAPKDIMTNTHAKSILNSMNSLRKSNTLCDVTLRVEQKDFPAHRIVLAACSDYFCAMFTSELSEKGKPYVDIQGLTASTMEILLDFVYTETVHVTVENVQELLPAACLLQLKGVKQACCEFLESQLDPSNCLGIRDFAETHNCVDLMQAAEVFSQKHFPEVVQHEEFILLSQGEVEKLIKCDEIQVDSEEPVFEAVINWVKHAKKEREESLPNLLQYVRMPLLTPRYITDVIDAEPFIRCSLQCRDLVDEAKKFHLRPELRSQMQGPRTRARLGANEVLLVVGGFGSQQSPIDVVEKYDPKTQEWSFLPSITRKRRYVASVSLHDRIYVIGGYDGRSRLSSVECLDYTADEDGVWYSVAPMNVRRGLAGATTLGDMIYVSGGFDGSRRHTSMERYDPNIDQWSMLGDMQTAREGAGLVVASGVIYCLGGYDGLNILNSVEKYDPHTGHWTNVTPMATKRSGAGVALLNDHIYVVGGFDGTAHLSSVEAYNIRTDSWTTVTSMTTPRCYVGATVLRGRLYAIAGYDGNSLLSSIECYDPIIDSWEVVTSMGTQRCDAGVCVLREK

SEQ ID NO: 42794 - protein, 655 aa, Homo sapiens
  Payload ID: 8704
  Gene Symbol: KLHL13
  Gene Name: kelch-like family member 13
  Uniprot ID: Q9P2N7
  ENSP ID: ENSP00000262820
MPLKWKTSSPAIWKFPVPVLKTSRSTPLSPAYISLVEEEDQHMKLSLGGSEMGLSSHLQSSKAGPTRIFTSNTHSSVVLQGFDQLRLEGLLCDVTLMPGDTDDAFPVHRVMMASASDYFKAMFTGGMKEQDLMCIKLHGVSKVGLRKIIDFIYTAKLSLNMDNLQDTLEAASFLQILPVLDFCKVFLISGVTLDNCVEVGRIANTYNLTEVDKYVNSFVLKNFPALLSTGEFLKLPFERLAFVLSSNSLKHCTELELFKATCRWLRLEEPRMDFAAKLMKNIRFPLMTPQELINYVQTVDFMRTDNTCVNLLLEASNYQMMPYMQPVMQSDRTAIRSDTTHLVTLGGVLRQQLVVSKELRMYDEKAHEWKSLAPMDAPRYQHGIAVIGNFLYVVGGQSNYDTKGKTAVDTVFRFDPRYNKWMQVASLNEKRTFFHLSALKGYLYAVGGRNAAGELPTVECYNPRTNEWTYVAKMSEPHYGHAGTVYGGVMYISGGITHDTFQKELMCFDPDTDKWIQKAPMTTVRGLHCMCTVGERLYVIGGNHFRGTSDYDDVLSCEYYSPILDQWTPIAAMLRGQSDVGVAVFENKIYVVGGYSWNNRCMVEIVQKYDPDKDEWHKVFDLPESLGGIRACTLTVFPPEETTPSPSRESPLSAP

SEQ ID NO: 42795 - protein, 604 aa, Homo sapiens
  Payload ID: 8704
  Gene Symbol: KLHL13
  Gene Name: kelch-like family member 13
  ENSP ID: ENSP00000360943
MGLSSHLQSSKAGPTRIFTSNTHSSVVLQGFDQLRLEGLLCDVTLMPGDTDDAFPVHRVMMASASDYFKAMFTGGMKEQDLMCIKLHGVSKVGLRKIIDFIYTAKLSLNMDNLQDTLEAASFLQILPVLDFCKVFLISGVTLDNCVEVGRIANTYNLTEVDKYVNSFVLKNFPALLSTGEFLKLPFERLAFVLSSNSLKHCTELELFKATCRWLRLEEPRMDFAAKLMKNIRFPLMTPQELINYVQTVDFMRTDNTCVNLLLEASNYQMMPYMQPVMQSDRTAIRSDTTHLVTLGGVLRQQLVVSKELRMYDEKAHEWKSLAPMDAPRYQHGIAVIGNFLYVVGGQSNYDTKGKTAVDTVFRFDPRYNKWMQVASLNEKRTFFHLSALKGYLYAVGGRNAAGELPTVECYNPRTNEWTYVAKMSEPHYGHAGTVYGGVMYISGGITHDTFQKELMCFDPDTDKWIQKAPMTTVRGLHCMCTVGERLYVIGGNHFRGTSDYDDVLSCEYYSPILDQWTPIAAMLRGQSDVGVAVFENKIYVVGGYSWNNRCMVEIVQKYDPDKDEWHKVFDLPESLGGIRACTLTVFPPEETTPSPSRESPLSAP

SEQ ID NO: 42796 - protein, 604 aa, Homo sapiens; identical to SEQ ID NO: 42795
  Payload ID: 8704
  Gene Symbol: KLHL13
  Gene Name: kelch-like family member 13
  ENSP ID: ENSP00000360945

SEQ ID NO: 42797 - protein, 604 aa, Homo sapiens; identical to SEQ ID NO: 42795
  Payload ID: 8704
  Gene Symbol: KLHL13
  Gene Name: kelch-like family member 13
  ENSP ID: ENSP00000360949

SEQ ID NO: 42798 - protein, 37 aa, Homo sapiens
  Payload ID: 8704
  Gene Symbol: KLHL13
  Gene Name: kelch-like family member 13
  ENSP ID: ENSP00000393807
MGLSSHLQSSKAGPTRIFTSNTHSSVVLQGFDQLRLE

SEQ ID NO: 42799 - protein, 604 aa, Homo sapiens; identical to SEQ ID NO: 42795
  Payload ID: 8704
  Gene Symbol: KLHL13
  Gene Name: kelch-like family member 13
  ENSP ID: ENSP00000412640

SEQ ID NO: 42800 - protein, 604 aa, Homo sapiens; identical to SEQ ID NO: 42795
  Payload ID: 8704
  Gene Symbol: KLHL13
  Gene Name: kelch-like family member 13
  ENSP ID: ENSP00000419803

SEQ ID NO: 42801 - protein, 613 aa, Homo sapiens
  Payload ID: 8704
  Gene Symbol: KLHL13
  Gene Name: kelch-like family member 13
  Uniprot ID: Q9P2N7
  ENSP ID: ENSP00000440707
MKLSLGGSEMGLSSHLQSSKAGPTRIFTSNTHSSVVLQGFDQLRLEGLLCDVTLMPGDTDDAFPVHRVMMASASDYFKAMFTGGMKEQDLMCIKLHGVSKVGLRKIIDFIYTAKLSLNMDNLQDTLEAASFLQILPVLDFCKVFLISGVTLDNCVEVGRIANTYNLTEVDKYVNSFVLKNFPALLSTGEFLKLPFERLAFVLSSNSLKHCTELELFKATCRWLRLEEPRMDFAAKLMKNIRFPLMTPQELINYVQTVDFMRTDNTCVNLLLEASNYQMMPYMQPVMQSDRTAIRSDTTHLVTLGGVLRQQLVVSKELRMYDEKAHEWKSLAPMDAPRYQHGIAVIGNFLYVVGGQSNYDTKGKTAVDTVFRFDPRYNKWMQVASLNEKRTFFHLSALKGYLYAVGGRNAAGELPTVECYNPRTNEWTYVAKMSEPHYGHAGTVYGGVMYISGGITHDTFQKELMCFDPDTDKWIQKAPMTTVRGLHCMCTVGERLYVIGGNHFRGTSDYDDVLSCEYYSPILDQWTPIAAMLRGQSDVGVAVFENKIYVVGGYSWNNRCMVEIVQKYDPDKDEWHKVFDLPESLGGIRACTLTVFPPEETTPSPSRESPLSAP

SEQ ID NO: 42802 - protein, 639 aa, Homo sapiens
  Payload ID: 8704
  Gene Symbol: KLHL13
  Gene Name: kelch-like family member 13
  Uniprot ID: Q9P2N7
  ENSP ID: ENSP00000441029
MDHLHRGELVAAILRNRSLVEEEDQHMKLSLGGSEMGLSSHLQSSKAGPTRIFTSNTHSSVVLQGFDQLRLEGLLCDVTLMPGDTDDAFPVHRVMMASASDYFKAMFTGGMKEQDLMCIKLHGVSKVGLRKIIDFIYTAKLSLNMDNLQDTLEAASFLQILPVLDFCKVFLISGVTLDNCVEVGRIANTYNLTEVDKYVNSFVLKNFPALLSTGEFLKLPFERLAFVLSSNSLKHCTELELFKATCRWLRLEEPRMDFAAKLMKNIRFPLMTPQELINYVQTVDFMRTDNTCVNLLLEASNYQMMPYMQPVMQSDRTAIRSDTTHLVTLGGVLRQQLVVSKELRMYDEKAHEWKSLAPMDAPRYQHGIAVIGNFLYVVGGQSNYDTKGKTAVDTVFRFDPRYNKWMQVASLNEKRTFFHLSALKGYLYAVGGRNAAGELPTVECYNPRTNEWTYVAKMSEPHYGHAGTVYGGVMYISGGITHDTFQKELMCFDPDTDKWIQKAPMTTVRGLHCMCTVGERLYVIGGNHFRGTSDYDDVLSCEYYSPILDQWTPIAAMLRGQSDVGVAVFENKIYVVGGYSWNNRCMVEIVQKYDPDKDEWHKVFDLPESLGGIRACTLTVFPPEETTPSPSRESPLSAP

SEQ ID NO: 42803 - protein, 658 aa, Homo sapiens
  Payload ID: 8704
  Gene Symbol: KLHL13
  Gene Name: kelch-like family member 13
  Uniprot ID: Q9P2N7
  ENSP ID: ENSP00000443191
MMRVQTLREKWAYWRRRQLSLKQADFKDIFKKSTSGSLVEEEDQHMKLSLGGSEMGLSSHLQSSKAGPTRIFTSNTHSSVVLQGFDQLRLEGLLCDVTLMPGDTDDAFPVHRVMMASASDYFKAMFTGGMKEQDLMCIKLHGVSKVGLRKIIDFIYTAKLSLNMDNLQDTLEAASFLQILPVLDFCKVFLISGVTLDNCVEVGRIANTYNLTEVDKYVNSFVLKNFPALLSTGEFLKLPFERLAFVLSSNSLKHCTELELFKATCRWLRLEEPRMDFAAKLMKNIRFPLMTPQELINYVQTVDFMRTDNTCVNLLLEASNYQMMPYMQPVMQSDRTAIRSDTTHLVTLGGVLRQQLVVSKELRMYDEKAHEWKSLAPMDAPRYQHGIAVIGNFLYVVGGQSNYDTKGKTAVDTVFRFDPRYNKWMQVASLNEKRTFFHLSALKGYLYAVGGRNAAGELPTVECYNPRTNEWTYVAKMSEPHYGHAGTVYGGVMYISGGITHDTFQKELMCFDPDTDKWIQKAPMTTVRGLHCMCTVGERLYVIGGNHFRGTSDYDDVLSCEYYSPILDQWTPIAAMLRGQSDVGVAVFENKIYVVGGYSWNNRCMVEIVQKYDPDKDEWHKVFDLPESLGGIRACTLTVFPPEETTPSPSRESPLSAP

SEQ ID NO: 42804 - protein, 639 aa, Homo sapiens; identical to SEQ ID NO: 42802
  Payload ID: 8704
  Gene Symbol: KLHL13
  Gene Name: kelch-like family member 13
  Uniprot ID: Q9P2N7
  ENSP ID: ENSP00000444450

SEQ ID NO: 42805 - protein, 388 aa, Homo sapiens
  Payload ID: 8705
  Gene Symbol: KLHL14
  Gene Name: kelch-like family member 14
  Uniprot ID: Q9P2G3
  ENSP ID: ENSP00000350808
MSRSGDRTSTFDPSHSDNLLHGLNLLWRKQLFCDVTLTAQGQQFHCHKAVLASCSQYFRSLFSSHPPLGGGVGGQDGLGAPKDQQQPPQQQPSQQQQPPPQEEPGTPSSSPDDKLLTSPRAINNLVLQGCSSIGLRLVLEYLYTANVTLSLDTVEEVLSVSKILHIPQVTKLCVQFLNDQISVQNYKQVCKIAALHGLEETKKLANKYLVEDVLLLNFEEMRALLDSLPPPVESELALFQMSVLWLEHDRETRMQYAPDLMKRLRFALIPAPELVERVQSVDFMRTDPVCQKLLLDAMNYHLMPFRQHCRQSLASRIRSNKKMLLLVGGLPPGPDRLPSNLVQYYDDEKKTWKILTITGPHPISGKQESASSPEFRRRKTREFSNNTM

SEQ ID NO: 42806 - protein, 628 aa, Homo sapiens
  Payload ID: 8705
  Gene Symbol: KLHL14
  Gene Name: kelch-like family member 14
  Uniprot ID: Q9P2G3
  ENSP ID: ENSP00000352314
MSRSGDRTSTFDPSHSDNLLHGLNLLWRKQLFCDVTLTAQGQQFHCHKAVLASCSQYFRSLFSSHPPLGGGVGGQDGLGAPKDQQQPPQQQPSQQQQPPPQEEPGTPSSSPDDKLLTSPRAINNLVLQGCSSIGLRLVLEYLYTANVTLSLDTVEEVLSVSKILHIPQVTKLCVQFLNDQISVQNYKQVCKIAALHGLEETKKLANKYLVEDVLLLNFEEMRALLDSLPPPVESELALFQMSVLWLEHDRETRMQYAPDLMKRLRFALIPAPELVERVQSVDFMRTDPVCQKLLLDAMNYHLMPFRQHCRQSLASRIRSNKKMLLLVGGLPPGPDRLPSNLVQYYDDEKKTWKILTIMPYNSAHHCVVEVENFLFVLGGEDQWNPNGKHSTNFVSRYDPRFNSWIQLPPMQERRASFYACRLDKHLYVIGGRNETGYLSSVECYNLETNEWRYVSSLPQPLAAHAGAVHNGKIYISGGVHNGEYVPWLYCYDPVMDVWARKQDMNTKRAIHTLAVMNDRLYAIGGNHLKGFSHLDVMLVECYDPKGDQWNILQTPILEGRSGPGCAVLDDSIYLVGGYSWSMGAYKSSTICYCPEKGTWTELEGDVAEPLAGPACVTVILPSCVPYNK

SEQ ID NO: 42807 - protein, 227 aa, Homo sapiens
  Payload ID: 8705
  Gene Symbol: KLHL14
  Gene Name: kelch-like family member 14
  ENSP ID: ENSP00000463803
MQAEGPFLLSPGRLEEGLKPGAPSQLAMSRSGDRTSTFDPSHSDNLLHGLNLLWRKQLFCDVTLTAQGQQFHCHKAVLASCSQYFRSLFSSHPPLGGGVGGQDGLGAPKDQQQPPQQQPSQQQQPPPQEEPGTPSSSPDDKLLTSPRAINNLVLQGCSSIGLRLVLEYLYTANVTLSLDTVEEVLSVSKILHIPQVTKLCVQFLNDQISVQNYKQVCKIAALHGLEE

SEQ ID NO: 42808 - protein, 604 aa, Homo sapiens
  Payload ID: 8706
  Gene Symbol: KLHL15
  Gene Name: kelch-like family member 15
  Uniprot ID: Q96M94
  ENSP ID: ENSP00000332791
MAGDVEGFCSSIHDTSVSAGFRALYEEGLLLDVTLVIEDHQFQAHKALLATQSDYFRIMFTADMRERDQDKIHLKGLTATGFSHVLQFMYYGTIELSMNTVHEILQAAMYVQLIEVVKFCCSFLLAKICLENCAEIMRLLDDFGVNIEGVREKLDTFLLDNFVPLMSRPDFLSYLSFEKLMSYLDNDHLSRFPEIELYEAVQSWLRHDRRRWRHTDTIIQNIRFCLMTPTSVFEKVKTSEFYRYSRQLRYEVDQALNYFQNVHQQPLLDMKSSRIRSAKPQTTVFRGMIGHSMVNSKILLLKKPRVWWELEGPQVPLRPDCLAIVNNFVFLLGGEELGPDGEFHASSKVFRYDPRQNSWLQMADMSVPRSEFAVGVIGKFIYAVAGRTRDETFYSTERYDITNDKWEFVDPYPVNKYGHEGTVLNNKLFITGGITSSSTSKQVCVFDPSKEGTIEQRTRRTQVVTNCWENKSKMNYARCFHKMISYNGKLYVFGGVCVILRASFESQGCPSTEVYNPETDQWTILASMPIGRSGHGVTVLDKQIMVLGGLCYNGHYSDSILTFDPDENKWKEDEYPRMPCKLDGLQVCNLHFPDYVLDEVRRCN

SEQ ID NO: 42809 - protein, 642 aa, Homo sapiens
  Payload ID: 8707
  Gene Symbol: KLHL17
  Gene Name: kelch-like family member 17
  Uniprot ID: Q6TDP4
  ENSP ID: ENSP00000343930
MQPRSERPAGRTQSPEHGSPGPGPEAPPPPPPQPPAPEAERTRPRQARPAAPMEGAVQLLSREGHSVAHNSKRHYHDAFVAMSRMRQRGLLCDIVLHVAAKEIRAHKVVLASCSPYFHAMFTNEMSESRQTHVTLHDIDPQALDQLVQFAYTAEIVVGEGNVQTLLPAASLLQLNGVRDACCKFLLSQLDPSNCLGIRGFADAHSCSDLLKAAHRYVLQHFVDVAKTEEFMLLPLKQVLELVSSDSLNVPSEEEVYRAVLSWVKHDVDARRQHVPRLMKCVRLPLLSRDFLLGHVDAESLVRHHPDCKDLLIEALKFHLLPEQRGVLGTSRTRPRRCEGAGPVLFAVGGGSLFAIHGDCEAYDTRTDRWHVVASMSTRRARVGVAAVGNRLYAVGGYDGTSDLATVESYDPVTNTWQPEVSMGTRRSCLGVAALHGLLYSAGGYDGASCLNSAERYDPLTGTWTSVAAMSTRRRYVRVATLDGNLYAVGGYDSSSHLATVEKYEPQVNVWSPVASMLSRRSSAGVAVLEGALYVAGGNDGTSCLNSVERYSPKAGAWESVAPMNIRRSTHDLVAMDGWLYAVGGNDGSSSLNSIEKYNPRTNKWVAASCMFTRRSSVGVAVLELLNFPPPSSPTLSVSSTSL

SEQ ID NO: 42810 - protein, 154 aa, Homo sapiens
  Payload ID: 8707
  Gene Symbol: KLHL17
  Gene Name: kelch-like family member 17
  ENSP ID: ENSP00000463694
  MOD_RES (1)..(1): Any amino acid
XLLSRDFLLGHVDAESLVRHHPDCKDLLIEALKFHLLPEQRGVLGTSRTRPRRCEGAGPVLFAVGASPGAWGVAQQWDPLTSPVSTCPPQAAGACLPSTETVRPTTRAPTAGTWWPPCPRAGPGWEWLRWGTGSMLWAAMMGPQTWLPWSPTTP

SEQ ID NO: 42811 - protein, 225 aa, Homo sapiens
  Payload ID: 8707
  Gene Symbol: KLHL17
  Gene Name: kelch-like family member 17
  ENSP ID: ENSP00000479477
MKCVRLPLLSRDFLLGHVDAESLVRHHPDCKDLLIEALKFHLLPEQRGVLGTSRTRPRRCEGAGPVLFAVGGGSLFAIHGDCEAYDTRTDRWHVVASMSTRRARVGVAAVGNRLYAVGGYDGTSDLATVESYDPVTNTWQPEVSMGTRRSCLGVAALHGLLYSAGGYDGASCLNSAERYDPLTGTWTSVAAMSTRRRYVRVATLDGNLYAVGGYDSSSHLATVEK

SEQ ID NO: 42812 - protein, 574 aa, Homo sapiens
  Payload ID: 8708
  Gene Symbol: KLHL18
  Gene Name: kelch-like family member 18
  Uniprot ID: O94889
  ENSP ID: ENSP00000232766
MVEDGAEELEDLVHFSVSELPSRGYGVMEEIRRQGKLCDVTLKIGDHKFSAHRIVLAASIPYFHAMFTNDMMECKQDEIVMQGMDPSALEALINFAYNGNLAIDQQNVQSLLMGASFLQLQSIKDACCTFLRERLHPKNCLGVRQFAETMMCAVLYDAANSFIHQHFVEVSMSEEFLALPLEDVLELVSRDELNVKSEEQVFEAALAWVRYDREQRGPYLPELLSNIRLPLCRPQFLSDRVQQDDLVRCCHKCRDLVDEAKDYHLMPERRPHLPAFRTRPRCCTSIAGLIYAVGGLNSAGDSLNVVEVFDPIANCWERCRPMTTARSRVGVAVVNGLLYAIGGYDGQLRLSTVEAYNPETDTWTRVGSMNSKRSAMGTVVLDGQIYVCGGYDGNSSLSSVETYSPETDKWTVVTSMSSNRSAAGVTVFEGRIYVSGGHDGLQIFSSVEHYNHHTATWHPAAGMLNKRCRHGAASLGSKMFVCGGYDGSGFLSIAEMYSSVADQWCLIVPMHTRRSRVSLVASCGRLYAVGGYDGQSNLSSVEMYDPETDCWTFMAPMACHEGGVGVGCIPLLTI

SEQ ID NO: 42813 - protein, 59 aa, Homo sapiens
  Payload ID: 8708
  Gene Symbol: KLHL18
  Gene Name: kelch-like family member 18
  ENSP ID: ENSP00000392507
MVEDGAEELEDLVHFSVSELPSRGYGVMEEIRRQGKLCDVTLKCPGGSDQLCLQRQPCH

SEQ ID NO: 42814 - protein, 63 aa, Homo sapiens
  Payload ID: 8708
  Gene Symbol: KLHL18
  Gene Name: kelch-like family member 18
  ENSP ID: ENSP00000407114
MVEDGAEELEDLVHFSVSELPSRGYGVMEEIRRQGKLCDVTLKPTEFSDEMRRSCFSTFELPL

SEQ ID NO: 42815 - protein, 147 aa, Homo sapiens
  Payload ID: 8708
  Gene Symbol: KLHL18
  Gene Name: kelch-like family member 18
  ENSP ID: ENSP00000411839
MVEDGAEELEDLVHFSVSELPSRGYGVMEEIRRQGKLCDVTLKIGDHKFSAHRIVLAASIPYFHAMFTNDMMECKQDEIVMQGMDPSALEALINFAYNGNLAIDQQNVQSLLMGASFLQLQSIKDACCTFLRERLHPKNCLGVRQFA

SEQ ID NO: 42816 - protein, 593 aa, Homo sapiens
  Payload ID: 8709
  Gene Symbol: KLHL2
  Gene Name: kelch-like family member 2
  Uniprot ID: O95198
  ENSP ID: ENSP00000226725
METPPLPPACTKQGHQKPLDSKDDNTEKHCPVTVNPWHMKKAFKVMNELRSQNLLCDVTIVAEDMEISAHRVVLAACSPYFHAMFTGEMSESRAKRVRIKEVDGWTLRMLIDYVYTAEIQVTEENVQVLLPAAGLLQLQDVKKTCCEFLESQLHPVNCLGIRAFADMHACTDLLNKANTYAEQHFADVVLSEEFLNLGIEQVCSLISSDKLTISSEEKVFEAVIAWVNHDKDVRQEFMARLMEHVRLPLLPREYLVQRVEEEALVKNSSACKDYLIEAMKYHLLPTEQRILMKSVRTRLRTPMNLPKLMVVVGGQAPKAIRSVECYDFKEERWHQVAELPSRRCRAGMVYMAGLVFAVGGFNGSLRVRTVDSYDPVKDQWTSVANMRDRRSTLGAAVLNGLLYAVGGFDGSTGLSSVEAYNIKSNEWFHVAPMNTRRSSVGVGVVGGLLYAVGGYDGASRQCLSTVECYNATTNEWTYIAEMSTRRSGAGVGVLNNLLYAVGGHDGPLVRKSVEVYDPTTNAWRQVADMNMCRRNAGVCAVNGLLYVVGGDDGSCNLASVEYYNPTTDKWTVVSSCMSTGRSYAGVTVIDKPL

SEQ ID NO: 42817 - protein, 496 aa, Homo sapiens
  Payload ID: 8709
  Gene Symbol: KLHL2
  Gene Name: kelch-like family member 2
  ENSP ID: ENSP00000408974
MSQLWQKTWKFLLIEWCWPPVVLIFMPCLQVLLPAAGLLQLQDVKKTCCEFLESQLHPVNCLGIRAFADMHACTDLLNKANTYAEQHFADVVLSEEFLNLGIEQVCSLISSDKLTISSEEKVFEAVIAWVNHDKDVRQEFMARLMEHVRLPLLPREYLVQRVEEEALVKNSSACKDYLIEAMKYHLLPTEQRILMKSVRTRLRTPMNLPKLMVVVGGQAPKAIRSVECYDFKEERWHQVAELPSRRCRAGMVYMAGLVFAVGGFNGSLRVRTVDSYDPVKDQWTSVANMRDRRSTLGAAVLNGLLYAVGGFDGSTGLSSVEAYNIKSNEWFHVAPMNTRRSSVGVGVVGGLLYAVGGYDGASRQCLSTVECYNATTNEWTYIAEMSTRRSGAGVGVLNNLLYAVGGHDGPLVRKSVEVYDPTTNAWRQVADMNMCRRNAGVCAVNGLLYVVGGDDGSCNLASVEYYNPTTDKWTVVSSCMSTGRSYAGVTVIDKPL

SEQ ID NO: 42818 - protein, 117 aa, Homo sapiens
  Payload ID: 8709
  Gene Symbol: KLHL2
  Gene Name: kelch-like family member 2
  ENSP ID: ENSP00000421324
MKKAFKVMNELRSQNLLCDVTIVAEDMEISAHRVVLAACSPYFHAMFTGEMSESRAKRVRIKEVDGWTLRMLIDYVYTAEIQVTEENVQVLLPAAGLLQLQDVKKTCCEFLESQLHP

SEQ ID NO: 42819 - protein, 55 aa, Homo sapiens
  Payload ID: 8709
  Gene Symbol: KLHL2
  Gene Name: kelch-like family member 2
  ENSP ID: ENSP00000421844
MVWLEARPQILFVCTKQGHQKPLDSKDDNTEKHCPVTVNPWHMKKAFKVMNELRR

SEQ ID NO: 42820 - protein, 144 aa, Homo sapiens
  Payload ID: 8709
  Gene Symbol: KLHL2
  Gene Name: kelch-like family member 2
  ENSP ID: ENSP00000422113
METPPLPPACTKQGHQKPLDSKDDNTEKHCPVTVNPWHMKKAFKVMNELRRQSHSATQAGMQWRDLSSLQPPTPGFKRLSHLSLPSSWDYSQNLLCDVTIVAEDMEISAHRVVLAACSPYFHAMFTGEMSESRAKRVRIKEVDG

SEQ ID NO: 42821 - protein, 427 aa, Homo sapiens
  Payload ID: 8709
  Gene Symbol: KLHL2
  Gene Name: kelch-like family member 2
  ENSP ID: ENSP00000424108
MHACTDLLNKANTYAEQHFADVVLSEEFLNLGIEQVCSLISSDKLTISSEEKVFEAVIAWVNHDKDVRQEFMARLMEHVRLPLLPREYLVQRVEEEALVKNSSACKDYLIEAMKYHLLPTEQRILMKSVRTRLRTPMNLPKLMVVVGGQAPKAIRSVECYDFKEERWHQVAELPSRRCRAGMVYMAGLVFAVGGFNGSLRVRTVDSYDPVKDQWTSVANMRDRRSTLGAAVLNGLLYAVGGFDGSTGLSSVEAYNIKSNEWFHVAPMNTRRSSVGVGVVGGLLYAVGGYDGASRQCLSTVECYNATTNEWTYIAEMSTRRSGAGVGVLNNLLYAVGGHDGPLVRKSVEVYDPTTNAWRQVADMNMCRRNAGVCAVNGLLYVVGGDDGSCNLASVEYYNPTTDKWTVVSSCMSTGRSYAGVTVIDKPL

SEQ ID NO: 42822 - protein, 597 aa, Homo sapiens
  Payload ID: 8709
  Gene Symbol: KLHL2
  Gene Name: kelch-like family member 2
  Uniprot ID: O95198
  ENSP ID: ENSP00000424198
MVWLEARPQILFVCTKQGHQKPLDSKDDNTEKHCPVTVNPWHMKKAFKVMNELRSQNLLCDVTIVAEDMEISAHRVVLAACSPYFHAMFTGEMSESRAKRVRIKEVDGWTLRMLIDYVYTAEIQVTEENVQVLLPAAGLLQLQDVKKTCCEFLESQLHPVNCLGIRAFADMHACTDLLNKANTYAEQHFADVVLSEEFLNLGIEQVCSLISSDKLTISSEEKVFEAVIAWVNHDKDVRQEFMARLMEHVRLPLLPREYLVQRVEEEALVKNSSACKDYLIEAMKYHLLPTEQRILMKSVRTRLRTPMNLPKLMVVVGGQAPKAIRSVECYDFKEERWHQVAELPSRRCRAGMVYMAGLVFAVGGFNGSLRVRTVDSYDPVKDQWTSVANMRDRRSTLGAAVLNGLLYAVGGFDGSTGLSSVEAYNIKSNEWFHVAPMNTRRSSVGVGVVGGLLYAVGGYDGASRQCLSTVECYNATTNEWTYIAEMSTRRSGAGVGVLNNLLYAVGGHDGPLVRKSVEVYDPTTNAWRQVADMNMCRRNAGVCAVNGLLYVVGGDDGSCNLASVEYYNPTTDKWTVVSSCMSTGRSYAGVTVIDKPL

SEQ ID NO: 42823 - protein, 505 aa, Homo sapiens
  Payload ID: 8709
  Gene Symbol: KLHL2
  Gene Name: kelch-like family member 2
  Uniprot ID: O95198
  ENSP ID: ENSP00000437526
MSESRAKRVRIKEVDGWTLRMLIDYVYTAEIQVTEENVQVLLPAAGLLQLQDVKKTCCEFLESQLHPVNCLGIRAFADMHACTDLLNKANTYAEQHFADVVLSEEFLNLGIEQVCSLISSDKLTISSEEKVFEAVIAWVNHDKDVRQEFMARLMEHVRLPLLPREYLVQRVEEEALVKNSSACKDYLIEAMKYHLLPTEQRILMKSVRTRLRTPMNLPKLMVVVGGQAPKAIRSVECYDFKEERWHQVAELPSRRCRAGMVYMAGLVFAVGGFNGSLRVRTVDSYDPVKDQWTSVANMRDRRSTLGAAVLNGLLYAVGGFDGSTGLSSVEAYNIKSNEWFHVAPMNTRRSSVGVGVVGGLLYAVGGYDGASRQCLSTVECYNATTNEWTYIAEMSTRRSGAGVGVLNNLLYAVGGHDGPLVRKSVEVYDPTTNAWRQVADMNMCRRNAGVCAVNGLLYVVGGDDGSCNLASVEYYNPTTDKWTVVSSCMSTGRSYAGVTVIDKPL

SEQ ID NO: 42824 - protein, 609 aa, Homo sapiens
  Payload ID: 8710
  Gene Symbol: KLHL20
  Gene Name: kelch-like family member 20
  Uniprot ID: Q9Y2M5
  ENSP ID: ENSP00000209884
MEGKPMRRCTNIRPGETGMDVTSRCTLGDPNKLPEGVPQPARMPYISDKHPRQTLEVINLLRKHRELCDVVLVVGAKKIYAHRVILSACSPYFRAMFTGELAESRQTEVVIRDIDERAMELLIDFAYTSQITVEEGNVQTLLPAACLLQLAEIQEACCEFLKRQLDPSNCLGIRAFADTHSCRELLRIADKFTQHNFQEVMESEEFMLLPANQLIDIISSDELNVRSEEQVFNAVMAWVKYSIQERRPQLPQVLQHVRLPLLSPKFLVGTVGSDPLIKSDEECRDLVDEAKNYLLLPQERPLMQGPRTRPRKPIRCGEVLFAVGGWCSGDAISSVERYDPQTNEWRMVASMSKRRCGVGVSVLDDLLYAVGGHDGSSYLNSVERYDPKTNQWSSDVAPTSTCRTSVGVAVLGGFLYAVGGQDGVSCLNIVERYDPKENKWTRVASMSTRRLGVAVAVLGGFLYAVGGSDGTSPLNTVERYNPQENRWHTIAPMGTRRKHLGCAVYQDMIYAVGGRDDTTELSSAERYNPRTNQWSPVVAMTSRRSGVGLAVVNGQLMAVGGFDGTTYLKTIEVFDPDANTWRLYGGMNYRRLGGGVGVIKMTHCESHIW

SEQ ID NO: 42825 - protein, 597 aa, Homo sapiens
  Payload ID: 8711
  Gene Symbol: KLHL21
  Gene Name: kelch-like family member 21
  Uniprot ID: Q9UJP4
  ENSP ID: ENSP00000366886
MERPAPLAVLPFSDPAHALSLLRGLSQLRAERKFLDVTLEAAGGRDFPAHRAVLAAASPYFRAMFAGQLRESRAERVRLHGVPPDMLQLLLDFSYTGRVAVSGDNAEPLLRAADLLQFPAVKEACGAFLQQQLDLANCLDMQDFAEAFSCSGLASAAQRFILRHVGELGAEQLERLPLARLLRYLRDDGLCVPKEEAAYQLALRWVRADPPRRAAHWPQLLEAVRLPFVRRFYLLAHVEAEPLVARCPPCLRLLREARDFQAARYDRHDRGPCPRMRPRPSTGLAEILVLVGGCDQDCDELVTVDCYNPQTGQWRYLAEFPDHLGGGYSIVALGNDIYVTGGSDGSRLYDCVWRYNSSVNEWAEVAPMLKAREYHSSSVLDGLLYVVAADSTERYDHTTDSWEALQPMTYPMDNCSTTACRGRLYAIGSLAGKETMVMQCYDPDTDLWSLVDCGQLPPWSFAPKTATLNGLMYFVRDDSAEVDVYNPTRNEWDKIPSMNQVHVGGSLAVLGGKLYVSGGYDNTFELSDVVEAYDPETRAWSVVGRLPEPTFWHGSVSIFRQFMPQTFSGGRGFELDSGSDDMDPGRPRPPRDPDELH

SEQ ID NO: 42826 - protein, 539 aa, Homo sapiens
  Payload ID: 8711
  Gene Symbol: KLHL21
  Gene Name: kelch-like family member 21
  Uniprot ID: Q9UJP4
  ENSP ID: ENSP00000366891
MERPAPLAVLPFSDPAHALSLLRGLSQLRAERKFLDVTLEAAGGRDFPAHRAVLAAASPYFRAMFAGQLRESRAERVRLHGVPPDMLQLLLDFSYTGRVAVSGDNAEPLLRAADLLQFPAVKEACGAFLQQQLDLANCLDMQDFAEAFSCSGLASAAQRFILRHVGELGAEQLERLPLARLLRYLRDDGLCVPKEEAAYQLALRWVRADPPRRAAHWPQLLEAVRLPFVRRFYLLAHVEAEPLVARCPPCLRLLREARDFQAARYDRHDRGPCPRMRPRPSTGLAEILVLVGGCDQDCDELVTVDCYNPQTGQWRYLAEFPDHLGGGYSIVALGNDIYVTGGSDGSRLYDCVWRYNSSVNEWAEVAPMLKAREYHSSSVLDGLLYVVAADSTERYDHTTDSWEALQPMTYPMDNCSTTACRGRLYAIGSLAGKETMVMQCYDPDTDLWSLVDCGQLPPWSFAPKTATLNGLMYFVRDDSAEVDVYNPTRNEWDKIPSMNQVNFQAGQHWKHRLVLILQPKCHRDECLGSTAMMGGSHLN

SEQ ID NO: 42827 - protein, 230 aa, Homo sapiens
  Payload ID: 8711
  Gene Symbol: KLHL21
  Gene Name: kelch-like family member 21
  ENSP ID: ENSP00000466089
MLKAREYHSSSVLDGLLYVVAADSTERYDHTTDSWEALQPMTYPMDNCSTTACRGRLYAIGSLAGKETMVMQCYDPDTDLWSLVDCGQLPPWSFAPKTATLNGLMYFVRDDSAEVDVYNPTRNEWDKIPSMNQVHVGGSLAVLGGKLYVSGGYDNTFELSDVVEAYDPETRAWSVVGRLPEPTFWHGSVSIFRQFMPQTFSGGRGFELDSGSDDMDPGRPRPPRDPDELH

SEQ ID NO: 42828 - protein, 133 aa, Homo sapiens
  Payload ID: 8711
  Gene Symbol: KLHL21
  Gene Name: kelch-like family member 21
  ENSP ID: ENSP00000466479
MLKAREYHSSSVLDGLLYVVAADSTERYDHTTDSWEALQPMTYPMDNCSTTACRGRLYAIGSLAGKETMVMQCYDPDTDLWSLVDCGQLPPWSFAPKTATLNGLMYFVRDDSAEVDVYNPTRNEWDKIPSMNQ

SEQ ID NO: 42829 - protein, 225 aa, Homo sapiens
  Payload ID: 8711
  Gene Symbol: KLHL21
  Gene Name: kelch-like family member 21
  ENSP ID: ENSP00000468710
MLKAREYHSSSVLDGLLYVVAADSTERYDHTTDSWEALQPMTYPMDNCSTTACRGRLYAIGSLAGKETMVMQCYDPDTDLWSLVDCGQLPPWSFAPKTATLNGLMYFVRDDSAEVDVYNPTRNEWDKIPSMNQVHVGGSLAVLGGKLYVSGGYDNTFELSDVVEAYDPETRAWSVVGRLPEPTFWHGSVSIFRQFMPQTFSGGRGFELDSGSDDMDPGRPRPPRD

SEQ ID NO: 42830 - protein, 35 aa, Homo sapiens
  Payload ID: 8711
  Gene Symbol: KLHL21
  Gene Name: kelch-like family member 21
  ENSP ID: ENSP00000480631
MPQTFSGGRGFELDSGSDDMDPGRPRPPRDPDELH

SEQ ID NO: 42831 - protein, 634 aa, Homo sapiens
  Payload ID: 8712
  Gene Symbol: KLHL22
  Gene Name: kelch-like family member 22
  Uniprot ID: Q53GT1
  ENSP ID: ENSP00000331682
MAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLHEPPKLLETVRFPLMEAEVLQRLHDKLDPSPLRDTVASALMYHRNESLQPSLQSPQTELRSDFQCVVGFGGIHSTPSTVLSDQAKYLNPLLGEWKHFTASLAPRMSNQGIAVLNNFVYLIGGDNNVQGFRAESRCWRYDPRHNRWFQIQSLQQEHADLSVCVVGRYIYAVAGRDYHNDLNAVERYDPATNSWAYVAPLKREVYAHAGATLEGKMYITCGRRGEDYLKETHCYDPGSNTWHTLADGPVRRAWHGMATLLNKLYVIGGSNNDAGYRRDVHQVACYSCTSGQWSSVCPLPAGHGEPGIAVLDNRIYVLGGRSHNRGSRTGYVHIYDVEKDCWEEGPQLDNSISGLAACVLTLPRSLLLEPPRGTPDRSQADPDFASEVMSVSDWEEFDNSSED

SEQ ID NO: 42832 - protein, 251 aa, Homo sapiens
  Payload ID: 8712
  Gene Symbol: KLHL22
  Gene Name: kelch-like family member 22
  ENSP ID: ENSP00000397882
MGLGSSCHLSLPKRAEALLCSRKATVVRDLVAVRMAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGA

SEQ ID NO: 42833 - protein, 235 aa, Homo sapiens
  Payload ID: 8712
  Gene Symbol: KLHL22
  Gene Name: kelch-like family member 22
  ENSP ID: ENSP00000398616
MAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLH

SEQ ID NO: 42834 - protein, 225 aa, Homo sapiens
  Payload ID: 8712
  Gene Symbol: KLHL22
  Gene Name: kelch-like family member 22
  ENSP ID: ENSP00000400095
MFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLHEPPKLLETVRFPLMEAEVLQRLHDKLDPSPLRDTVASALMYHRNESLQPSLQSPQTELRSDFQCVVG

SEQ ID NO: 42835 - protein, 107 aa, Homo sapiens
  Payload ID: 8712
  Gene Symbol: KLHL22
  Gene Name: kelch-like family member 22
  ENSP ID: ENSP00000402746
MPPPWHPPPRLLAVCLLTTTQATVVRDLVAVRMAEEQEFTQLCKLPAQPSHPHCVNNTYRSAQHSQALLRGLLALRDSGILFDVVLVVEGRHIEAHRILLAASCDYF

SEQ ID NO: 42836 - protein, 295 aa, Homo sapiens
  Payload ID: 8712
  Gene Symbol: KLHL22
  Gene Name: kelch-like family member 22
  ENSP ID: ENSP00000403999
MPPPWHPPPRLLAVCLLTTTQATVVRDLVAVRMAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLHEPPKLLETVRFPLMEAEVLQRLHDKLDP

SEQ ID NO: 42837 - protein, 158 aa, Homo sapiens
  Payload ID: 8712
  Gene Symbol: KLHL22
  Gene Name: kelch-like family member 22
  ENSP ID: ENSP00000409092
MAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQMLFTSPGLNGCHSLCRSQKLSISAVIS

SEQ ID NO: 42838 - protein, 558 aa, Homo sapiens
  Payload ID: 8713
  Gene Symbol: KLHL23
  Gene Name: kelch-like family member 23
  Uniprot ID: Q8NBE8
  ENSP ID: ENSP00000272797
MALKGQEDYIYLFKDSTHPVDFLDAFRTFYLDGLFTDITLQCPSGIIFHCHRAVLAACSNYFKAMFTADMKEKFKNKIKLSGIHHDILEGLVNYAYTSQIEITKRNVQSLLEAADLLQFLSVKKACERFLVRHLDIDNCIGMHSFAEFHVCPELEKESRRILCSKFKEVWQQEEFLEISLEKFLFILSRKNLSVWKEEAIIEPVIKWTAHDVENRIECLYNLLSYINIDIDPVYLKTALGLQRSCLLTENKIRSLIYNALNPMHKEISQRSTATMYIIGGYYWHPLSEVHIWDPLTNVWIQGAEIPDYTRESYGVTCLGPNIYVTGGYRTDNIEALDTVWIYNSESDEWTEGLPMLNARYYHCAVTLGGCVYALGGYRKGAPAEEAEFYDPLKEKWIPIANMIKGVGNATACVLHDVIYVIGGHCGYRGSCTYDKVQSYNSDINEWSLITSSPHPEYGLCSVPFENKLYLVGGQTTITECYDPEQNEWREIAPMMERRMECGAVIMNGCIYVTGGYSYSKGTYLQSIEKYDPDLNKWEIVGNLPSAMRSHGCVCVYNV

SEQ ID NO: 42839 - protein, 558 aa, Homo sapiens; identical to SEQ ID NO: 42838
  Payload ID: 8713
  Gene Symbol: KLHL23
  Gene Name: kelch-like family member 23
  Uniprot ID: Q8NBE8
  ENSP ID: ENSP00000376419

SEQ ID NO: 42840 - protein, 288 aa, Homo sapiens
  Payload ID: 8713
  Gene Symbol: KLHL23
  Gene Name: kelch-like family member 23
  ENSP ID: ENSP00000394732
LEKFLFILSRKNLSVWKEEAIIEPVIKWTAHDVENRIECLYNLLSYINIDIDPVYLKTALGLQRSCLLTENKIRSLIYNALNPMHKEISQRSTATMYIIGGYYWHPLSEVHIWDPLTNVWIQGAEIPDYTRESYGVTCLGPNIYVTGGYRTDNIEALDTVWIYNSESDEWTEGLPMLNARYYHCAVTLGGCVYALGGYRKGAPAEEAEFYDPLKEKWIPIANMIKGVGNATACVLHDVIYVIGGHCGYRGSCTYDKVQSYNSDINEWSLITSSPHPGKKTWYVGAFSI

SEQ ID NO: 42841 - protein, 25 aa, Homo sapiens
  Payload ID: 8713
  Gene Symbol: KLHL23
  Gene Name: kelch-like family member 23
  ENSP ID: ENSP00000400833
  MOD_RES (1)..(1): Any amino acid
XDINEWSLITSSPHPGLPTKKTTRR

SEQ ID NO: 42842 - protein, 49 aa, Homo sapiens
  Payload ID: 8713
  Gene Symbol: KLHL23
  Gene Name: kelch-like family member 23
  ENSP ID: ENSP00000474581
MMERRMECGAVIMNGCIYVTGGYSYSKGTYLQSIEKYDPDLNKWEIVGN

SEQ ID NO: 42843 - protein, 65 aa, Homo sapiens
  Payload ID: 8713
  Gene Symbol: KLHL23
  Gene Name: kelch-like family member 23
  ENSP ID: ENSP00000475081
MMERRMECGAVIMNGCIYVTGGYSYSKGTYLQSIEKYDPDLNKWEIVGNLPSAMRSHGCVCVYNV

SEQ ID NO: 42844 - protein, 600 aa, Homo sapiens
  Payload ID: 8714
  Gene Symbol: KLHL24
  Gene Name: kelch-like family member 24
  Uniprot ID: Q6TFL4
  ENSP ID: ENSP00000242810
MVLILGRRLNREDLGVRDSPATKRKVFEMDPKSLTGHEFFDFSSGSSHAENILQIFNEFRDSRLFTDVIICVEGKEFPCHRAVLSACSSYFRAMFCNDHRESREMLVEINGILAEAMECFLQYVYTGKVKITTENVQYLFETSSLFQISVLRDACAKFLEEQLDPCNCLGIQRFADTHSLKTLFTKCKNFALQTFEDVSQHEEFLELDKDELIDYICSDELVIGKEEMVFEAVMRWVYRAVDLRRPLLHELLTHVRLPLLHPNYFVQTVEVDQLIQNSPECYQLLHEARRYHILGNEMMSPRTRPRRSTGYSEVIVVVGGCERVGGFNLPYTECYDPVTGEWKSLAKLPEFTKSEYAVCALRNDILVSGGRINSRDVWIYNSQLNIWIRVASLNKGRWRHKMAVLLGKVYVVGGYDGQNRLSSVECYDSFSNRWTEVAPLKEAVSSPAVTSCVGKLFVIGGGPDDNTCSDKVQSYDPETNSWLLRAAIPIAKRCITAVSLNNLIYVAGGLTKAIYCYDPVEDYWMHVQNTFSRQENCGMSVCNGKIYILGGRRENGEATDTILCYDPATSIITGVAAMPRPVSYHGCVTIHRYNEKCFKL

SEQ ID NO: 42845 - protein, 600 aa, Homo sapiens; identical to SEQ ID NO: 42844
  Payload ID: 8714
  Gene Symbol: KLHL24
  Gene Name: kelch-like family member 24
  Uniprot ID: Q6TFL4
  ENSP ID: ENSP00000395012

SEQ ID NO: 42846 - protein, 60 aa, Homo sapiens
  Payload ID: 8714
  Gene Symbol: KLHL24
  Gene Name: kelch-like family member 24
  ENSP ID: ENSP00000408516
MVLILGRRLNREDLGVRDSPATKRKVFEMDPKSLTGHEFFDFSSGSSHAENILQIFNEFR

SEQ ID NO: 42847 - protein, 113 aa, Homo sapiens
  Payload ID: 8714
  Gene Symbol: KLHL24
  Gene Name: kelch-like family member 24
  ENSP ID: ENSP00000408567
MVLILGRRLNREDLGVRDSPATKRKVFEMDPKSLTGHEFFDFSSGSSHAENILQIFNEFRDSRLFTDVIICVEGKEFPCHRAVLSACSSYFRAMFCNDHRESREMLVEINGIL

SEQ ID NO: 42848 - protein, 117 aa, Homo sapiens
  Payload ID: 8714
  Gene Symbol: KLHL24
  Gene Name: kelch-like family member 24
  ENSP ID: ENSP00000416836
MVLILGRRLNREDLGVRDSPATKRKVFEMDPKSLTGHEFFDFSSGSSHAENILQIFNEFRDSRLFTDVIICVEGKEFPCHRAVLSACSSYFRAMFCNDHRESREMLVEINGILAEAM

SEQ ID NO: 42849 - protein, 134 aa, Homo sapiens
  Payload ID: 8714
  Gene Symbol: KLHL24
  Gene Name: kelch-like family member 24
  ENSP ID: ENSP00000417275
MVLILGRRLNREDLGVRDSPATKRKVFEMDPKSLTGHEFFDFSSGSSHAENILQIFNEFRDSRLFTDVIICVEGKEFPCHRAVLSACSSYFRAMFCNDHRESREMLVEINGILAEAMECFLQYVYTGKVKITTE

SEQ ID NO: 42850 - protein, 127 aa, Homo sapiens
  Payload ID: 8714
  Gene Symbol: KLHL24
  Gene Name: kelch-like family member 24
  ENSP ID: ENSP00000417347
MVLILGRRLNREDLGVRDSPATKRKVFEMDPKSLTGHEFFDFSSGSSHAENILQIFNEFRDSRLFTDVIICVEGKEFPCHRAVLSACSSYFRAMFCNDHRESREMLVEINGILAEAMECFLQYVYTG

SEQ ID NO: 42851 - protein, 125 aa, Homo sapiens
  Payload ID: 8714
  Gene Symbol: KLHL24
  Gene Name: kelch-like family member 24
  ENSP ID: ENSP00000418922
MVLILGRRLNREDLGVRDSPATKRKVFEMDPKSLTGHEFFDFSSGSSHAENILQIFNEFRDSRLFTDVIICVEGKEFPCHRAVLSACSSYFRAMFCNDHRESREMLVEINGILAEAMECFLQYVY

SEQ ID NO: 42852 - protein, 537 aa, Homo sapiens
  Payload ID: 8714
  Gene Symbol: KLHL24
  Gene Name: kelch-like family member 24
  Uniprot ID: Q6TFL4
  ENSP ID: ENSP00000419010
MVLILGRRLNREDLGVRDSPATKRKVFEMDPKSLTGHEFFDFSSGSSHAENILQIFNEFRDSRLFTDVIICVEGKEFPCHRAVLSACSSYFRAMFCNDHRESREMLVEINGILAEAMECFLQYVYTGKVKITTENVQYLFETSSLFQISVLRDACAKFLEEQLDPCNCLGIQRFADTHSLKTLFTKCKNFALQTFEDVSQHEEFLELDKDELIDYICSDELVIGKEEMVFEAVMRWVYRAVDLRRPLLHELLTHVRLPLLHPNYFVQTVEVDQLIQNSPECYQLLHEARRYHILGNEMMSPRTRPRRSTGYSEVIVVVGGCERVGGFNLPYTECYDPVTGEWKSLAKLPEFTKSEYAVCALRNDILVSGGRINSRDVWIYNSQLNIWIRVASLNKGRWRHKMAVLLGKVYVVGGYDGQNRLSSVECYDSFSNRWTEVAPLKEAVSSPAVTSCVGKLFVIGGGPDDNTCSDKVQSYDPETNSWLLRAAIPIAKRCITAVSLNNLIYVAGGLTKAIYCYDPVEDYWMHVQNTFSRQVIT

SEQ ID NO: 42853 - protein, 73 aa, Homo sapiens
  Payload ID: 8714
  Gene Symbol: KLHL24
  Gene Name: kelch-like family member 24
  ENSP ID: ENSP00000419120
MVLILGRRLNREDLGVRDSPATKRKVFEMDPKSLTGHEFFDFSSGSSHAENILQIFNEFRDSRLFTDVIICVE

SEQ ID NO: 42854 - protein, 78 aa, Homo sapiens
  Payload ID: 8714
  Gene Symbol: KLHL24
  Gene Name: kelch-like family member 24
  ENSP ID: ENSP00000420207
MVLILGRRLNREDLGVRDSPATKRKVFEMDPKSLTGHEFFDFSSGSSHAENILQIFNEFRDSRLFTDVIICVEGKEFP

SEQ ID NO: 42855 - protein, 589 aa, Homo sapiens
  Payload ID: 8715
  Gene Symbol: KLHL25
  Gene Name: kelch-like family member 25
  Uniprot ID: Q9H0H3
  ENSP ID: ENSP00000336800
MSVSVHETRKSRSSTGSMNVTLFHKASHPDCVLAHLNTLRKHCMFTDVTLWAGDRAFPCHRAVLAASSRYFEAMFSHGLRESRDDTVNFQDNLHPEVLELLLDFAYSSRIAINEENAESLLEAGDMLQFHDVRDAAAEFLEKNLFPSNCLGMMLLSDAHQCRRLYEFSWRMCLVHFETVRQSEDFNSLSKDTLLDLISSDELETEDERVVFEAILQWVKHDLEPRKVHLPELLRSVRLALLPSDCLQEAVSSEALLMADERTKLIMDEALRCKTRILQNDGVVTSPCARPRKAGHTLLILGGQTFMCDKIYQVDHKAKEIIPKADLPSPRKEFSASAIGCKVYVTGGRGSENGVSKDVWVYDTVHEEWSKAAPMLIARFGHGSAELENCLYVVGGHTSLAGVFPASPSVSLKQVEKYDPGANKWMMVAPLRDGVSNAAVVSAKLKLFVFGGTSIHRDMVSKVQCYDPSENRWTIKAECPQPWRYTAAAVLGSQIFIMGGDTEFTAASAYRFDCETNQWTRIGDMTAKRMSCHALASGNKLYVVGGYFGTQRCKTLDCYDPTSDTWNCITTVPYSLIPTAFVSTWKHLPA

SEQ ID NO: 42856 - protein, 615 aa, Homo sapiens
  Payload ID: 8716
  Gene Symbol: KLHL26
  Gene Name: kelch-like family member 26
  Uniprot ID: Q53HC5
  ENSP ID: ENSP00000300976
MAESGGSSGGAGGGGAFGAGPGPERPNSTADKNGALKCTFSAPSHSTSLLQGLATLRAQGQLLDVVLTINREAFPAHKVVLAACSDYFRAMFTGGMREASQDVIELKGVSARGLRHIIDFAYSAEVTLDLDCVQDVLGAAVFLQMLPVVELCEEFLKAAMSVETCLNIGQMATTFSLASLRESVDAFTFRHFLQIAEEEDFLRLPLERLVFFLQSNRLQSCAEIDLFRAAVRWLQHDPARRPRASHVLCHIRFPLMQSSELVDSVQTLDIMVEDVLCRQYLLEAFNYQVLPFRQHEMQSPRTAVRSDVPSLVTFGGTPYTDSDRSVSSKVYQLPEPGARHFRELTEMEVGCSHTCVAVLDNFVYVAGGQHLQYRSGEGAVDACYRYDPHLNRWLRLQAMQESRIQFQLNVLCGMVYATGGRNRAGSLASVERYCPRRNEWGYACSLKRRTWGHAGAASGGRLYISGGYGISVEDKKALHCYDPVADQWEFKAPMSEPRVLHAMVGAGGRIYALGGRMDHVDRCFDVLAVEYYVPETDQWTSVSPMRAGQSEAGCCLLERKIYIVGGYNWRLNNVTGIVQVYNTDTDEWERDLHFPESFAGIACAPVLLPRAGTRR

SEQ ID NO: 42857 - protein, 185 aa, Homo sapiens
  Payload ID: 8716
  Gene Symbol: KLHL26
  Gene Name: kelch-like family member 26
  ENSP ID: ENSP00000469099
  MOD_RES (1)..(1): Any amino acid
XAESGGSSGGAGGGGAFGAGPGPERPNSTADKNGALKCTFSAPSHSTSLLQGLATLRAQGQLLDVVLTINREAFPAHKVVLAACSDYFRLLFPRPDHSWLAKTPLSHCQPHVVFLPFRAMFTGGMREASQDVIELKGVSARGLRHIIDFAYSAEVTLDLDCVQDVLGAAVFLQMLPVVELCEEFL

SEQ ID NO: 42858 - protein, 46 aa, Homo sapiens
  Payload ID: 8716
  Gene Symbol: KLHL26
  Gene Name: kelch-like family member 26
  ENSP ID: ENSP00000470999
MAESGGSSGGAGGGGAFGAGPGPERPNRTVLGLWIASHGLGSRPWR

SEQ ID NO: 42859 - protein, 145 aa, Homo sapiens
  Payload ID: 8716
  Gene Symbol: KLHL26
  Gene Name: kelch-like family member 26
  ENSP ID: ENSP00000472001
MAESGGSSGGAGGGGAFGAGPGPERPNSTADKNGALKCTFSAPSHSTSLLQGLATLRAQGQLLDVVLTINREAFPAHKVVLAACSDYFRAMFTGGMREASQDVIELKGVSARGLRHIIDFAYSAEVTLDLDCVQDVAPKTPGTLA

SEQ ID NO: 42860 - protein, 102 aa, Homo sapiens
  Payload ID: 8716
  Gene Symbol: KLHL26
  Gene Name: kelch-like family member 26
  ENSP ID: ENSP00000472032
MAESGGSSGGAGGGGAFGAGPGPERPNSTADKNGALKCTFSAPSHSTSLLQGLATLRAQGQLLDVVLTINREAFPAHKVVLAACSDYFRLECSASGLDLLIS

SEQ ID NO: 42861 - protein, 585 aa, Homo sapiens
  Payload ID: 8717
  Gene Symbol: KLHL28
  Gene Name: kelch-like family member 28
  ENSP ID: ENSP00000347193
MHFKCKYSYPALYQMDHTSPTYMLANLTHLHSEQLLQGLNLLRQHHELCDIILRVGDVKIHAHKVVLASVSPYFKAMFTGNLSEKENSEVEFQCIDETALQAIVEYAYTGTVFISQDTVESLLPAANLLQIKLVLKECCAFLESQLDPGNCIGISRFAETYGCRDLYLAATKYICQNFEAVCQTEEFFELTHADLDEIVSNDCLNVATEETVFYALESWIKYDVQERQKYLAQLLNSVRLPLLSVKFLTRLYEANHLIRDDRTCKHLLNEALKYHFMPEHRLSHQTVLMTRPRCAPKVLCAVGGKSGLFACLDSVEMYFPQNDSWIGLAPLNIPRYEFGICVLDQKVYVIGGIATNVRPGVTIRKHENSVECWNPDTNTWTSLERMNESRSTLGVVVLAGELYALGGYDGQSYLQSVEKYIPKIRKWQPVAPMTTTRSCFAAAVLDGMIYAIGGYGPAHMNSVERYDPSKDSWEMVASMADKRIHFGVGVMLGFIFVVGGHNGVSHLSSIERYDPHQNQWTVCRPMKEPRTGVGAAVIDNYLYVVGGHSGSSYLNTVQKYDPISDTWLDSAGMIYCRCNFGLTAL

SEQ ID NO: 42862 - protein, 571 aa, Homo sapiens
  Payload ID: 8717
  Gene Symbol: KLHL28
  Gene Name: kelch-like family member 28
  Uniprot ID: Q9NXS3
  ENSP ID: ENSP00000379434
MDHTSPTYMLANLTHLHSEQLLQGLNLLRQHHELCDIILRVGDVKIHAHKVVLASVSPYFKAMFTGNLSEKENSEVEFQCIDETALQAIVEYAYTGTVFISQDTVESLLPAANLLQIKLVLKECCAFLESQLDPGNCIGISRFAETYGCRDLYLAATKYICQNFEAVCQTEEFFELTHADLDEIVSNDCLNVATEETVFYALESWIKYDVQERQKYLAQLLNSVRLPLLSVKFLTRLYEANHLIRDDRTCKHLLNEALKYHFMPEHRLSHQTVLMTRPRCAPKVLCAVGGKSGLFACLDSVEMYFPQNDSWIGLAPLNIPRYEFGICVLDQKVYVIGGIATNVRPGVTIRKHENSVECWNPDTNTWTSLERMNESRSTLGVVVLAGELYALGGYDGQSYLQSVEKYIPKIRKWQPVAPMTTTRSCFAAAVLDGMIYAIGGYGPAHMNSVERYDPSKDSWEMVASMADKRIHFGVGVMLGFIFVVGGHNGVSHLSSIERYDPHQNQWTVCRPMKEPRTGVGAAVIDNYLYVVGGHSGSSYLNTVQKYDPISDTWLDSAGMIYCRCNFGLTAL

SEQ ID NO: 42863 - protein, 45 aa, Homo sapiens
  Payload ID: 8717
  Gene Symbol: KLHL28
  Gene Name: kelch-like family member 28
  ENSP ID: ENSP00000450788
MDHTSPTYMLANLTHLHSEQLLQGLNLLRQHHELCDIILRVGDVK

SEQ ID NO: 42864 - protein, 162 aa, Homo sapiens
  Payload ID: 8717
  Gene Symbol: KLHL28
  Gene Name: kelch-like family member 28
  ENSP ID: ENSP00000452061
MDHTSPTYMLANLTHLHSEQLLQGLNLLRQHHELCDIILRVGDVKIHAHKVVLASVSPYFKAMFTGNLSEKENSEVEFQCIDETALQAIVEYAYTGTVFISQDTVESLLPAANLLQIKLVLKECCAFLESQLDPGNCIGISRFAETYGCRDLYLAATKYICQ

SEQ ID NO: 42865 - protein, 84 aa, Homo sapiens
  Payload ID: 8717
  Gene Symbol: KLHL28
  Gene Name: kelch-like family member 28
  ENSP ID: ENSP00000452591
MDHTSPTYMLANLTHLHSEQLLQGLNLLRQHHELCDIILRVGDVKIHAHKVVLASVSPYFKAMFTGNLSEKENSEVEFQCIDET

SEQ ID NO: 42866 - protein, 232 aa, Homo sapiens
  Payload ID: 8717
  Gene Symbol: KLHL28
  Gene Name: kelch-like family member 28
  ENSP ID: ENSP00000462025
MDHTSPTYMLANLTHLHSEQLLQGLNLLRQHHELCDIILRVGDVKIHAHKVVLASVSPYFKAMFTGNLSEKENSEVEFQCIDETALQAIVEYAYTGTVFISQDTVESLLPAANLLQIKLVLKECCAFLESQLDPGNCIGISRFAETYGCRDLYLAATKYICQNFEAVCQTEEFFELTHADLDEIVSNDCLNVATEETVFYALESWIKYDVQERQKYLAQLLNSVRLPLLSVK

SEQ ID NO: 42867 - protein, 542 aa, Homo sapiens
  Payload ID: 8718
  Gene Symbol: KLHL29
  Gene Name: kelch-like family member 29
  ENSP ID: ENSP00000288548
  MOD_RES (1)..(1): Any amino acid
XHSYGVAQPPTFSPAVNVQAPVIGVTPSLPPHVGPQLPLMPGHYSLPQPPSQPLSSVVVNMPAQALYASPQPLAVSTLPGVGQVARPGPTAVGNGHMAGPLLPPPPPAQPSATLPSGAPATNGPPTTDSAHGLQMLRTIGVGKYEFTDPGHPREMLKELNQQRRAKAFTDLKIVVEGREFEVHQNVLASCSLYFKDLIQRSVQDSGQGGREKLELVLSNLQADVLELLLEFVYTGSLVIDSANAKTLLEAASKFQFHTFCKVCVSFLEKQLTASNCLGVLAMAEAMQCSELYHMAKAFALQIFPEVAAQEEILSISKDDFIAYVSNDSLNTKAEELVYETVIKWIKKDPATRTQYAAELLAVVRLPFIHPSYLLNVVDNEELIKSSEACRDLVNEAKRYHMLPHARQEMQTPRTRPRLSAGVAEVIVLVGGRQMVGMTQRSLVAVTCWNPQNNKWYPLASLPFYDREFFSVVSAGDNIYLSGGMESGVTLADVWCYMSLLDNWNLVSRMTVPRCRHNSLVYDGKIYTLGGLGVAGNVDHVER

SEQ ID NO: 42868 - protein, 875 aa, Homo sapiens
  Payload ID: 8718
  Gene Symbol: KLHL29
  Gene Name: kelch-like family member 29
  Uniprot ID: Q96CT2
  ENSP ID: ENSP00000420659
MSRHHSRFERDYRVGWDRREWSVNGTHGTTSICSVTSGAGGGTASSLSVRPGLLPLPVVPSRLPTPATAPAPCTTGSSEAITSLVASSASAVTTKAPGISKGDSQSQGLATSIRWGQTPINQSTPWDTDEPPSKQMRESDNPGTGPWVTTVAAGNQPTLIAHSYGVAQPPTFSPAVNVQAPVIGVTPSLPPHVGPQLPLMPGHYSLPQPPSQPLSSVVVNMPAQALYASPQPLAVSTLPGVGQVARPGPTAVGNGHMAGPLLPPPPPAQPSATLPSGAPATNGPPTTDSAHGLQMLRTIGVGKYEFTDPGHPREMLKELNQQRRAKAFTDLKIVVEGREFEVHQNVLASCSLYFKDLIQRSVQDSGQGGREKLELVLSNLQADVLELLLEFVYTGSLVIDSANAKTLLEAASKFQFHTFCKVCVSFLEKQLTASNCLGVLAMAEAMQCSELYHMAKAFALQIFPEVAAQEEILSISKDDFIAYVSNDSLNTKAEELVYETVIKWIKKDPATRTQYAAELLAVVRLPFIHPSYLLNVVDNEELIKSSEACRDLVNEAKRYHMLPHARQEMQTPRTRPRLSAGVAEVIVLVGGRQMVGMTQRSLVAVTCWNPQNNKWYPLASLPFYDREFFSVVSAGDNIYLSGGMESGVTLADVWCYMSLLDNWNLVSRMTVPRCRHNSLVYDGKIYTLGGLGVAGNVDHVERYDTITNQWEAVAPLPKAVHSAAATVCGGKIYVFGGVNEAGRAAGVLQSYVPQTNTWSFIESPMIDNKYAPAVTLNGFVFILGGAYARATTIYDPEKGNIKAGPNMNHSRQFCSAVVLDGKIYATGGIVSSEGPALGNMEAYEPTTNTWTLLPHMPCPVFRHGCVVIKKYIQSG

SEQ ID NO: 42869 - protein, 587 aa, Homo sapiens
  Payload ID: 8719
  Gene Symbol: KLHL3
  Gene Name: kelch-like family member 3
  Uniprot ID: Q9UH77
  ENSP ID: ENSP00000312397
MEGESVKLSSQTLIQAGDDEKNQRTITVNPAHMGKAFKVMNELRSKQLLCDVMIVAEDVEIEAHRVVLAACSPYFCAMFTGDMSESKAKKIEIKDVDGQTLSKLIDYIYTAEIEVTEENVQVLLPAASLLQLMDVRQNCCDFLQSQLHPTNCLGIRAFADVHTCTDLLQQANAYAEQHFPEVMLGEEFLSLSLDQVCSLISSDKLTVSSEEKVFEAVISWINYEKETRLEHMAKLMEHVRLPLLPRDYLVQTVEEEALIKNNNTCKDFLIEAMKYHLLPLDQRLLIKNPRTKPRTPVSLPKVMIVVGGQAPKAIRSVECYDFEEDRWDQIAELPSRRCRAGVVFMAGHVYAVGGFNGSLRVRTVDVYDGVKDQWTSIASMQERRSTLGAAVLNDLLYAVGGFDGSTGLASVEAYSYKTNEWFFVAPMNTRRSSVGVGVVEGKLYAVGGYDGASRQCLSTVEQYNPATNEWIYVADMSTRRSGAGVGVLSGQLYATGGHDGPLVRKSVEVYDPGTNTWKQVADMNMCRRNAGVCAVNGLLYVVGGDDGSCNLASVEYYNPVTDKWTLLPTNMSTGRSYAGVAVIHKSL

SEQ ID NO: 42870 - protein, 555 aa, Homo sapiens
  Payload ID: 8719
  Gene Symbol: KLHL3
  Gene Name: kelch-like family member 3
  Uniprot ID: Q9UH77
  ENSP ID: ENSP00000422099
MGKAFKVMNELRSKQLLCDVMIVAEDVEIEAHRVVLAACSPYFCAMFTGDMSESKAKKIEIKDVDGQTLSKLIDYIYTAEIEVTEENVQVLLPAASLLQLMDVRQNCCDFLQSQLHPTNCLGIRAFADVHTCTDLLQQANAYAEQHFPEVMLGEEFLSLSLDQVCSLISSDKLTVSSEEKVFEAVISWINYEKETRLEHMAKLMEHVRLPLLPRDYLVQTVEEEALIKNNNTCKDFLIEAMKYHLLPLDQRLLIKNPRTKPRTPVSLPKVMIVVGGQAPKAIRSVECYDFEEDRWDQIAELPSRRCRAGVVFMAGHVYAVGGFNGSLRVRTVDVYDGVKDQWTSIASMQERRSTLGAAVLNDLLYAVGGFDGSTGLASVEAYSYKTNEWFFVAPMNTRRSSVGVGVVEGKLYAVGGYDGASRQCLSTVEQYNPATNEWIYVADMSTRRSGAGVGVLSGQLYATGGHDGPLVRKSVEVYDPGTNTWKQVADMNMCRRNAGVCAVNGLLYVVGGDDGSCNLASVEYYNPVTDKWTLLPTNMSTGRSYAGVAVIHKSL

SEQ ID NO: 42871 - protein, 105 aa, Homo sapiens
  Payload ID: 8719
  Gene Symbol: KLHL3
  Gene Name: kelch-like family member 3
  ENSP ID: ENSP00000423585
MSESKAKKIEIKDVDGQTLSKLIDYIYTAEIEVTEENVQVLLPAASLLQLMDVRQNCCDFLQSQLHPTNCLGIRAFADVHTCTDLLQQANAYAALSRGDARRRIS

SEQ ID NO: 42872 - protein, 505 aa, Homo sapiens
  Payload ID: 8719
  Gene Symbol: KLHL3
  Gene Name: kelch-like family member 3
  Uniprot ID: Q9UH77
  ENSP ID: ENSP00000424828
MSESKAKKIEIKDVDGQTLSKLIDYIYTAEIEVTEENVQVLLPAASLLQLMDVRQNCCDFLQSQLHPTNCLGIRAFADVHTCTDLLQQANAYAEQHFPEVMLGEEFLSLSLDQVCSLISSDKLTVSSEEKVFEAVISWINYEKETRLEHMAKLMEHVRLPLLPRDYLVQTVEEEALIKNNNTCKDFLIEAMKYHLLPLDQRLLIKNPRTKPRTPVSLPKVMIVVGGQAPKAIRSVECYDFEEDRWDQIAELPSRRCRAGVVFMAGHVYAVGGFNGSLRVRTVDVYDGVKDQWTSIASMQERRSTLGAAVLNDLLYAVGGFDGSTGLASVEAYSYKTNEWFFVAPMNTRRSSVGVGVVEGKLYAVGGYDGASRQCLSTVEQYNPATNEWIYVADMSTRRSGAGVGVLSGQLYATGGHDGPLVRKSVEVYDPGTNTWKQVADMNMCRRNAGVCAVNGLLYVVGGDDGSCNLASVEYYNPVTDKWTLLPTNMSTGRSYAGVAVIHKSL

SEQ ID NO: 42873 - protein, 400 aa, Homo sapiens
  Payload ID: 8719
  Gene Symbol: KLHL3
  Gene Name: kelch-like family member 3
  ENSP ID: ENSP00000426173
MEGESKQLLCDVMIVAEDVEIEAHRVVLAACSPYFCAMFTGDMSESKAKKIEIKDVDGQTLSKLIDYIYTAEIEVTEENVQVLLPAASLLQLMDVRQNCCDFLQSQLHPTNCLGIRAFADVHTCTDLLQQANAYAEQHFPEVMLGEEFLSLSLDQVCSLISSDKLTVSSEEKVFEAVISWINYEKETRLEHMAKLMEHVRLPLLPRDYLVQTVEEEALIKNNNTCKDFLIEAMKYHLLPLDQRLLIKNPRTKPRTPVSLPKVMIVVGGQAPKAIRSVECYDFEEDRWDQIAELPSRRCRAGVVFMAGHVYAVGGFNGSLRVRTVDVYDGVKDQWTSIASMQERRSTLGAAVLNDLLYAVGGFDGSTGLASVEAYSYKTNEWFFVAPMNTRRSSVGVGVVE

SEQ ID NO: 42874 - protein, 578 aa, Homo sapiens
  Payload ID: 8720
  Gene Symbol: KLHL30
  Gene Name: kelch-like family member 30
  Uniprot ID: Q0D2K2
  ENSP ID: ENSP00000386389
MVRNVDDLDFHLPSHAQDMLDGLQRLRSQPKLADVTLLVGGRELPCHRGLLALSSPYFHAMFAGDFAESFSARVELRDVEPAVVGQLVDFVYTGRLTITQGNVEALTRTAARLHFPSVQKVCGRYLQQQLDAANCLGICEFGEQQGLLGVAAKAWAFLRENFEAVAREDEFLQLPRERLVTCLAGDLLQVQPEQSRLEALMRWVRHDPQARAAHLPELLSLVHLDAVPRPCVQQLLASEPLIQESEACRAALSQGHDGAPLALQQKLEEVLVVVGGQALEEEEAGEEPTPGLGNFAFYNSKAKRWMALPDFPDYHKWGFSLAALNNNIYVTGGSRGTKTDTWSTTQAWCFPLKEASWKPVAPMLKPRTNHASAALNGEIYVIGGTTLDVVEVESYDPYTDSWTPVSPALKYVSNFSAAGCRGRLYLVGSSACKYNALALQCYNPVTDAWSVIASPFLPKYLSSPRCAALHGELYLIGDNTKKVYVYDPGANLWQKVQSQHSLHENGALVPLGDALYVTGGRWQGMEGDYHVEMEAYDTVRDTWTRHGALPRLWLYHGASTVFLDVSKWTQPSGPTQEH

SEQ ID NO: 42875 - protein, 634 aa, Homo sapiens
  Payload ID: 8721
  Gene Symbol: KLHL31
  Gene Name: kelch-like family member 31
  Uniprot ID: Q9H511
  ENSP ID: ENSP00000359942
MAPKKKIVKKNKGDINEMTIIVEDSPLNKLNALNGLLEGGNGLSCISSELTDASYGPNLLEGLSKMRQENFLCDLVIGTKTKSFDVHKSVMASCSEYFYNILKKDPSIQRVDLNDISPLGLATVIAYAYTGKLTLSLYTIGSIISAAVYLQIHTLVKMCSDFLIREMSVENCMYVVNIAETYSLKNAKAAAQKFIRDNFLEFAESDQFMKLTFEQINELLIDDDLQLPSEIVAFQIAMKWLEFDQKRVKYAADLLSNIRFGTISAQDLVNYVQSVPRMMQDADCHRLLVDAMNYHLLPYHQNTLQSRRTRIRGGCRVLVTVGGRPGLTEKSLSRDILYRDPENGWSKLTEMPAKSFNQCVAVMDGFLYVAGGEDQNDARNQAKHAVSNFCRYDPRFNTWIHLASMNQKRTHFSLSVFNGLVYAAGGRNAEGSLASLECYVPSTNQWQPKTPLEVARCCHASAVADGRVLVTGGYIANAYSRSVCAYDPASDSWQELPNLSTPRGWHCAVTLSDRVYVMGGSQLGPRGERVDVLTVECYSPATGQWSYAAPLQVGVSTAGVSALHGRAYLVGGWNEGEKKYKKCIQCFSPELNEWTEDDELPEATVGVSCCTLSMPNNVTRESRASSVSSVPVSI

SEQ ID NO: 42876 - protein, 634 aa, Homo sapiens; identical to SEQ ID NO: 42875
  Payload ID: 8721
  Gene Symbol: KLHL31
  Gene Name: kelch-like family member 31
  Uniprot ID: Q9H511
  ENSP ID: ENSP00000384644

SEQ ID NO: 42877 - protein, 139 aa, Homo sapiens
  Payload ID: 8722
  Gene Symbol: KLHL32
  Gene Name: kelch-like family member 32
  ENSP ID: ENSP00000358258
MPSERCLSIQEMLTGQRLCHSESHNDSVLAALNQQRSDGILCDITLIAEEQKFHAHKAVLAACSDYFRAMFSLCMVESGADEVNLHGVTSLGLKQALEFAYTGQILLEPGVIQDVLAAGSHLQLLELLNLCSHYLIQVE

SEQ ID NO: 42878 - protein, 620 aa, Homo sapiens
  Payload ID: 8722
  Gene Symbol: KLHL32
  Gene Name: kelch-like family member 32
  Uniprot ID: Q96NJ5
  ENSP ID: ENSP00000358265
MPSERCLSIQEMLTGQRLCHSESHNDSVLAALNQQRSDGILCDITLIAEEQKFHAHKAVLAACSDYFRAMFSLCMVESGADEVNLHGVTSLGLKQALEFAYTGQILLEPGVIQDVLAAGSHLQLLELLNLCSHYLIQELNSFNYLDLYRLADLFNLTLLEKAVIDFLVKHLSELLKSRPEEVLTLPYCLLQEVLKSDRLTSLSEEQIWQLAVRWLEHNCHYQYMDELLQYIRFGLMDVDTLHTVALSHPLVQASETATALVNEALEYHQSIYAQPVWQTRRTKPRFQSDTLYIIGGKKREVCKVKELRYFNPVDQENALIAAIANWSELAPMPVGRSHHCVAVMGDFLFVAGGEVEHASGRTCAVRTACRYDPRSNSWAEIAPMKNCREHFVLGAMEEYLYAVGGRNELRQVLPTVERYCPKKNKWTFVQSFDRSLSCHAGYVADGLLWISGGVTNTAQYQNRLMVYEPNQNKWISRSPMLQRRVYHSMAAVQRKLYVLGGNDLDYNNDRILVRHIDSYNIDTDQWTRCNFNLLTGQNESGVAVHNGRIYLVGGYSIWTNEPLACIQVLDVSREGKEEVFYGPTLPFASNGIAACFLPAPYFTCPNLQTLQVPHHRIGTI

SEQ ID NO: 42879 - protein, 176 aa, Homo sapiens
  Payload ID: 8722
  Gene Symbol: KLHL32
  Gene Name: kelch-like family member 32
  ENSP ID: ENSP00000389310
ILLEPGVIQDVLAAGSHLQLLELLNLCSHYLIQELNSFNYLDLYRLADLFNLTLLEKAVIDFLVKHLSELLKSRPEEVLTLPYCLLQEVLKSDRLTSLSEEQIWQKCGICAAFCALRGDWCPGLPQWDDKTASCEVVGTQLPLPVHGRAPAIHPLWPNGCGYSPYSCPVPPPCPSK

SEQ ID NO: 42880 - protein, 584 aa, Homo sapiens
  Payload ID: 8722
  Gene Symbol: KLHL32
  Gene Name: kelch-like family member 32
  Uniprot ID: Q96NJ5
  ENSP ID: ENSP00000440382
MPSERCLSIQEMLTGQRLCHSESHNDSVLAALNQQRSDGILCDITLIAEEQKFHAHKAVLAACSDYFRILLEPGVIQDVLAAGSHLQLLELLNLCSHYLIQELNSFNYLDLYRLADLFNLTLLEKAVIDFLVKHLSELLKSRPEEVLTLPYCLLQEVLKSDRLTSLSEEQIWQLAVRWLEHNCHYQYMDELLQYIRFGLMDVDTLHTVALSHPLVQASETATALVNEALEYHQSIYAQPVWQTRRTKPRFQSDTLYIIGGKKREVCKVKELRYFNPVDQENALIAAIANWSELAPMPVGRSHHCVAVMGDFLFVAGGEVEHASGRTCAVRTACRYDPRSNSWAEIAPMKNCREHFVLGAMEEYLYAVGGRNELRQVLPTVERYCPKKNKWTFVQSFDRSLSCHAGYVADGLLWISGGVTNTAQYQNRLMVYEPNQNKWISRSPMLQRRVYHSMAAVQRKLYVLGGNDLDYNNDRILVRHIDSYNIDTDQWTRCNFNLLTGQNESGVAVHNGRIYLVGGYSIWTNEPLACIQVLDVSREGKEEVFYGPTLPFASNGIAACFLPAPYFTCPNLQTLQVPHHRIGTI

SEQ ID NO: 42881 - protein, 551 aa, Homo sapiens
  Payload ID: 8722
  Gene Symbol: KLHL32
  Gene Name: kelch-like family member 32
  Uniprot ID: Q96NJ5
  ENSP ID: ENSP00000441527
MPSERCLSIQEMLTGQRLCHSESHNDSVLAALNQQRSDGILCDITLIAEEQKFHAHKAVLAACSDYFRELNSFNYLDLYRLADLFNLTLLEKAVIDFLVKHLSELLKSRPEEVLTLPYCLLQEVLKSDRLTSLSEEQIWQLAVRWLEHNCHYQYMDELLQYIRFGLMDVDTLHTVALSHPLVQASETATALVNEALEYHQSIYAQPVWQTRRTKPRFQSDTLYIIGGKKREVCKVKELRYFNPVDQENALIAAIANWSELAPMPVGRSHHCVAVMGDFLFVAGGEVEHASGRTCAVRTACRYDPRSNSWAEIAPMKNCREHFVLGAMEEYLYAVGGRNELRQVLPTVERYCPKKNKWTFVQSFDRSLSCHAGYVADGLLWISGGVTNTAQYQNRLMVYEPNQNKWISRSPMLQRRVYHSMAAVQRKLYVLGGNDLDYNNDRILVRHIDSYNIDTDQWTRCNFNLLTGQNESGVAVHNGRIYLVGGYSIWTNEPLACIQVLDVSREGKEEVFYGPTLPFASNGIAACFLPAPYFTCPNLQTLQVPHHRIGTI

SEQ ID NO: 42882 - protein, 176 aa, Homo sapiens
  Payload ID: 8722
  Gene Symbol: KLHL32
  Gene Name: kelch-like family member 32
  ENSP ID: ENSP00000445453
MLPLSHPGGVTNTAQYQNRLMVYEPNQNKWISRSPMLQRRVYHSMAAVQRKLYVLGGNDLDYNNDRILVRHIDSYNIDTDQWTRCNFNLLTGQNESGVAVHNGRIYLVGGYSIWTNEPLACIQVLDVSREGKEEVFYGPTLPFASNGIAACFLPAPYFTCPNLQTLQVPHHRIGTI

SEQ ID NO: 42883 - protein, 156 aa, Homo sapiens
  Payload ID: 8722
  Gene Symbol: KLHL32
  Gene Name: kelch-like family member 32
  ENSP ID: ENSP00000482012
MVYEPNQNKWISRSPMLQRRVYHSMAAVQRKLYVLGGNDLDYNNDRILVRHIDSYNIDTDQWTRCNFNLLTGQNESGVAVHNGRIYLVGGYSIWTNEPLACIQVLDVSREGKEEVFYGPTLPFASNGIAACFLPAPYFTCPNLQTLQVPHHRIGTI

SEQ ID NO: 42884 - protein, 533 aa, Homo sapiens
  Payload ID: 8723
  Gene Symbol: KLHL33
  Gene Name: kelch-like family member 33
  Uniprot ID: A6NCF5
  ENSP ID: ENSP00000341549
MLLSGMRESQGTEVSLRTISTQDLRLLVSFAYSGVVRARWPGLLRAAQAALQYQSSSCLDLCQKGLARGLSPARCLALFPMAEAPGLERLWSKARHYLLTHLPAVALCPAFPSLPAACLAELLDSDELHVQEEFEAFVAARCWLAANPETQESEAKALLRCVRFGRMSTRELRRVRAAGLLPPLTPDLLHQLMVEADVPGQERRREPDRALVVIGGDGLRPDMALRQPSRAVWWARAFRCGVGLVRTVEWGQLPALPAPGRFRHGAASLAGSELYVCGGQDFYSHSNTLASTLRWEPSQEDWEEMAPLSQARSLFSLVALDGKLYALGGRHNDVALDSVETYNPELNVWRPAPALPAPCFAHAAAILEGQLYVSGGCGGTGQYLASLMHYDPKLEKPGTFLSPMGVPRAGHVMAALGGRLYVAGGLGETEDLLSFEAYELRTDSWTHLAPLPSPHVGAASAVLQGELLVLGGYSHRTYALSHLIHAYCPGLGRWLCLGTLPRPRAEMPACILTLPAVQHIALVPTPHQTKPAG

SEQ ID NO: 42885 - protein, 644 aa, Homo sapiens
  Payload ID: 8724
  Gene Symbol: KLHL34
  Gene Name: kelch-like family member 34
  Uniprot ID: Q8N239
  ENSP ID: ENSP00000368813
MSYFLSYCKAHGGALLTGYQALRAEGFLCDVTLETEGSEFPAHRSLLACSSDYFRALFKSHTQESRARVIHLHVPSAAGLQRLLDFIYTAWLSLSMDTVEDTLEAASYLQVTEALGLCGRYLERQLAPENCCFAANVAARFGLAHTLDAAERCIVSHLQELLARGAGPAGLLELNPTSLRAVLGAPDVARVPEARLLGLALAWLRQEPTTERLAHCTELLERVRFGLVPADVLRRVYSGSGLVLPARVKGLIIQALNYHTTPSRQPLMQGEQTSIRSPQTRILLVGGRRAREVVIEEVAAPQRAARGQVAAPEPEEEEEELEEEEEEEEWELTQNVVAFDVYNHRWRSLTQLPTPLLGHSVCTAGNFLFVLGGESPSGSASSPLADDSRVVTAQVHRYDPRFHAWTEVPAMREARAHFWCGAVGERLLAVGGLGAGGEVLASVEMYDLRRDRWTAAGALPRALHGHAGAVGDRGVVYISGGKAGRGEGGASSLRDLYVLGPEEQVWSKKAPMGTARFGHHMAVLRGAVFAFLGRYEPFSEIERYDPGADQWTRLRPLPYDRFCYGLAVVEETALLLGGLKWRDSRQVPTRNVVGYDLDLDRWEDIGCALPWAWSGLRCAVLQLAEGGDDEREGEVGEALDLVLG

SEQ ID NO: 42886 - protein, 363 aa, Homo sapiens
  Payload ID: 8725
  Gene Symbol: KLHL35
  Gene Name: kelch-like family member 35
  ENSP ID: ENSP00000365469
MRWVRHDAPARRGQLRRLLEHVRLPLLAPAYFLEKVEADELLQACGECRPLLLEARACFILGREAGALRTRPRRFMDLAEVIVVIGGCDRKGLLKLPFADAYHPESQRWTPLPSLPGYTRSEFAACALRNDVYVSGGHINSHDVWMFSSHLHTWIKVASLHKGRWRHKMAVVQGQLFAVGGFDGLRRLHSVERYDPFSNTWAAAAPLPEAVSSAAVASCAGKLFVIGGARQGGVNTDKVQCFDPKEDRWSLRSPAPFSQRCLEAVSLEDTIYVMGGLMSKIFTYDPGTDVWGEAAVLPSPVESCGVTVCDGKVHILGGRDDRGESTDKVFTFDPSSGQVEVQPSLQRCTSSHGCVTIIQSLGR

SEQ ID NO: 42887 - protein, 583 aa, Homo sapiens
  Payload ID: 8725
  Gene Symbol: KLHL35
  Gene Name: kelch-like family member 35
  Uniprot ID: Q6PF15
  ENSP ID: ENSP00000438526
MRQGHAPEESEPGCEAPCAGPCHAQRVLQALNAYRRSGTLTDVVLRAGGRDFPCHRAALSAGSAYFRSLFAAGRPERGPAVVPVVPVAPEAPGTSPAGAAAALAVVLDYVYGAGVRLRAEDEAAAVLALAERLGVAGLREACVRFLEGRLRAANSLALRRVAAAFSLAPLAERCGRVLRQAFAEVARHADFLELAPDEVVALLADPALGVAREEAVFEAAMRWVRHDAPARRGQLRRLLEHVRLPLLAPAYFLEKVEADELLQACGECRPLLLEARACFILGREAGALRTRPRRFMDLAEVIVVIGGCDRKGLLKLPFADAYHPESQRWTPLPSLPGYTRSEFAACALRNDVYVSGGHINSHDVWMFSSHLHTWIKVASLHKGRWRHKMAVVQGQLFAVGGFDGLRRLHSVERYDPFSNTWAAAAPLPEAVSSAAVASCAGKLFVIGGARQGGVNTDKVQCFDPKEDRWSLRSPAPFSQRCLEAVSLEDTIYVMGGLMSKIFTYDPGTDVWGEAAVLPSPVESCGVTVCDGKVHILGGRDDRGESTDKVFTFDPSSGQVEVQPSLQRCTSSHGCVTIIQSLGR

SEQ ID NO: 42888 - protein, 553 aa, Homo sapiens
  Payload ID: 8726
  Gene Symbol: KLHL36
  Gene Name: kelch-like family member 36
  Uniprot ID: Q8N4N3
  ENSP ID: ENSP00000258157
MMEGSRQTRVSRPYKISESSKVYRWADHSSTVLQRLNEQRLRGLFCDVVLVADEQRVPAHRNLLAVCSDYFNSMFTIGMREAFQKEVELIGASYIGLKAVVDFLYGGELVLDGGNIDYVLETAHLLQIWTVVDFCCEYLEQEVSEDNYLYLQELASIYSLKRLDAFIDGFILNHFGTLSFTPDFLQNVSMQKLCVYLSSSEVQRECEHDLLQAALQWLTQQPEREAHARQVLENIHFPLIPKNDLLHRVKPAVCSLLPKEANCEGFIEEAVRYHNNLAAQPVMQTKRTALRTNQERLLFVGGEVSERCLELSDDTCYLDAKSEQWVKETPLPARRSHHCVAVLGGFIFIAGGSFSRDNGGDAASNLLYRFTYGHAGTIYKDFVYISGGHDYQIGPYRKNLLCYDHRTDVWEERRPMTTARGWHSMCSLGDSIYSIGGSDDNIESMERFDVLGVEAYSPQCNQWTRVAPLLHANSESGVAVWEGRIYILGGYSWENTAFSKTVQVYDREADKWSRGVDLPKAIAGGSACVCALEPRPEDKKKKGKGKRHQDRGQ

SEQ ID NO: 42889 - protein, 97 aa, Homo sapiens
  Payload ID: 8726
  Gene Symbol: KLHL36
  Gene Name: kelch-like family member 36
  ENSP ID: ENSP00000455244
MMEGSRQTRVSRPYKISESSKVYRWADHSSTVLQRLNEQRLRGLFCDVVLVADEQRVPAHRNLLAVCSDYFNSMFTIGMREAFQKEVELIGASYIGL

SEQ ID NO: 42890 - protein, 115 aa, Homo sapiens
  Payload ID: 8726
  Gene Symbol: KLHL36
  Gene Name: kelch-like family member 36
  ENSP ID: ENSP00000455746
MMEGSRQTRVSRPYKISESSKVYRWADHSSTVLQRLNEQRLRGLFCDVVLVADEQRVPAHRNLLAVCSDYFNSMFTIGMREAFQKEVELIGASYIGLKAVVDFLYGGELVLDGGN

SEQ ID NO: 42891 - protein, 62 aa, Homo sapiens
  Payload ID: 8726
  Gene Symbol: KLHL36
  Gene Name: kelch-like family member 36
  ENSP ID: ENSP00000455966
MMEGSRQTRVSRPYKISESSKVYRWADHSSTVLQRLNEQRLRGLFCDVVLVADEQRVPAHRN

SEQ ID NO: 42892 - protein, 616 aa, Homo sapiens
  Payload ID: 8726
  Gene Symbol: KLHL36
  Gene Name: kelch-like family member 36
  Uniprot ID: Q8N4N3
  ENSP ID: ENSP00000456743
MMEGSRQTRVSRPYKISESSKVYRWADHSSTVLQRLNEQRLRGLFCDVVLVADEQRVPAHRNLLAVCSDYFNSMFTIGMREAFQKEVELIGASYIGLKAVVDFLYGGELVLDGGNIDYVLETAHLLQIWTVVDFCCEYLEQEVSEDNYLYLQELASIYSLKRLDAFIDGFILNHFGTLSFTPDFLQNVSMQKLCVYLSSSEVQRECEHDLLQAALQWLTQQPEREAHARQVLENIHFPLIPKNDLLHRVKPAVCSLLPKEANCEGFIEEAVRYHNNLAAQPVMQTKRTALRTNQERLLFVGGEVSERCLELSDDTCYLDAKSEQWVKETPLPARRSHHCVAVLGGFIFIAGGSFSRDNGGDAASNLLYRYDPRCKQWIKVASMNQRRVDFYLASIEDMLVAIGGRNENGALSSVETYSPKTDSWSYVAGLPRFTYGHAGTIYKDFVYISGGHDYQIGPYRKNLLCYDHRTDVWEERRPMTTARGWHSMCSLGDSIYSIGGSDDNIESMERFDVLGVEAYSPQCNQWTRVAPLLHANSESGVAVWEGRIYILGGYSWENTAFSKTVQVYDREADKWSRGVDLPKAIAGGSACVCALEPRPEDKKKKGKGKRHQDRGQ

SEQ ID NO: 42893 - protein, 581 aa, Homo sapiens
  Payload ID: 8727
  Gene Symbol: KLHL38
  Gene Name: kelch-like family member 38
  Uniprot ID: Q2WGJ6
  ENSP ID: ENSP00000321475
MDEESLDGLLFKDHDFSSDLLRQLNSLRQSRILTDVSICAGAREIPCHRNVLASSSPYFRAMFCSSFREKSEAKVQLKGIDPPTLDQIVSYVYTGEAHIATDNVLPVMEAASMLQFPKLFEACSSYLQSQLAPSNCLGMIRLSEILSCETLKKKAREVALTSFPEVAASADLKELCALELRDYLGDDGLCGEEEKVFEALMVWIKHDLQARKRYMQELFKQVRLQYIHPAFFHHFIANDALLQSSPACQIILETAKRQMFSLCGTTVPDCKLLLHVPPRNSYQDFLILLGGRKDSQQTTRDVLLYSKQTGQWQSLAKLPTRLYKASAITLHRSIYVLGGMAVSSGRSLVSHNVYIFSLKLNQWRLGEPMLVARYSHRSTAHKNFIFSIGGIGEGQELMGSMERYDSICNVWESMASMPVGVLHPAVAVKDQRLYLFGGEDIMQNPVRLIQVYHISRNSWFKMETRMIKNVCAPAVVLGERIVIVGGYTRRILAYDPQSNKFVKCADMKDRRMHHGATVMGNKLYVTGGRRLTTDCNIEDSASFDCYDPETDTWTSQGQLPHKLFDHACLTLQCIPRTSGLP

SEQ ID NO: 42894 - protein, 720 aa, Homo sapiens
  Payload ID: 8728
  Gene Symbol: KLHL4
  Gene Name: kelch-like family member 4
  Uniprot ID: Q9C0H6
  ENSP ID: ENSP00000362206
MSVSGKKEFDVKQILRLRWRWFSHPFQGSTNTGSCLQQEGYEHRGTPVQGRLKSHSRDRNGLKKSNSPVHHNILAPVPGPAPAHQRAVQNLQQHNLIVHFQANEDTPKSVPEKNLFKEACEKRAQDLEMMADDNIEDSTARLDTQHSEDMNATRSEEQFHVINHAEQTLRKMENYLKEKQLCDVLLIAGHLRIPAHRLVLSAVSDYFAAMFTNDVLEAKQEEVRMEGVDPNALNSLVQYAYTGVLQLKEDTIESLLAAACLLQLTQVIDVCSNFLIKQLHPSNCLGIRSFGDAQGCTELLNVAHKYTMEHFIEVIKNQEFLLLPANEISKLLCSDDINVPDEETIFHALMQWVGHDVQNRQGELGMLLSYIRLPLLPPQLLADLETSSMFTGDLECQKLLMEAMKYHLLPERRSMMQSPRTKPRKSTVGALYAVGGMDAMKGTTTIEKYDLRTNSWLHIGTMNGRRLQFGVAVIDNKLYVVGGRDGLKTLNTVECFNPVGKIWTVMPPMSTHRHGLGVATLEGPMYAVGGHDGWSYLNTVERWDPEGRQWNYVASMSTPRSTVGVVALNNKLYAIGGRDGSSCLKSMEYFDPHTNKWSLCAPMSKRRGGVGVATYNGFLYVVGGHDAPASNHCSRLSDCVERYDPKGDSWSTVAPLSVPRDAVAVCPLGDKLYVVGGYDGHTYLNTVESYDAQRNEWKESMQELLQNFYTTQKLKETLGH

SEQ ID NO: 42895 - protein, 718 aa, Homo sapiens
  Payload ID: 8728
  Gene Symbol: KLHL4
  Gene Name: kelch-like family member 4
  Uniprot ID: Q9C0H6
  ENSP ID: ENSP00000362211
MSVSGKKEFDVKQILRLRWRWFSHPFQGSTNTGSCLQQEGYEHRGTPVQGRLKSHSRDRNGLKKSNSPVHHNILAPVPGPAPAHQRAVQNLQQHNLIVHFQANEDTPKSVPEKNLFKEACEKRAQDLEMMADDNIEDSTARLDTQHSEDMNATRSEEQFHVINHAEQTLRKMENYLKEKQLCDVLLIAGHLRIPAHRLVLSAVSDYFAAMFTNDVLEAKQEEVRMEGVDPNALNSLVQYAYTGVLQLKEDTIESLLAAACLLQLTQVIDVCSNFLIKQLHPSNCLGIRSFGDAQGCTELLNVAHKYTMEHFIEVIKNQEFLLLPANEISKLLCSDDINVPDEETIFHALMQWVGHDVQNRQGELGMLLSYIRLPLLPPQLLADLETSSMFTGDLECQKLLMEAMKYHLLPERRSMMQSPRTKPRKSTVGALYAVGGMDAMKGTTTIEKYDLRTNSWLHIGTMNGRRLQFGVAVIDNKLYVVGGRDGLKTLNTVECFNPVGKIWTVMPPMSTHRHGLGVATLEGPMYAVGGHDGWSYLNTVERWDPEGRQWNYVASMSTPRSTVGVVALNNKLYAIGGRDGSSCLKSMEYFDPHTNKWSLCAPMSKRRGGVGVATYNGFLYVVGGHDAPASNHCSRLSDCVERYDPKGDSWSTVAPLSVPRDAVAVCPLGDKLYVVGGYDGHTYLNTVESYDAQRNEWKEEVPVNIGRAGACVVVVKLP

SEQ ID NO: 42896 - protein, 621 aa, Homo sapiens
  Payload ID: 8729
  Gene Symbol: KLHL40
  Gene Name: kelch-like family member 40
  Uniprot ID: Q2TBA0
  ENSP ID: ENSP00000287777
MALGLEQAEEQRLYQQTLLQDGLKDMLDHGKFLDCVVRAGEREFPCHRLVLAACSPYFRARFLAEPERAGELHLEEVSPDVVAQVLHYLYTSEIALDEASVQDLFAAAHRFQIPSIFTICVSFLQKRLCLSNCLAVFRLGLLLDCARLAVAARDFICAHFTLVARDADFLGLSADELIAIISSDGLNVEKEEAVFEAVMRWAGSGDAEAQAERQRALPTVFESVRCRLLPRAFLESRVERHPLVRAQPELLRKVQMVKDAHEGRITTLRKKKKGKDGAGAKEADKGTSKAKAEEDEEAERILPGILNDTLRFGMFLQDLIFMISEEGAVAYDPAANECYCASLSNQVPKNHVSLVTKENQVFVAGGLFYNEDNKEDPMSAYFLQFDHLDSEWLGMPPLPSPRCLFGLGEALNSIYVVGGREIKDGERCLDSVMCYDRLSFKWGESDPLPYVVYGHTVLSHMDLVYVIGGKGSDRKCLNKMCVYDPKKFEWKELAPMQTARSLFGATVHDGRIIVAAGVTDTGLTSSAEVYSITDNKWAPFEAFPQERSSLSLVSLVGTLYAIGGFATLETESGELVPTELNDIWRYNEEEKKWEGVLREIAYAAGATFLPVRLNVLCLTKM

SEQ ID NO: 42897 - protein, 606 aa, Homo sapiens
  Payload ID: 8730
  Gene Symbol: KLHL41
  Gene Name: kelch-like family member 41
  Uniprot ID: O60662
  ENSP ID: ENSP00000284669
MDSQRELAEELRLYQSTLLQDGLKDLLDEKKFIDCTLKAGDKSLPCHRLILSACSPYFREYFLSEIDEAKKKEVVLDNVDPAILDLIIKYLYSASIDLNDGNVQDIFALASRFQIPSVFTVCVSYLQKRLAPGNCLAILRLGLLLDCPRLAISAREFVSDRFVQICKEEDFMQLSPQELISVISNDSLNVEKEEAVFEAVMKWVRTDKENRVKNLSEVFDCIRFRLMTEKYFKDHVEKDDIIKSNPDLQKKIKVLKDAFAGKLPEPSKNAAKTGAGEVNGDVGDEDLLPGYLNDIPRHGMFVKDLILLVNDTAAVAYDPTENECYLTALAEQIPRNHSSIVTQQNQIYVVGGLYVDEENKDQPLQSYFFQLDSIASEWVGLPPLPSARCLFGLGEVDDKIYVVAGKDLQTEASLDSVLCYDPVAAKWNEVKKLPIKVYGHNVISHKGMIYCLGGKTDDKKCTNRVFIFNPKKGDWKDLAPMKIPRSMFGVAVHKGKIVIAGGVTEDGLSASVEAFDLTTNKWDVMTEFPQERSSISLVSLAGSLYAIGGFAMIQLESKEFAPTEVNDIWKYEDDKKEWAGMLKEIRYASGASCLATRLNLFKLSKL

SEQ ID NO: 42898 - protein, 505 aa, Homo sapiens
  Payload ID: 8731
  Gene Symbol: KLHL42
  Gene Name: kelch-like family member 42
  Uniprot ID: Q9P2K6
  ENSP ID: ENSP00000370671
MSAEEMVQIRLEDRCYPVSKRKLIEQSDYFRALYRSGMREALSQEAGGPEVQQLRGLSAPGLRLVLDFINAGGAREGWLLGPRGEKGGGVDEDEEMDEVSLLSELVEAASFLQVTSLLQLLLSQVRLNNCLEMYRLAQVYGLPDLQEACLRFMVVHFHEVLCKPQFHLLGSPPQAPGDVSLKQRLREARMTGTPVLVALGDFLGGPLAPHPYQGEPPSMLRYEEMTERWFPLANNLPPDLVNVRGYGSAILDNYLFIVGGYRITSQEISAAHSYNPSTNEWLQVASMNQKRSNFKLVAVNSKLYAIGGQAVSNVECYNPEQDAWNFVAPLPNPLAEFSACECKGKIYVIGGYTTRDRNMNILQYCPSSDMWTLFETCDVHIRKQQMVSVEETIYIVGGCLHELGPNRRSSQSEDMLTVQSYNTVTRQWLYLKENTSKSGLNLTCALHNDGIYIMSRDVTLSTSLEHRVFLKYNIFSDSWEAFRRFPAFGHNLLVSSLYLPNKAET

SEQ ID NO: 42899 - protein, 179 aa, Homo sapiens
  Payload ID: 8731
  Gene Symbol: KLHL42
  Gene Name: kelch-like family member 42
  ENSP ID: ENSP00000443934
  MOD_RES (1)..(1): Any amino acid
XSLKQRLREARMTGTPVLVALGDFLGGPLAPHPYQGEPPSMLRYEEMTERWFPLANNLPPDLVNVRGYGSAILDNYLFIVGGYRITSQEISAAHSYNPSTNEWLQVASMNQKRSNFKLVAVNSKLYAIGGQAVSNVECYNPEQDAWNFVAPLPNPLAEFSACECKGKIYVIGGYTTRGK

SEQ ID NO: 42900 - protein, 369 aa, Homo sapiens
  Payload ID: 8731
  Gene Symbol: KLHL42
  Gene Name: kelch-like family member 42
  ENSP ID: ENSP00000444748
MSAEEMVQIRLEDRCYPVSKRKLIEQSDYFRALYRSGMREALSQEAGGPEVQQLRGLSAPGLRLVLDFINAGGAREGWLLGPRGEKGGGVDEDEEMDEVSLLSELVEAASFLQVTSLLQLLLSQVRLNNCLEMYRLAQVYGLPDLQEACLRFMVVHFHEVLCKPQFHLLGSPPQAPGDVSLKQRLREARMTGTPVLVALGDFLGGPLAPHPYQGEPPSMLRYEEMTERWFPLANNLPPDLVNVRGYGSAILDNYLFIVGGYRITSQEISAAHSYNPSTNEWLQVASMNQKRSNFKLVAVNSKLYAIGGQAVSNVECYNPEQDAWNFVAPLPNPLAEFSACECKGKIYVIGGYTTRDSLWRSCVATCHVS

SEQ ID NO: 42901 - protein, 709 aa, Homo sapiens
  Payload ID: 8732
  Gene Symbol: KLHL5
  Gene Name: kelch-like family member 5
  Uniprot ID: Q96PQ7
  ENSP ID: ENSP00000261425
MSGSRKEFDVKQILKIRWRWFGHQASSPNSTVDSQQGEFWNRGQTGANGGRKFLDPCSLQLPLASIGYRRSSQLDFQNSPSWPMASTSEVPAFEFTAEDCGGAHWLDRPEVDDGTSEEENESDSSSCRTSNSSQTLSSCHTMEPCTSDEFFQALNHAEQTFKKMENYLRHKQLCDVILVAGDRRIPAHRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVAPLCLGRAGACVVTVKL

SEQ ID NO: 42902 - protein, 694 aa, Homo sapiens
  Payload ID: 8732
  Gene Symbol: KLHL5
  Gene Name: kelch-like family member 5
  Uniprot ID: Q96PQ7
  ENSP ID: ENSP00000261426
MNVIYFPLHIFVVYSRAYTSLVLVGCTNLCAVLFARCLDDHLVSLRMSGSRKEFDVKQILKIRWRWFGHQASSPNSTVDSQQGEFWNRGQTGANGGRKFLDPCSLQLPLASIGYRRSSQLDFQNSPSWPMASTSEVPAFEFTAEDCGGAHWLDRPEVDDGTSEEENESDSSSCRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVAPLCLGRAGACVVTVKL

SEQ ID NO: 42903 - protein, 757 aa, Homo sapiens
  Payload ID: 8732
  Gene Symbol: KLHL5
  Gene Name: kelch-like family member 5
  Uniprot ID: Q96PQ7
  ENSP ID: ENSP00000371355
MNVIYFPLHIFVVYSRAYTSLVLVGCTNLCAVLFARCLDDHLVSLRMSGSRKEFDVKQILKIRWRWFGHQASSPNSTVDSQQGEFWNRGQTGANGGRKFLDPCSLQLPLASIGYRRSSQLDFQNSPSWPMASTSEVPAFEFTAEDCGGAHWLDRPEVDDGTSEEENESDSSSCRTSNSSQTLSSCHTMEPCTSDEFFQALNHAEQTFKKMENYLRHKQLCDVILVAGDRRIPAHRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVWHSCFIITLTLFLLKQFLW

SEQ ID NO: 42904 - protein, 568 aa, Homo sapiens
  Payload ID: 8732
  Gene Symbol: KLHL5
  Gene Name: kelch-like family member 5
  Uniprot ID: Q96PQ7
  ENSP ID: ENSP00000423080
MEPCTSDEFFQALNHAEQTFKKMENYLRHKQLCDVILVAGDRRIPAHRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVAPLCLGRAGACVVTVKL

SEQ ID NO: 42905 - protein, 755 aa, Homo sapiens
  Payload ID: 8732
  Gene Symbol: KLHL5
  Gene Name: kelch-like family member 5
  Uniprot ID: Q96PQ7
  ENSP ID: ENSP00000423897
MNVIYFPLHIFVVYSRAYTSLVLVGCTNLCAVLFARCLDDHLVSLRMSGSRKEFDVKQILKIRWRWFGHQASSPNSTVDSQQGEFWNRGQTGANGGRKFLDPCSLQLPLASIGYRRSSQLDFQNSPSWPMASTSEVPAFEFTAEDCGGAHWLDRPEVDDGTSEEENESDSSSCRTSNSSQTLSSCHTMEPCTSDEFFQALNHAEQTFKKMENYLRHKQLCDVILVAGDRRIPAHRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVAPLCLGRAGACVVTVKL

SEQ ID NO: 42906 - protein, 282 aa, Homo sapiens
  Payload ID: 8732
  Gene Symbol: KLHL5
  Gene Name: kelch-like family member 5
  ENSP ID: ENSP00000425512
  MOD_RES (1)..(1): Any amino acid
XRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVFSHTFEDSKDHLVAIKQTIWRQNSLSEEFRSH

SEQ ID NO: 42907 - protein, 36 aa, Homo sapiens
  Payload ID: 8732
  Gene Symbol: KLHL5
  Gene Name: kelch-like family member 5
  ENSP ID: ENSP00000426949
  MOD_RES (1)..(1): Any amino acid
XAEDCGGAHWLDRPEVDDGTSEEENESDSSSCSSPD

SEQ ID NO: 42908 - protein, 621 aa, Homo sapiens
  Payload ID: 8733
  Gene Symbol: KLHL6
  Gene Name: kelch-like family member 6
  Uniprot ID: Q8WZ60
  ENSP ID: ENSP00000341342
MLMAGQRGAWTMGDVVEKSLEGPLAPSTDEPSQKTGDLVEILNGEKVKFDDAGLSLILQNGLETLRMENALTDVILCVDIQEFSCHRVVLAAASNYFRAMFCNDLKEKYEKRIIIKGVDAETMHTLLDYTYTSKALITKQNVQRVLEAANLFQFLRMVDACASFLTEALNPENCVGILRLADTHSLDSLKKQVQSYIIQNFVQILNSEEFLDLPVDTLHHILKSDDLYVTEEAQVFETVMSWVRHKPSERLCLLPYVLENVRLPLLDPWYFVETVEADPLIRQCPEVFPLLQEARMYHLSGNEIISERTKPRMHEFQSEVFMIIGGCTKDERFVAEVTCLDPLRRSRLEVAKLPLTEHELESENKKWVEFACVTLKNEVYISGGKETQHDVWKYNSSINKWIQIEYLNIGRWRHKMVVLGGKVYVIGGFDGLQRINNVETYDPFHNCWSEAAPLLVHVSSFAATSHKKKLYVIGGGPNGKLATDKTQCYDPSTNKWSLKAAMPVEAKCINAVSFRDRIYVVGGAMRALYAYSPLEDSWCLVTQLSHERASCGIAPCNNRLYITGGRDEKNEVIATVLCWDPEAQKLTEECVLPRGVSHHGSVTIRKSYTHIRRIVPGAVSV

SEQ ID NO: 42909 - protein, 610 aa, Homo sapiens
  Payload ID: 8733
  Gene Symbol: KLHL6
  Gene Name: kelch-like family member 6
  ENSP ID: ENSP00000433734
MGDVVEKSLEGPLAPSTDEPSQKTGDLVEILNGEKVKFDDAGLSLILQNGLETLRMENALTDVILCVDIQEFSCHRVVLAAASNYFRAMFCNDLKEKYEKRIIIKGVDAETMHTLLDYTYTSKALITKQNVQRVLEAANLFQFLRMVDACASFLTEALNPENCVGILRLADTHSLDSLKKQVQSYIIQNFVQILNSEEFLDLPVDTLHHILKSDDLYVTEEAQVFETVMSWVRHKPSERLCLLPYVLENVRLPLLDPWYFVETVEADPLIRQCPEVFPLLQEARMYHLSGNEIISERTKPRMHEFQSEVFMIIGGCTKDERFVAEVTCLDPLRRSRLEVAKLPLTEHELESENKKWVEFACVTLKNEVYISGGKETQHDVWKYNSSINKWIQIEYLNIGRWRHKMVVLGGKVYVIGGFDGLQRINNVETYDPFHNCWSEAAPLLVHVSSFAATSHKKKLYVIGGGPNGKLATDKTQCYDPSTNKWSLKAAMPVEAKCINAVSFRDRIYVVGGAMRALYAYSPLEDSWCLVTQLSHERASCGIAPCNNRLYITGGRDEKNEVIATVLCWDPEAQKLTEECVLPRGVSHHGSVTIRKSYTHIRRIVPGAVSV

SEQ ID NO: 42910 - protein, 166 aa, Homo sapiens
  Payload ID: 8734
  Gene Symbol: KLHL7
  Gene Name: kelch-like family member 7
  Uniprot ID: Q8IXQ5
  ENSP ID: ENSP00000323270
MAASGVEKSSKKKTEKKLAAREEAKLLAGFMGVMNNMRKQKTLCDVILMVQERKIPAHRVVLAAASHFFNLMFTTNMLESKSFEVELKDAEPDIIEQLVEFAYTARISVNSNNVQSLLDAANQYQIEPVKKMCVDFLKEQVDASNCLGEAEKVDQSLPECGMLFTV

SEQ ID NO: 42911 - protein, 586 aa, Homo sapiens
  Payload ID: 8734
  Gene Symbol: KLHL7
  Gene Name: kelch-like family member 7
  Uniprot ID: Q8IXQ5
  ENSP ID: ENSP00000343273
MAASGVEKSSKKKTEKKLAAREEAKLLAGFMGVMNNMRKQKTLCDVILMVQERKIPAHRVVLAAASHFFNLMFTTNMLESKSFEVELKDAEPDIIEQLVEFAYTARISVNSNNVQSLLDAANQYQIEPVKKMCVDFLKEQVDASNCLGISVLAECLDCPELKATADDFIHQHFTEVYKTDEFLQLDVKRVTHLLNQDTLTVRAEDQVYDAAVRWLKYDEPNRQPFMVDILAKVRFPLISKNFLSKTVQAEPLIQDNPECLKMVISGMRYHLLSPEDREELVDGTRPRRKKHDYRIALFGGSQPQSCRYFNPKDYSWTDIRCPFEKRRDAACVFWDNVVYILGGSQLFPIKRMDCYNVVKDSWYSKLGPPTPRDSLAACAAEGKIYTSGGSEVGNSALYLFECYDTRTESWHTKPSMLTQRCSHGMVEANGLIYVCGGSLGNNVSGRVLNSCEVYDPATETWTELCPMIEARKNHGLVFVKDKIFAVGGQNGLGGLDNVEYYDIKLNEWKMVSPMPWKGVTVKCAAVGSIVYVLAGFQGVGRLGHILEYNTETDKWVANSKVRAFPVTSCLICVVDTCGANEETLET

SEQ ID NO: 42912 - protein, 538 aa, Homo sapiens
  Payload ID: 8734
  Gene Symbol: KLHL7
  Gene Name: kelch-like family member 7
  Uniprot ID: Q8IXQ5
  ENSP ID: ENSP00000386263
MVQERKIPAHRVVLAAASHFFNLMFTTNMLESKSFEVELKDAEPDIIEQLVEFAYTARISVNSNNVQSLLDAANQYQIEPVKKMCVDFLKEQVDASNCLGISVLAECLDCPELKATADDFIHQHFTEVYKTDEFLQLDVKRVTHLLNQDTLTVRAEDQVYDAAVRWLKYDEPNRQPFMVDILAKVRFPLISKNFLSKTVQAEPLIQDNPECLKMVISGMRYHLLSPEDREELVDGTRPRRKKHDYRIALFGGSQPQSCRYFNPKDYSWTDIRCPFEKRRDAACVFWDNVVYILGGSQLFPIKRMDCYNVVKDSWYSKLGPPTPRDSLAACAAEGKIYTSGGSEVGNSALYLFECYDTRTESWHTKPSMLTQRCSHGMVEANGLIYVCGGSLGNNVSGRVLNSCEVYDPATETWTELCPMIEARKNHGLVFVKDKIFAVGGQNGLGGLDNVEYYDIKLNEWKMVSPMPWKGVTVKCAAVGSIVYVLAGFQGVGRLGHILEYNTETDKWVANSKVRAFPVTSCLICVVDTCGANEETLET

SEQ ID NO: 42913 - protein, 144 aa, Homo sapiens
  Payload ID: 8734
  Gene Symbol: KLHL7
  Gene Name: kelch-like family member 7
  Uniprot ID: Q8IXQ5
  ENSP ID: ENSP00000386999
MLGGTDCRTFLTSHINLKKTLCDVILMVQERKIPAHRVVLAAASHFFNLMFTTNMLESKSFEVELKDAEPDIIEQLVEFAYTARISVNSNNVQSLLDAANQYQIEPVKKMCVDFLKEQVDASNCLGEAEKVDQSLPECGMLFTV

SEQ ID NO: 42914 - protein, 93 aa, Homo sapiens
  Payload ID: 8734
  Gene Symbol: KLHL7
  Gene Name: kelch-like family member 7
  ENSP ID: ENSP00000404181
VRFPLISKNFLSKTVQAEPLIQDNPECLKMVISGMRYHLLSPEDREELVDGTRPRRKKHDYRIALFGGSQPQSCRYFNPKLKRDAYSSTRAWK

SEQ ID NO: 42915 - protein, 40 aa, Homo sapiens
  Payload ID: 8734
  Gene Symbol: KLHL7
  Gene Name: kelch-like family member 7
  ENSP ID: ENSP00000430351
MAASGVEKSSKKKTEKKLAAREEAKLLAGFMGVMNNMRKQ

SEQ ID NO: 42916 - protein, 620 aa, Homo sapiens
  Payload ID: 8735
  Gene Symbol: KLHL8
  Gene Name: kelch-like family member 8
  Uniprot ID: Q9P2G9
  ENSP ID: ENSP00000273963
MASDSMSSKQARNHITKGKRQQQHQQIKNRSSISDGDGEDSFIFEANEAWKDFHGSLLRFYENGELCDVTLKVGSKLISCHKLVLACVIPYFRAMFLSEMAEAKQTLIEIRDFDGDAIEDLVKFVYSSRLTLTVDNVQPLLYAACILQVELVARACCEYMKLHFHPSNCLAVRAFAESHNRIDLMDMADQYACDHFTEVVECEDFVSVSPQHLHKLLSSSDLNIENEKQVYNAAIKWLLANPQHHSKWLDETLAQVRLPLLPVDFLMGVVAKEQIVKQNLKCRDLLDEARNYHLHLSSRAVPDFEYSIRTTPRKHTAGVLFCVGGRGGSGDPFRSIECYSINKNSWFFGPEMNSRRRHVGVISVEGKVYAVGGHDGNEHLGSMEMFDPLTNKWMMKASMNTKRRGIALASLGGPIYAIGGLDDNTCFNDVERYDIESDQWSTVAPMNTPRGGVGSVALVNHVYAVGGNDGMASLSSVERYDPHLDKWIEVKEMGQRRAGNGVSKLHGCLYVVGGFDDNSPLSSVERYDPRSNKWDYVAALTTPRGGVGIATVMGKIFAVGGHNGNAYLNTVEAFDPVLNRWELVGSVSHCRAGAGVAVCSCLTSQIRDVGHGSNNVVDCM

SEQ ID NO: 42917 - protein, 437 aa, Homo sapiens
  Payload ID: 8735
  Gene Symbol: KLHL8
  Gene Name: kelch-like family member 8
  ENSP ID: ENSP00000408854
MASDSMSSKQARNHITKGKRQQQHQQIKNRSSISDGDGEDSFIFEANEAWKDFHGSLLRFYENGELCDVTLKVRLPLLPVDFLMGVVAKEQIVKQNLKCRDLLDEARNYHLHLSSRAVPDFEYSIRTTPRKHTAGVLFCVGGRGGSGDPFRSIECYSINKNSWFFGPEMNSRRRHVGVISVEGKVYAVGGHDGNEHLGSMEMFDPLTNKWMMKASMNTKRRGIALASLGGPIYAIGGLDDNTCFNDVERYDIESDQWSTVAPMNTPRGGVGSVALVNHVYAVGGNDGMASLSSVERYDPHLDKWIEVKEMGQRRAGNGVSKLHGCLYVVGGFDDNSPLSSVERYDPRSNKWDYVAALTTPRGGVGIATVMGKIFAVGGHNGNAYLNTVEAFDPVLNRWELVGSVSHCRAGAGVAVCSCLTSQIRDVGHGSNNVVDCM

SEQ ID NO: 42918 - protein, 620 aa, Homo sapiens; identical to SEQ ID NO: 42916
  Payload ID: 8735
  Gene Symbol: KLHL8
  Gene Name: kelch-like family member 8
  Uniprot ID: Q9P2G9
  ENSP ID: ENSP00000424131

SEQ ID NO: 42919 - protein, 77 aa, Homo sapiens
  Payload ID: 8735
  Gene Symbol: KLHL8
  Gene Name: kelch-like family member 8
  ENSP ID: ENSP00000426361
MASDSMSSKQARNHITKGKRQQQHQQIKNRSSISDGDGEDSFIFEANEAWKDFHGSLLRFYENGELCDVTLKVCCFV

SEQ ID NO: 42920 - protein, 544 aa, Homo sapiens
  Payload ID: 8735
  Gene Symbol: KLHL8
  Gene Name: kelch-like family member 8
  Uniprot ID: Q9P2G9
  ENSP ID: ENSP00000426451
MASDSMSSKQARNHITKGKRQQQHQQIKNRSSISDGDGEDSFIFEANEAWKDFHGSLLRFYENGELCDVTLKVELVARACCEYMKLHFHPSNCLAVRAFAESHNRIDLMDMADQYACDHFTEVVECEDFVSVSPQHLHKLLSSSDLNIENEKQVYNAAIKWLLANPQHHSKWLDETLAQVRLPLLPVDFLMGVVAKEQIVKQNLKCRDLLDEARNYHLHLSSRAVPDFEYSIRTTPRKHTAGVLFCVGGRGGSGDPFRSIECYSINKNSWFFGPEMNSRRRHVGVISVEGKVYAVGGHDGNEHLGSMEMFDPLTNKWMMKASMNTKRRGIALASLGGPIYAIGGLDDNTCFNDVERYDIESDQWSTVAPMNTPRGGVGSVALVNHVYAVGGNDGMASLSSVERYDPHLDKWIEVKEMGQRRAGNGVSKLHGCLYVVGGFDDNSPLSSVERYDPRSNKWDYVAALTTPRGGVGIATVMGKIFAVGGHNGNAYLNTVEAFDPVLNRWELVGSVSHCRAGAGVAVCSCLTSQIRDVGHGSNNVVDCM

SEQ ID NO: 42921 - protein, 617 aa, Homo sapiens
  Payload ID: 8736
  Gene Symbol: KLHL9
  Gene Name: kelch-like family member 9
  Uniprot ID: Q9P2J3
  ENSP ID: ENSP00000351933
MKVSLGNGEMGVSAHLQPCKAGTTRFFTSNTHSSVVLQGFDQLRIEGLLCDVTLVPGDGDEIFPVHRAMMASASDYFKAMFTGGMKEQDLMCIKLHGVNKVGLKKIIDFIYTAKLSLNMDNLQDTLEAASFLQILPVLDFCKVFLISGVSLDNCVEVGRIANTYNLIEVDKYVNNFILKNFPALLSTGEFLKLPFERLAFVLSSNSLKHCTELELFKAACRWLRLEDPRMDYAAKLMKNIRFPLMTPQDLINYVQTVDFMRTDNTCVNLLLEASNYQMMPYMQPVMQSDRTAIRSDSTHLVTLGGVLRQQLVVSKELRMYDERAQEWRSLAPMDAPRYQHGIAVIGNFLYVVGGQSNYDTKGKTAVDTVFRFDPRYNKWMQVASLNEKRTFFHLSALKGHLYAVGGRSAAGELATVECYNPRMNEWSYVAKMSEPHYGHAGTVYGGLMYISGGITHDTFQNELMCFDPDTDKWMQKAPMTTVRGLHCMCTVGDKLYVIGGNHFRGTSDYDDVLSCEYYSPTLDQWTPIAAMLRGQSDVGVAVFENKIYVVGGYSWNNRCMVEIVQKYDPEKDEWHKVFDLPESLGGIRACTLTVFPPEENPGSPSRESPLSAPSDHS

SEQ ID NO: 42922 - protein, 732 aa, Homo sapiens
  Payload ID: 8737
  Gene Symbol: KEL
  Gene Name: Kell blood group, metallo-endopeptidase
  Uniprot ID: P23276
  ENSP ID: ENSP00000347409
MEGGDQSEEEPRERSQAGGMGTLWSQESTPEERLPVEGSRPWAVARRVLTAILILGLLLCFSVLLFYNFQNCGPRPCETSVCLDLRDHYLASGNTSVAPCTDFFSFACGRAKETNNSFQELATKNKNRLRRILEVQNSWHPGSGEEKAFQFYNSCMDTLAIEAAGTGPLRQVIEELGGWRISGKWTSLNFNRTLRLLMSQYGHFPFFRAYLGPHPASPHTPVIQIDQPEFDVPLKQDQEQKIYAQIFREYLTYLNQLGTLLGGDPSKVQEHSSLSISITSRLFQFLRPLEQRRAQGKLFQMVTIDQLKEMAPAIDWLSCLQATFTPMSLSPSQSLVVHDVEYLKNMSQLVEEMLLKQRDFLQSHMILGLVVTLSPALDSQFQEARRKLSQKLRELTEQPPMPARPRWMKCVEETGTFFEPTLAALFVREAFGPSTRSAAMKLFTAIRDALITRLRNLPWMNEETQNMAQDKVAQLQVEMGASEWALKPELARQEYNDIQLGSSFLQSVLSCVRSLRARIVQSFLQPHPQHRWKVSPWDVNAYYSVSDHVVVFPAGLLQPPFFHPGYPRAVNFGAAGSIMAHELLHIFYQLLLPGGCLACDNHALQEAHLCLKRHYAAFPLPSRTSFNDSLTFLENAADVGGLAIALQAYSKRLLRHHGETVLPSLDLSPQQIFFRSYAQVMCRKPSPQDSHDTHSPPHLRVHGPLSSTPAFARYFRCARGALLNPSSRCQLW

SEQ ID NO: 42923 - protein, 186 aa, Homo sapiens
  Payload ID: 8737
  Gene Symbol: KEL
  Gene Name: Kell blood group, metallo-endopeptidase
  ENSP ID: ENSP00000418886
  MOD_RES (1)..(1): Any amino acid
XQKSCPHWRGGNEGGDQSEEEPRERSQAGGMGTLWSQESTPEERLPVEGSRPWAVARRVLTAILILGLLLCFSVLLFYNFQNCGPRPCETSVCLDLRDHYLASGNTSVAPCTDFFSFACGRAKETNNSFQELATKNKNRLRRILEVQNSWHPGSGEEKAFQFYNSCMDTLAIEAAGTGPLRQVIEE

SEQ ID NO: 42924 - protein, 184 aa, Homo sapiens
  Payload ID: 8737
  Gene Symbol: KEL
  Gene Name: Kell blood group, metallo-endopeptidase
  ENSP ID: ENSP00000419889
MEGGDQSEEEPRERSQAGGMGTLWSQESTPEERLPVEGSRPWAVARRVLTAILILGLLLCFSVLLFYNFQNCGPRPCETSVCLDLRDHYLASGNTSVAPCTDFFSFACGRAKETNNSFQELATKNKNRLRRILEVQNSWHPGSGEEKAFQFYNSCMDTLAIEAAGTGPLRQVIEEIFREYLTYL

SEQ ID NO: 42925 - protein, 204 aa, Homo sapiens
  Payload ID: 8737
  Gene Symbol: KEL
  Gene Name: Kell blood group, metallo-endopeptidase
  ENSP ID: ENSP00000420011
MGTLWSQESTPEERLPVEGSRPWAVARRVLTAILILGLLLCFSVLLFYNFQNCGPRPCETSVCLDLRDHYLASGNTSVAPCTDFFSFACGRAKETNNSFQELATKNKNRLRRILEVQNSWHPGSGEEKAFQFYNSCMDTLAIEAAGTGPLRQVIEELGGWRISGKWTSLNFNRTLRLLMSQYGHFPFFRAYLGPHPASPHTPVI

SEQ ID NO: 42926 - protein, 732 aa, Homo sapiens; identical to SEQ ID NO: 42922
  Payload ID: 8737
  Gene Symbol: KEL
  Gene Name: Kell blood group, metallo-endopeptidase
  Uniprot ID: P23276
  ENSP ID: ENSP00000477793

SEQ ID NO: 42927 - protein, 186 aa, Homo sapiens; identical to SEQ ID NO: 42923
  Payload ID: 8737
  Gene Symbol: KEL
  Gene Name: Kell blood group, metallo-endopeptidase
  ENSP ID: ENSP00000488333
  MOD_RES (1)..(1): Any amino acid

SEQ ID NO: 42928 - protein, 204 aa, Homo sapiens; identical to SEQ ID NO: 42925
  Payload ID: 8737
  Gene Symbol: KEL
  Gene Name: Kell blood group, metallo-endopeptidase
  ENSP ID: ENSP00000488564

SEQ ID NO: 42929 - protein, 184 aa, Homo sapiens; identical to SEQ ID NO: 42924
  Payload ID: 8737
  Gene Symbol: KEL
  Gene Name: Kell blood group, metallo-endopeptidase
  ENSP ID: ENSP00000488896

SEQ ID NO: 42930 - protein, 644 aa, Homo sapiens
  Payload ID: 8738
  Gene Symbol: KRT1
  Gene Name: keratin 1, type II
  Uniprot ID: P04264
  ENSP ID: ENSP00000252244
MSRQFSSRSGYRSGGGFSSGSAGIINYQRRTTSSSTRRSGGGGGRFSSCGGGGGSFGAGGGFGSRSLVNLGGSKSISISVARGGGRGSGFGGGYGGGGFGGGGFGGGGFGGGGIGGGGFGGFGSGGGGFGGGGFGGGGYGGGYGPVCPPGGIQEVTINQSLLQPLNVEIDPEIQKVKSREREQIKSLNNQFASFIDKVRFLEQQNQVLQTKWELLQQVDTSTRTHNLEPYFESFINNLRRRVDQLKSDQSRLDSELKNMQDMVEDYRNKYEDEINKRTNAENEFVTIKKDVDGAYMTKVDLQAKLDNLQQEIDFLTALYQAELSQMQTQISETNVILSMDNNRSLDLDSIIAEVKAQYEDIAQKSKAEAESLYQSKYEELQITAGRHGDSVRNSKIEISELNRVIQRLRSEIDNVKKQISNLQQSISDAEQRGENALKDAKNKLNDLEDALQQAKEDLARLLRDYQELMNTKLALDLEIATYRTLLEGEESRMSGECAPNVSVSVSTSHTTISGGGSRGGGGGGYGSGGSSYGSGGGSYGSGGGGGGGRGSYGSGGSSYGSGGGSYGSGGGGGGHGSYGSGSSSGGYRGGSGGGGGGSSGGRGSGGGSSGGSIGGRGSSSGGVKSSGGSSSVKFVSTTYSGVTR

SEQ ID NO: 42931 - protein, 584 aa, Homo sapiens
  Payload ID: 8739
  Gene Symbol: KRT10
  Gene Name: keratin 10, type I
  Uniprot ID: P13645
  ENSP ID: ENSP00000269576
MSVRYSSSKHYSSSRSGGGGGGGGCGGGGGVSSLRISSSKGSLGGGFSSGGFSGGSFSRGSSGGGCFGGSSGGYGGLGGFGGGSFRGSYGSSSFGGSYGGIFGGGSFGGGSFGGGSFGGGGFGGGGFGGGFGGGFGGDGGLLSGNEKVTMQNLNDRLASYLDKVRALEESNYELEGKIKEWYEKHGNSHQGEPRDYSKYYKTIDDLKNQILNLTTDNANILLQIDNARLAADDFRLKYENEVALRQSVEADINGLRRVLDELTLTKADLEMQIESLTEELAYLKKNHEEEMKDLRNVSTGDVNVEMNAAPGVDLTQLLNNMRSQYEQLAEQNRKDAEAWFNEKSKELTTEIDNNIEQISSYKSEITELRRNVQALEIELQSQLALKQSLEASLAETEGRYCVQLSQIQAQISALEEQLQQIRAETECQNTEYQQLLDIKIRLENEIQTYRSLLEGEGSSGGGGRGGGSFGGGYGGGSSGGGSSGGGHGGGHGGSSGGGYGGGSSGGGSSGGGYGGGSSSGGHGGSSSGGYGGGSSGGGGGGYGGGSSGGGSSSGGGYGGGSSSGGHKSSSSGSVGESSSKGPRY

SEQ ID NO: 42932 - protein, 494 aa, Homo sapiens
  Payload ID: 8740
  Gene Symbol: KRT12
  Gene Name: keratin 12, type I
  Uniprot ID: Q99456
  ENSP ID: ENSP00000251643
MDLSNNTMSLSVRTPGLSRRLSSQSVIGRPRGMSASSVGSGYGGSAFGFGASCGGGFSAASMFGSSSGFGGGSGSSMAGGLGAGYGRALGGGSFGGLGMGFGGSPGGGSLGILSGNDGGLLSGSEKETMQNLNDRLASYLDKVRALEEANTELENKIREWYETRGTGTADASQSDYSKYYPLIEDLRNKIISASIGNAQLLLQIDNARLAAEDFRMKYENELALRQGVEADINGLRRVLDELTLTRTDLEMQIESLNEELAYMKKNHEDELQSFRVGGPGEVSVEMDAAPGVDLTRLLNDMRAQYETIAEQNRKDAEAWFIEKSGELRKEISTNTEQLQSSKSEVTDLRRAFQNLEIELQSQLAMKKSLEDSLAEAEGDYCAQLSQVQQLISNLEAQLLQVRADAERQNVDHQRLLNVKARLELEIETYRRLLDGEAQGDGLEESLFVTDSKSQAQSTDSSKDPTKTRKIKTVVQEMVNGEVVSSQVQEIEELM

SEQ ID NO: 42933 - protein, 494 aa, Homo sapiens; identical to SEQ ID NO: 42932
  Payload ID: 8740
  Gene Symbol: KRT12
  Gene Name: keratin 12, type I
  Uniprot ID: Q99456
  ENSP ID: ENSP00000459559

SEQ ID NO: 42934 - protein, 458 aa, Homo sapiens
  Payload ID: 8741
  Gene Symbol: KRT13
  Gene Name: keratin 13, type I
  Uniprot ID: P13646
  ENSP ID: ENSP00000246635
MSLRLQSSSASYGGGFGGGSCQLGGGRGVSTCSTRFVSGGSAGGYGGGVSCGFGGGAGSGFGGGYGGGLGGGYGGGLGGGFGGGFAGGFVDFGACDGGLLTGNEKITMQNLNDRLASYLEKVRALEEANADLEVKIRDWHLKQSPASPERDYSPYYKTIEELRDKILTATIENNRVILEIDNARLAADDFRLKYENELALRQSVEADINGLRRVLDELTLSKTDLEMQIESLNEELAYMKKNHEEEMKEFSNQVVGQVNVEMDATPGIDLTRVLAEMREQYEAMAERNRRDAEEWFHTKSAELNKEVSTNTAMIQTSKTEITELRRTLQGLEIELQSQLSMKAGLENTVAETECRYALQLQQIQGLISSIEAQLSELRSEMECQNQEYKMLLDIKTRLEQEIATYRSLLEGQDAKMIGFPSSAGSVSPRSTSVTTTSSASVTTTSNASGRRTSDVRRP

SEQ ID NO: 42935 - protein, 420 aa, Homo sapiens
  Payload ID: 8741
  Gene Symbol: KRT13
  Gene Name: keratin 13, type I
  Uniprot ID: P13646
  ENSP ID: ENSP00000336604
MSLRLQSSSASYGGGFGGGSCQLGGGRGVSTCSTRFVSGGSAGGYGGGVSCGFGGGAGSGFGGGYGGGLGGGYGGGLGGGFGGGFAGGFVDFGACDGGLLTGNEKITMQNLNDRLASYLEKVRALEEANADLEVKIRDWHLKQSPASPERDYSPYYKTIEELRDKILTATIENNRVILEIDNARLAADDFRLKYENELALRQSVEADINGLRRVLDELTLSKTDLEMQIESLNEELAYMKKNHEEEMKEFSNQVVGQVNVEMDATPGIDLTRVLAEMREQYEAMAERNRRDAEEWFHTKSAELNKEVSTNTAMIQTSKTEITELRRTLQGLEIELQSQLSMKAGLENTVAETECRYALQLQQIQGLISSIEAQLSELRSEMECQNQEYKMLLDIKTRLEQEIATYRSLLEGQDAKKRQPP

SEQ ID NO: 42936 - protein, 165 aa, Homo sapiens
  Payload ID: 8741
  Gene Symbol: KRT13
  Gene Name: keratin 13, type I
  ENSP ID: ENSP00000466465
MQNLNDRLASYLEKVRALEEANADLEVKIRDWHLKQSPASPERDYSPYYKTIEELRDKILTATIENNRVILEIDNARLAADDFRLKYENELALRQSVEADINGLRRVLDELTLSKTDLEMQIESLNEELAYMKKNHEEEMKEFSNQVVGQVNVEMDATPGIDLTR

SEQ ID NO: 42937 - protein, 63 aa, Homo sapiens
  Payload ID: 8741
  Gene Symbol: KRT13
  Gene Name: keratin 13, type I
  ENSP ID: ENSP00000466525
MSLRLQSSSASYGGGFGGGSCQLGGGRGVSTCSTRSPCRTSTTAWLPTWRRCAPWRRPTLTWR

SEQ ID NO: 42938 - protein, 162 aa, Homo sapiens
  Payload ID: 8741
  Gene Symbol: KRT13
  Gene Name: keratin 13, type I
  ENSP ID: ENSP00000467833
MSLRLQSSSASYGGGFGGGSCQLGGGRGVSTCSTRFVSGGSAGGYGGGVSCGFGGGAGSGFGGGYGGGLGGGYGGGLGGGFGGGFAGGFVDFGACDGGLLTGNEKITMQNLNDRLASYLEKVRALEEANADLEMQIESLNEELAYMKKNHEEEMKEFSNQVV

SEQ ID NO: 42939 - protein, 415 aa, Homo sapiens
  Payload ID: 8741
  Gene Symbol: KRT13
  Gene Name: keratin 13, type I
  ENSP ID: ENSP00000468221
MSLRLQSSSASYGGGFGGGSCQLGGGRGVSTCSTRFVSGGSAGGYGGGVSCGFGGGAGSGFGGGYGGGLGGGYGGGLGGGFGGGFAGGFVDFGACDGGLLTGNEKITMQNLNDRLASYLEKVRALEEANADLEVKIRDWHLKQSPASPERDYSPYYKTIEELRDKILTATIENNRVILEIDNARLAADDFRLKYENELALRQSVEADINGLRRVLDELTLSKTDLEMQIESLNEELAYMKKNHEEEMKEFSNQVVGQVNVEMDATPGIDLTRVLAEMREQYEAMAERNRRDAEEWFHTKSAELNKEVSTNTAMIQTSKTEITELRRTLQGLEIELQSQLSMKAGLENTVAETECRYALQLQQIQGLISSIEAQLSELRSEMECQNQEYKMLLDIKTRLEQEIATYRSLLEGQDAK

SEQ ID NO: 42940 - protein, 472 aa, Homo sapiens
  Payload ID: 8742
  Gene Symbol: KRT14
  Gene Name: keratin 14, type I
  Uniprot ID: P02533
  ENSP ID: ENSP00000167586
MTTCSRQFTSSSSMKGSCGIGGGIGGGSSRISSVLAGGSCRAPSTYGGGLSVSSSRFSSGGACGLGGGYGGGFSSSSSSFGSGFGGGYGGGLGAGLGGGFGGGFAGGDGLLVGSEKVTMQNLNDRLASYLDKVRALEEANADLEVKIRDWYQRQRPAEIKDYSPYFKTIEDLRNKILTATVDNANVLLQIDNARLAADDFRTKYETELNLRMSVEADINGLRRVLDELTLARADLEMQIESLKEELAYLKKNHEEEMNALRGQVGGDVNVEMDAAPGVDLSRILNEMRDQYEKMAEKNRKDAEEWFFTKTEELNREVATNSELVQSGKSEISELRRTMQNLEIELQSQLSMKASLENSLEETKGRYCMQLAQIQEMIGSVEEQLAQLRCEMEQQNQEYKILLDVKTRLEQEIATYRRLLEGEDAHLSSSQFSSGSQSSRDVTSSSRQIRTKVMDVHDGKVVSTHEQVLRTKN

SEQ ID NO: 42941 - protein, 456 aa, Homo sapiens
  Payload ID: 8743
  Gene Symbol: KRT15
  Gene Name: keratin 15, type I
  Uniprot ID: P19012
  ENSP ID: ENSP00000254043
MTTTFLQTSSSTFGGGSTRGGSLLAGGGGFGGGSLSGGGGSRSISASSARFVSSGSGGGYGGGMRVCGFGGGAGSVFGGGFGGGVGGGFGGGFGGGDGGLLSGNEKITMQNLNDRLASYLDKVRALEEANADLEVKIHDWYQKQTPTSPECDYSQYFKTIEELRDKIMATTIDNSRVILEIDNARLAADDFRLKYENELALRQGVEADINGLRRVLDELTLARTDLEMQIEGLNEELAYLKKNHEEEMKEFSSQLAGQVNVEMDAAPGVDLTRVLAEMREQYEAMAEKNRRDVEAWFFSKTEELNKEVASNTEMIQTSKTEITDLRRTMQELEIELQSQLSMKAGLENSLAETECRYATQLQQIQGLIGGLEAQLSELRCEMEAQNQEYKMLLDIKTRLEQEIATYRSLLEGQDAKMAGIAIREASSGGGGSSSNFHINVEESVDGQVVSSHKREI

SEQ ID NO: 42942 - protein, 291 aa, Homo sapiens
  Payload ID: 8743
  Gene Symbol: KRT15
  Gene Name: keratin 15, type I
  ENSP ID: ENSP00000377544
MTGTRSRPQPAQNATTANTSRPLKSSGTRYENELALRQGVEADINGLRRVLDELTLARTDLEMQIEGLNEELAYLKKNHEEEMKEFSSQLAGQVNVEMDAAPGVDLTRVLAEMREQYEAMAEKNRRDVEAWFFSKTEELNKEVASNTEMIQTSKTEITDLRRTMQELEIELQSQLSMKAGLENSLAETECRYATQLQQIQGLIGGLEAQLSELRCEMEAQNQEYKMLLDIKTRLEQEIATYRSLLEGQDAKMAGIAIREASSGGGGSSSNFHINVEESVDGQVVSSHKREI

SEQ ID NO: 42943 - protein, 456 aa, Homo sapiens; identical to SEQ ID NO: 42941
  Payload ID: 8743
  Gene Symbol: KRT15
  Gene Name: keratin 15, type I
  Uniprot ID: P19012
  ENSP ID: ENSP00000377546

SEQ ID NO: 42944 - protein, 220 aa, Homo sapiens
  Payload ID: 8743
  Gene Symbol: KRT15
  Gene Name: keratin 15, type I
  ENSP ID: ENSP00000409282
MTGTRSRPQPAQNATTANTSRPLKSSGTRYENELALRQGVEADINGLRRVLDELTLARTDLEMQIEGLNEELAYLKKNHEEEMKEFSSQLAGQVNVEMDAAPGVDLTRVLAEMREQYEAMAEKNRRDVEAWFFSKTEELNKEVASNTEMIQTSKTEITDLRRTMQELEIELQSQLSMKAGLENSLAETECRYATQLQQIQGLIGGLEAQLSELRCEMEAQ

SEQ ID NO: 42945 - protein, 81 aa, Homo sapiens
  Payload ID: 8743
  Gene Symbol: KRT15
  Gene Name: keratin 15, type I
  ENSP ID: ENSP00000466687
MTGTRSRPQPAQNATTANTSRPLKSSGTRSWPPPSTTPGSSWRSTMPGWLRTTSGSSMRMSWPCARALRLTSTACAESWMS

SEQ ID NO: 42946 - protein, 49 aa, Homo sapiens
  Payload ID: 8743
  Gene Symbol: KRT15
  Gene Name: keratin 15, type I
  ENSP ID: ENSP00000467875
MTGTRSRPQPAQNATTANTSRPLKSSGTRLLLAGMFCRSMAVSKVCRRQ

SEQ ID NO: 42947 - protein, 473 aa, Homo sapiens
  Payload ID: 8744
  Gene Symbol: KRT16
  Gene Name: keratin 16, type I
  Uniprot ID: P08779
  ENSP ID: ENSP00000301653
MTTCSRQFTSSSSMKGSCGIGGGIGGGSSRISSVLAGGSCRAPSTYGGGLSVSSRFSSGGACGLGGGYGGGFSSSSSFGSGFGGGYGGGLGAGFGGGLGAGFGGGFAGGDGLLVGSEKVTMQNLNDRLASYLDKVRALEEANADLEVKIRDWYQRQRPSEIKDYSPYFKTIEDLRNKIIAATIENAQPILQIDNARLAADDFRTKYEHELALRQTVEADVNGLRRVLDELTLARTDLEMQIEGLKEELAYLRKNHEEEMLALRGQTGGDVNVEMDAAPGVDLSRILNEMRDQYEQMAEKNRRDAETWFLSKTEELNKEVASNSELVQSSRSEVTELRRVLQGLEIELQSQLSMKASLENSLEETKGRYCMQLSQIQGLIGSVEEQLAQLRCEMEQQSQEYQILLDVKTRLEQEIATYRRLLEGEDAHLSSQQASGQSYSSREVFTSSSSSSSRQTRPILKEQSSSSFSQGQSS

SEQ ID NO: 42948 - protein, 48 aa, Homo sapiens
  Payload ID: 8744
  Gene Symbol: KRT16
  Gene Name: keratin 16, type I
  ENSP ID: ENSP00000467105
MTTCSRQFTSSSSMKGSCGIGGGIGGGSSRISSVLAGGSCRAPSTYGG

SEQ ID NO: 42949 - protein, 162 aa, Homo sapiens
  Payload ID: 8744
  Gene Symbol: KRT16
  Gene Name: keratin 16, type I
  ENSP ID: ENSP00000467124
MQIEGLKEELAYLRKNHEEEMLALRGQTGGDVNVEMDAAPGVDLSRILNEMRDQYEQMAEKNRRDAETWFLSKTEELNKEVASNSELVQSSRSEVTELRRVLQGLEIELQSQLSMKASLENSLEETKGRYCMQLSQIQGLIGSVEEQLAQLRCEMEQQSQEY

SEQ ID NO: 42950 - protein, 432 aa, Homo sapiens
  Payload ID: 8745
  Gene Symbol: KRT17
  Gene Name: keratin 17, type I
  Uniprot ID: Q04695
  ENSP ID: ENSP00000308452
MTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKILTATVDNANILLQIDNARLAADDFRTKFETEQALRLSVEADINGLRRVLDELTLARADLEMQIENLKEELAYLKKNHEEEMNALRGQVGGEINVEMDAAPGVDLSRILNEMRDQYEKMAEKNRKDAEDWFFSKTEELNREVATNSELVQSGKSEISELRRTMQALEIELQSQLSMKASLEGNLAETENRYCVQLSQIQGLIGSVEEQLAQLRCEMEQQNQEYKILLDVKTRLEQEIATYRRLLEGEDAHLTQYKKEPVTTRQVRTIVEEVQDGKVISSREQVHQTTR

SEQ ID NO: 42951 - protein, 349 aa, Homo sapiens
  Payload ID: 8745
  Gene Symbol: KRT17
  Gene Name: keratin 17, type I
  ENSP ID: ENSP00000441751
MAAALGVLMGCWLEVRRPPCRTSMANTELEVKIRDWYQRQAPGPARDYSQYYRTIEELQNKILTATVDNANILLQIDNARLAADDFRTKFETEQALRLSVEADINGLRRVLDELTLARADLEMQIENLKEELAYLKKNHEEEMNALRGQVGGEINVEMDAAPGVDLSRILNEMRDQYEKMAEKNRKDAEDWFFSKTEELNREVATNSELVQSGKSEISELRRTMQALEIELQSQLSMKASLEGNLAETENRYCVQLSQIQGLIGSVEEQLAQLRCEMEQQNQEYKILLDVKTRLEQEIATYRRLLEGEDAHLTQYKKEPVTTRQVRTIVEEVQDGKVISSREQVHQTTR

SEQ ID NO: 42952 - protein, 49 aa, Homo sapiens
  Payload ID: 8745
  Gene Symbol: KRT17
  Gene Name: keratin 17, type I
  ENSP ID: ENSP00000466166
MQIENLKEELAYLKKNHEEMNALRGQVGGEINVEMDAAPGVDLSRILNE

SEQ ID NO: 42953 - protein, 231 aa, Homo sapiens
  Payload ID: 8745
  Gene Symbol: KRT17
  Gene Name: keratin 17, type I
  ENSP ID: ENSP00000467418
GSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKILTATVDNANILLQIDNARLAADDFRTKVLDELTLARADLEMQIENLKEELAYLKKNHEEEMNALRGQVGGEINVEMDAAPGVDLSRILNEMRDQYEKMAEK

SEQ ID NO: 42954 - protein, 95 aa, Homo sapiens
  Payload ID: 8745
  Gene Symbol: KRT17
  Gene Name: keratin 17, type I
  ENSP ID: ENSP00000468672
MQIENLKEELAYLKKNHEEEMNALRGQVGGEINVEMDAAPGVDLSRILNEMRDQYEKMAEKNRKDAEDWFFSKTEELNREVATNSELVQSGKSEI

SEQ ID NO: 42955 - protein, 430 aa, Homo sapiens
  Payload ID: 8746
  Gene Symbol: KRT18
  Gene Name: keratin 18, type I
  Uniprot ID: P05783
  ENSP ID: ENSP00000373487
MSFTTRSTFSTNYRSLGSVQAPSYGARPVSSAASVYAGAGGSGSRISVSRSTSFRGGMGSGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVIDDTNITRLQLETEIEALKEELLFMKKNHEEEVKGLQAQIASSGLTVEVDAPKSQDLAKIMADIRAQYDELARKNREELDKYWSQQIEESTTVVTTQSAEVGAAETTLTELRRTVQSLEIDLDSMRNLKASLENSLREVEARYALQMEQLNGILLHLESELAQTRAEGQRQAQEYEALLNIKVKLEAEIATYRRLLEDGEDFNLGDALDSSNSMQTIQKTTTRRIVDGKVVSETNDTKVLRH

SEQ ID NO: 42956 - protein, 430 aa, Homo sapiens; identical to SEQ ID NO: 42955
  Payload ID: 8746
  Gene Symbol: KRT18
  Gene Name: keratin 18, type I
  Uniprot ID: P05783
  ENSP ID: ENSP00000373489

SEQ ID NO: 42957 - protein, 391 aa, Homo sapiens
  Payload ID: 8746
  Gene Symbol: KRT18
  Gene Name: keratin 18, type I
  ENSP ID: ENSP00000447278
MSFTTRSTFSTNYRSLGSVQAPSYGARPVSSAASVYAGAGGSGSRISVSRSTSFRGGMGSGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVIDDTNITRLQLETEIEALKEELLFMKKNHEEEVKGLQAQIASSGLTVEVDAPKSQDLAKIMADIRAQYDELARKNREELDKYWSQQIEESTTVVTTQSAEVGAAETTLTELRRTVQSLEIDLDSMRNLKASLENSLREVEARYALQMEQLNGILLHLESELAQTRAEGQRQAQEYEALLNIKVKLEAEIATYRRLLEDGEDFK

SEQ ID NO: 42958 - protein, 400 aa, Homo sapiens
  Payload ID: 8747
  Gene Symbol: KRT19
  Gene Name: keratin 19, type I
  Uniprot ID: P08727
  ENSP ID: ENSP00000355124
MTSYSYRQSSATSSFGGLGGGSVRFGPGVAFRAPSIHGGSGGRGVSVSSARFVSSSSSGAYGGGYGGVLTASDGLLAGNEKLTMQNLNDRLASYLDKVRALEAANGELEVKIRDWYQKQGPGPSRDYSHYYTTIQDLRDKILGATIENSRIVLQIDNARLAADDFRTKFETEQALRMSVEADINGLRRVLDELTLARTDLEMQIEGLKEELAYLKKNHEEEISTLRGQVGGQVSVEVDSAPGTDLAKILSDMRSQYEVMAEQNRKDAEAWFTSRTEELNREVAGHTEQLQMSRSEVTDLRRTLQGLEIELQSQLSMKAALEDTLAETEARFGAQLAHIQALISGIEAQLGDVRADSERQNQEYQRLMDIKSRLEQEIATYRSLLEGQEDHYNNLSASKVL

SEQ ID NO: 42959 - protein, 196 aa, Homo sapiens
  Payload ID: 8747
  Gene Symbol: KRT19
  Gene Name: keratin 19, type I
  ENSP ID: ENSP00000408759
MTSYSYRQSSATSSFGGLGGGSVRFGPGVAFRAPSIHGGSGGRGVSVSSARFVSSSSSGAYGGGYGGVLTASDGLLAGNEKLTMQNLNDRLASYLDKVRALEAANGELEILGATIENSRIVLQIDNARLAADDFRTKFETEQALRMSVEADINGLRRVLDELTLARTDLEMQIEGLKEELAYLKKNHEEEISTLRG

SEQ ID NO: 42960 - protein, 181 aa, Homo sapiens
  Payload ID: 8747
  Gene Symbol: KRT19
  Gene Name: keratin 19, type I
  ENSP ID: ENSP00000466625
MSVEADINGLRRVLDELTLARTDLEMQIEGLKEELAYLKKNHEEEISTLRGQVGGQVSVEVDSAPGTDLAKILSDMRSQYEVMAEQNRKDAEAWFTSRTEELNREVAGHTEQLQMSRSEVTDLRRTLQGLEIELQSQLSMKAALEDTLAETEARFGAQLAHIQALISGIEAQLGDVRADSE

SEQ ID NO: 42961 - protein, 639 aa, Homo sapiens
  Payload ID: 8748
  Gene Symbol: KRT2
  Gene Name: keratin 2, type II
  Uniprot ID: P35908
  ENSP ID: ENSP00000310861
MSCQISCKSRGRGGGGGGFRGFSSGSAVVSGGSRRSTSSFSCLSRHGGGGGGFGGGGFGSRSLVGLGGTKSISISVAGGGGGFGAAGGFGGRGGGFGGGSSFGGGSGFSGGGFGGGGFGGGRFGGFGGPGGVGGLGGPGGFGPGGYPGGIHEVSVNQSLLQPLNVKVDPEIQNVKAQEREQIKTLNNKFASFIDKVRFLEQQNQVLQTKWELLQQMNVGTRPINLEPIFQGYIDSLKRYLDGLTAERTSQNSELNNMQDLVEDYKKKYEDEINKRTAAENDFVTLKKDVDNAYMIKVELQSKVDLLNQEIEFLKVLYDAEISQIHQSVTDTNVILSMDNSRNLDLDSIIAEVKAQYEEIAQRSKEEAEALYHSKYEELQVTVGRHGDSLKEIKIEISELNRVIQRLQGEIAHVKKQCKNVQDAIADAEQRGEHALKDARNKLNDLEEALQQAKEDLARLLRDYQELMNVKLALDVEIATYRKLLEGEECRMSGDLSSNVTVSVTSSTISSNVASKAAFGGSGGRGSSSGGGYSSGSSSYGSGGRQSGSRGGSGGGGSISGGGYGSGGGSGGRYGSGGGSKGGSISGGGYGSGGGKHSSGGGSRGGSSSGGGYGSGGGGSSSVKGSSGEAFGSSVTFSFR

SEQ ID NO: 42962 - protein, 424 aa, Homo sapiens
  Payload ID: 8749
  Gene Symbol: KRT20
  Gene Name: keratin 20, type I
  Uniprot ID: P35900
  ENSP ID: ENSP00000167588
MDFSRRSFHRSLSSSLQAPVVSTVGMQRLGTTPSVYGGAGGRGIRISNSRHTVNYGSDLTGGGDLFVGNEKMAMQNLNDRLASYLEKVRTLEQSNSKLEVQIKQWYETNAPRAGRDYSAYYRQIEELRSQIKDAQLQNARCVLQIDNAKLAAEDFRLKYETERGIRLTVEADLQGLNKVFDDLTLHKTDLEIQIEELNKDLALLKKEHQEEVDGLHKHLGNTVNVEVDAAPGLNLGVIMNEMRQKYEVMAQKNLQEAKEQFERQTAVLQQQVTVNTEELKGTEVQLTELRRTSQSLEIELQSHLSMKESLEHTLEETKARYSSQLANLQSLLSSLEAQLMQIRSNMERQNNEYHILLDIKTRLEQEIATYRRLLEGEDVKTTEYQLSTLEERDIKKTRKIKTVVQEVVDGKVVSSEVKEVEENI

SEQ ID NO: 42963 - protein, 424 aa, Homo sapiens; identical to SEQ ID NO: 42962
  Payload ID: 8749
  Gene Symbol: KRT20
  Gene Name: keratin 20, type I
  Uniprot ID: P35900
  ENSP ID: ENSP00000460501

SEQ ID NO: 42964 - protein, 58 aa, Homo sapiens
  Payload ID: 8750
  Gene Symbol: KRT222
  Gene Name: keratin 222, type II
  ENSP ID: ENSP00000377613
MELSQLLNEIRANYEKILTRNQIETVLSTRIQVMISYRQAPSRIRRQSMSTQFLSRPL

SEQ ID NO: 42965 - protein, 295 aa, Homo sapiens
  Payload ID: 8750
  Gene Symbol: KRT222
  Gene Name: keratin 222, type II
  Uniprot ID: Q8N1A0
  ENSP ID: ENSP00000377616
MELSQLLNEIRANYEKILTRNQIETVLSTRIQLEEDISKKMDKDEEALKAAQAELKEARRQWHHLQVEIESLHAVERGLENSLHASEQHYQMQLQDLETVIEGLEKELQEVRRGIEKQLQEHEMLLNTKMRLEQEIATYRHLLEKEEIRYYGCIQGGKKDKKPTTSRVGFVLPSAIINEISFTTKVPQKYENENVETVTKQAILNGSIVKESTEAHGTIQTEKVDEVIKEWEGSFFKDNPRLRKKSVSLRFDLHLAATDEGCLETKQDNLPDIEVRLIMRRSCSIPSIKPPSTAN

SEQ ID NO: 42966 - protein, 58 aa, Homo sapiens; identical to SEQ ID NO: 42964
  Payload ID: 8750
  Gene Symbol: KRT222
  Gene Name: keratin 222, type II
  ENSP ID: ENSP00000463865

SEQ ID NO: 42967 - protein, 58 aa, Homo sapiens; identical to SEQ ID NO: 42964
  Payload ID: 8750
  Gene Symbol: KRT222
  Gene Name: keratin 222, type II
  ENSP ID: ENSP00000464647

SEQ ID NO: 42968 - protein, 422 aa, Homo sapiens
  Payload ID: 8751
  Gene Symbol: KRT23
  Gene Name: keratin 23, type I
  Uniprot ID: Q9C075
  ENSP ID: ENSP00000209718
MNSGHSFSQTPSASFHGAGGGWGRPRSFPRAPTVHGGAGGARISLSFTTRSCPPPGGSWGSGRSSPLLGGNGKATMQNLNDRLASYLEKVRALEEANMKLESRILKWHQQRDPGSKKDYSQYEENITHLQEQIVDGKMTNAQIILLIDNARMAVDDFNLKYENEHSFKKDLEIEVEGLRRTLDNLTIVTTDLEQEVEGMRKELILMKKHHEQEMEKHHVPSDFNVNVKVDTGPREDLIKVLEDMRQEYELIIKKKHRDLDTWYKEQSAAMSQEAASPATVQSRQGDIHELKRTFQALEIDLQTQYSTKSALENMLSETQSRYSCKLQDMQEIISHYEEELTQLRHELERQNNEYQVLLGIKTHLEKEITTYRRLLEGESEGTREESKSSMKVSATPKIKAITQETINGRLVLCQVNEIQKHA

SEQ ID NO: 42969 - protein, 285 aa, Homo sapiens
  Payload ID: 8751
  Gene Symbol: KRT23
  Gene Name: keratin 23, type I
  Uniprot ID: Q9C075
  ENSP ID: ENSP00000414056
MTNAQIILLIDNARMAVDDFNLKYENEHSFKKDLEIEVEGLRRTLDNLTIVTTDLEQEVEGMRKELILMKKHHEQEMEKHHVPSDFNVNVKVDTGPREDLIKVLEDMRQEYELIIKKKHRDLDTWYKEQSAAMSQEAASPATVQSRQGDIHELKRTFQALEIDLQTQYSTKSALENMLSETQSRYSCKLQDMQEIISHYEEELTQLRHELERQNNEYQVLLGIKTHLEKEITTYRRLLEGESEGTREESKSSMKVSATPKIKAITQETINGRLVLCQVNEIQKHA

SEQ ID NO: 42970 - protein, 422 aa, Homo sapiens; identical to SEQ ID NO: 42968
  Payload ID: 8751
  Gene Symbol: KRT23
  Gene Name: keratin 23, type I
  Uniprot ID: Q9C075
  ENSP ID: ENSP00000459021

SEQ ID NO: 42971 - protein, 285 aa, Homo sapiens; identical to SEQ ID NO: 42969
  Payload ID: 8751
  Gene Symbol: KRT23
  Gene Name: keratin 23, type I
  Uniprot ID: Q9C075
  ENSP ID: ENSP00000460637

SEQ ID NO: 42972 - protein, 37 aa, Homo sapiens
  Payload ID: 8751
  Gene Symbol: KRT23
  Gene Name: keratin 23, type I
  ENSP ID: ENSP00000462335
MTNAQIILLIDNARMAVDDFNLKKWRSIMCQVTSMSM

SEQ ID NO: 42973 - protein, 149 aa, Homo sapiens
  Payload ID: 8751
  Gene Symbol: KRT23
  Gene Name: keratin 23, type I
  ENSP ID: ENSP00000462422
GKATMQNLNDRLASYLEKVRALEEANMKLESRILKWHQQRDPGSKKDYSQYEENITHLQEQIVDGKMTNAQIILLIDNARMAVDDFNLKYENEHSFKKDLEIEVEGLRRTLDNLTIVTTDLEQEVEGMRKELILMKKHHEQVQLPRNTC

SEQ ID NO: 42974 - protein, 37 aa, Homo sapiens; identical to SEQ ID NO: 42972
  Payload ID: 8751
  Gene Symbol: KRT23
  Gene Name: keratin 23, type I
  ENSP ID: ENSP00000462542

SEQ ID NO: 42975 - protein, 37 aa, Homo sapiens; identical to SEQ ID NO: 42972
  Payload ID: 8751
  Gene Symbol: KRT23
  Gene Name: keratin 23, type I
  ENSP ID: ENSP00000463052

SEQ ID NO: 42976 - protein, 149 aa, Homo sapiens; identical to SEQ ID NO: 42973
  Payload ID: 8751
  Gene Symbol: KRT23
  Gene Name: keratin 23, type I
  ENSP ID: ENSP00000464051

SEQ ID NO: 42977 - protein, 37 aa, Homo sapiens; identical to SEQ ID NO: 42972
  Payload ID: 8751
  Gene Symbol: KRT23
  Gene Name: keratin 23, type I
  ENSP ID: ENSP00000464548

SEQ ID NO: 42978 - protein, 52 aa, Homo sapiens
  Payload ID: 8751
  Gene Symbol: KRT23
  Gene Name: keratin 23, type I
  ENSP ID: ENSP00000467393
MNSGHSFSQTPSASFHGAGGGWGRPRSFPRAPTVHGGAGGARISLSFTTRSC

SEQ ID NO: 42979 - protein, 52 aa, Homo sapiens; identical to SEQ ID NO: 42978
  Payload ID: 8751
  Gene Symbol: KRT23
  Gene Name: keratin 23, type I
  ENSP ID: ENSP00000468798

SEQ ID NO: 42980 - protein, 525 aa, Homo sapiens
  Payload ID: 8752
  Gene Symbol: KRT24
  Gene Name: keratin 24, type I
  Uniprot ID: Q2M2I5
  ENSP ID: ENSP00000264651
MSCSSRASSSRAGGSSSARVSAGGSSFSSGSRCGLGGSSAQGFRGGASSCSLSGGSSGAFGGSFGGGFGSCSVGGGFGGASGSGTGFGGGSSFGGVSGFGRGSGFCGSSRFSSGATGGFYSYGGGMGGGVGDGGLFSGGEKQTMQNLNDRLANYLDKVRALEEANTDLENKIKEWYDKYGPGSGDGGSGRDYSKYYSIIEDLRNQIIAATVENAGIILHIDNARLAADDFRLKYENELCLRQSVEADINGLRKVLDDLTMTRSDLEMQIESFTEELAYLRKNHEEEMKNMQGSSGGEVTVEMNAAPGTDLTKLLNDMRAQYEELAEQNRREAEERFNKQSASLQAQISTDAGAATSAKNEITELKRTLQALEIELQSQLAMKSSLEGTLADTEAGYVAQLSEIQTQISALEEEICQIWGETKCQNAEYKQLLDIKTRLEVEIETYRRLLDGEGGGSSFAEFGGRNSGSVNMGSRDLVSGDSRSGSCSGQGRDSSKTRVTKTIVEELVDGKVVSSQVSSISEVKVK

SEQ ID NO: 42981 - protein, 450 aa, Homo sapiens
  Payload ID: 8753
  Gene Symbol: KRT25
  Gene Name: keratin 25, type I
  Uniprot ID: Q7Z3Z0
  ENSP ID: ENSP00000310573
MSLRLSSASRRSCPRPTTGSLRLYGGGTSFGTGNSCGISGIGSGFSSAFGGSSSGGNTGGGNPCAGFTVNERGLLSGNEKVTMQNLNDRLASYLDSVHALEEANADLEQKIKGWYEKFGPGSCRGLDHDYSRYFPIIDDLKNQIIASTTSNANAVLQIDNARLTADDFRLKYENELALHQSVEADVNGLRRVLDEITLCRTDLEIQYETLSEEMTYLKKNHKEEMQVLQCAAGGNVNVEMNAAPGVDLTVLLNNMRAEYEALAEQNRRDAEAWFNEKSASLQQQISEDVGATTSARNELTEMKRTLQTLEIELQSLLATKHSLECSLTETESNYCAQLAQIQAQIGALEEQLHQVRTETEGQKLEYEQLLDIKLHLEKEIETYCLLIGGDDGACKSGGYKSKDYGSGNVGSQVKDPAKAIVVKKVLEEVDQRSKILTTRLHSLEEKSQSN

SEQ ID NO: 42982 - protein, 468 aa, Homo sapiens
  Payload ID: 8754
  Gene Symbol: KRT26
  Gene Name: keratin 26, type I
  Uniprot ID: Q7Z3Y9
  ENSP ID: ENSP00000334798
MSFRLSGGSRRICSRTGSGRLSGGGTGFVAGNVCVGSGARSSFSCTLEGISSGGSFCNSGGGLGSGACAGFLGNEHSLLSGNEKVTMQNLNDRLASYLDHVHALEEANADLEQKIKGWYEKCEPGSSREHDHDYSRYFSVIEDLKRQIISATICNASIVLQNDNARLTADDFRLKYENELALHHSVEADTSGLRRVLDELTLCTTDLEIQCETLSEELTYLKKSHEEEMEVLQYTAGGNVNVEMNATPGVDLTVLLNNMRAEYEDLAEQNRKDAEAWFNERSATLQQQISDHEGAATAARNELTELKRNLQTLEIELQSLMAVKHSYECSLAETEGNYCNQLQQIQDQIGVMEEQLQQIRTETEGQKLEYEQLLDVKIFLEKEIDIYCNLLDGEERKSKSTCYKSKGYRPVNSGNQAKDSTEETIVKTVVEELDQIGNLLSLRVHSVEEKSSKISNITVEQRVPSKAP

SEQ ID NO: 42983 - protein, 459 aa, Homo sapiens
  Payload ID: 8755
  Gene Symbol: KRT27
  Gene Name: keratin 27, type I
  Uniprot ID: Q7Z3Y8
  ENSP ID: ENSP00000301656
MSVRFSSTSRRLGSCGGTGSVRLSSGGAGFGAGNTCGVPGIGSGFSCAFGGSSSAGGYGGGLGGGSASCAAFTGNEHGLLSGNEKVTMQNLNDRLASYLENVRALEEANADLEQKIKGWYEKFGPGSCRGLDHDYSRYFPIIDELKNQIISATTSNAHVVLQNDNARLTADDFRLKFENELALHQSVEADINGLRRVLDELTLCRTDLEIQLETLSEELAYLKKNHEEEMKALQCAAGGNVNVEMNAAPGVDLTVLLNNMRAEYEALAEQNRRDAEAWFNEKSASLQQQISDDAGATTSARNELIEMKRTLQTLEIELQSLLATKHSLECSLTETESNYCAQLAQIQAQIGALEEQLHQVRTETEGQKLEYEQLLDIKVHLEKEIETYCLLIDGEDGSCSKSKGYGGPGNQTKDSSKTTIVKTVVEEIDPRGKVLSSRVHTVEEKSTKVNNKNEQRVSS

SEQ ID NO: 42984 - protein, 464 aa, Homo sapiens
  Payload ID: 8756
  Gene Symbol: KRT28
  Gene Name: keratin 28, type I
  Uniprot ID: Q7Z3Y7
  ENSP ID: ENSP00000305263
MSLQFSNGSRHVCLRSGAGSVRPLNGGAGFAGSSACGGSVAGSEFSCALGGGLGSVPGGSHAGGALGNAACIGFAGSEGGLLSGNEKVTMQNLNDRLASYLDNVRALEEANAELERKIKGWYEKYGPGSCRGLDHDYSRYHLTIEDLKNKIISSTTTNANVILQIDNARLAADDFRLKYENELTLHQNVEADINGLRRVLDELTLCRTDQELQYESLSEEMTYLKKNHEEEMKALQCAAGGNVNVEMNAAPGVDLAVLLNNMRAEYEALAEQNRKDAEAWFNEKSASLQQQISHDSGAATFARSQLTEMRRTLQTLEIQLQSLMATKHSLECSLTETESNYCTQLAQIQAQIGALEEQLHQVRTETEGQKLEYEHLLDVKVHLEKEIETYCRLIDGDGNSCSKSKGFGSGSPGNSSKDLSKTTLVKTVVEELDQRGKVLSSRIHSIEEKTSKMTNGKTEQRVPF

SEQ ID NO: 42985 - protein, 628 aa, Homo sapiens
  Payload ID: 8757
  Gene Symbol: KRT3
  Gene Name: keratin 3, type II
  Uniprot ID: P12035
  ENSP ID: ENSP00000413479
MSRQASKTSGGGSQGFSGRSAVVSGSSRMSCVAHSGGAGGGAYGFRSGAGGFGSRSLYNLGGNKSISISVAAGGSRAGGFGGGRSSCAFAGGYGGGFGSGYGGGFGGGFGGGRGMGGGFGGAGGFGGAGGFGGAGGFGGPGGFGGSGGFGGPGSLGSPGGFGPGGFPGGIQEVTINQSLLQPLNVEIDPQIGQVKAQEREQIKTLNNKFASFIDKVRFLEQQNKVLETKWNLLQQQGTSSISGTNNLEPLFENHINYLRSYLDNILGERGRLDSELKNMEDLVEDFKKKYEDEINKRTAAENEFVTLKKDVDSAYMNKVELQAKVDALIDEIDFLRTLYDAELSQMQSHISDTSVVLSMDNNRSLDLDSIIAEVRAQYEDIAQRSKAEAEALYQTKLGELQTTAGRHGDDLRNTKSEIIELNRMIQRLRAEIEGVKKQNANLQTAIAEAEQHGEMALKDANAKLQELQAALQQAKDDLARLLRDYQELMNVKLALDVEIATYRKLLEGEEYRMSGECPSAVSISVVSSSTTSASAGGYGGGYGGGMGGGLGGGFSAGGGSGSGFGRGGGGGIGGGFGGGSSGFSGGSGFGSISGARYGVSGGGFSSASNRGGSIKFSQSSQSSQRYSR

SEQ ID NO: 42986 - protein, 416 aa, Homo sapiens [sequence omitted]

SEQ ID NO: 42987 - protein, 416 aa, Homo sapiens [sequence omitted]

SEQ ID NO: 42988 - protein, 448 aa, Homo sapiens
  Payload ID: 8759
  Gene Symbol: KRT32
  Gene Name: keratin 32, type I
  Uniprot ID: Q14532
  ENSP ID: ENSP00000225899
MTSSCCVTNNLQASLKSCPRPASVCSSGVNCRPELCLGYVCQPMACLPSVCLPTTFRPASCLSKTYLSSSCQAASGISGSMGPGSWYSEGAFNGNEKETMQFLNDRLASYLTRVRQLEQENAELESRIQEASHSQVLTMTPDYQSHFRTIEELQQKILCTKAENARMVVNIDNAKLAADDFRAKYEAELAMRQLVEADINGLRRILDDLTLCKADLEAQVESLKEELMCLKKNHEEEVGSLRCQLGDRLNIEVDAAPPVDLTRVLEEMRCQYEAMVEANRRDVEEWFNMQMEELNQQVATSSEQLQNYQSDIIDLRRTVNTLEIELQAQHSLRDSLENTLTESEARYSSQLAQMQCMITNVEAQLAEIRADLERQNQEYQVLLDVRARLEGEINTYRSLLENEDCKLPCNPCSTPSCTTCVPSPCVPRTVCVPRTVGMPCSPCPQGRY

SEQ ID NO: 42989 - protein, 404 aa, Homo sapiens
  Payload ID: 8760
  Gene Symbol: KRT33A
  Gene Name: keratin 33A, type I
  Uniprot ID: O76009
  ENSP ID: ENSP00000007735
MSYSCGLPSLSCRTSCSSRPCVPPSCHGCTLPGACNIPANVSNCNWFCEGSFNGSEKETMQFLNDRLASYLEKVRQLERDNAELENLIRERSQQQEPLVCASYQSYFKTIEELQQKILCSKSENARLVVQIDNAKLASDDFRTKYETELSLRQLVESDINGLRRILDELTLCRSDLEAQVESLKEELLCLKQNHEQEVNTLRCQLGDRLNVEVDAAPTVDLNQVLNETRSQYEALVETNRREVEQWFATQTEELNKQVVSSSEQLQSYQAEIIELRRTVNALEIELQAQHNLRDSLENTLTESEARYSSQLSQVQRLITNVESQLAEIRSDLERQNQEYQVLLDVRARLECEINTYRSLLESEDCKLPSNPCATTNACDKSTGPCISNPCGLRARCGPCNTFGY

SEQ ID NO: 42990 - protein, 404 aa, Homo sapiens; identical to SEQ ID NO: 42989
  Payload ID: 8760
  Gene Symbol: KRT33A
  Gene Name: keratin 33A, type I
  Uniprot ID: O76009
  ENSP ID: ENSP00000461221

SEQ ID NO: 42991 - protein, 404 aa, Homo sapiens
  Payload ID: 8761
  Gene Symbol: KRT33B
  Gene Name: keratin 33B, type I
  Uniprot ID: Q14525
  ENSP ID: ENSP00000251646
MPYNFCLPSLSCRTSCSSRPCVPPSCHGYTLPGACNIPANVSNCNWFCEGSFNGSEKETMQFLNDRLASYLEKVRQLERDNAELENLIRERSQQQEPLLCPSYQSYFKTIEELQQKILCSKSENARLVVQIDNAKLAADDFRTKYQTEQSLRQLVESDINSLRRILDELTLCRSDLEAQMESLKEELLSLKQNHEQEVNTLRCQLGDRLNVEVDAAPAVDLNQVLNETRNQYEALVETNRREVEQWFATQTEELNKQVVSSSEQLQSYQAEIIELRRTVNALEIELQAQHNLRYSLENTLTESEARYSSQLSQVQSLITNVESQLAEIRSDLERQNQEYQVLLDVRARLECEINTYRSLLESEDCKLPSNPCATTNACEKPIGSCVTNPCGPRSRCGPCNTFGY

SEQ ID NO: 42992 - protein, 404 aa, Homo sapiens; identical to SEQ ID NO: 42991
  Payload ID: 8761
  Gene Symbol: KRT33B
  Gene Name: keratin 33B, type I
  Uniprot ID: Q14525
  ENSP ID: ENSP00000459509

SEQ ID NO: 42993 - protein, 436 aa, Homo sapiens
  Payload ID: 8762
  Gene Symbol: KRT34
  Gene Name: keratin 34, type I
  Uniprot ID: O76011
  ENSP ID: ENSP00000377570
MLYAKPPPTINGIKGLQRKERLKPAHIHLQQLTCFSITCSSTMSYSCCLPSLGCRTSCSSRPCVPPSCHGYTLPGACNIPANVSNCNWFCEGSFNGSEKETMQFLNDRLASYLEKVRQLERDNAELEKLIQERSQQQEPLLCPSYQSYFKTIEELQQKILCAKAENARLVVNIDNAKLASDDFRSKYQTEQSLRLLVESDINSIRRILDELTLCKSDLESQVESLREELICLKKNHEEEVNTLRSQLGDRLNVEVDTAPTVDLNQVLNETRSQYEALVEINRREVEQWFATQTEELNKQVVSSSEQLQSCQAEIIELRRTVNALEIELQAQHNLRDSLENTLTESEAHYSSQLSQVQSLITNVESQLAEIRCDLERQNQEYQVLLDVRARLECEINTYRSLLESEDCKLPCNPCATTNASGNSCGPCGTSQKGCCN

SEQ ID NO: 42994 - protein, 436 aa, Homo sapiens
  Payload ID: 8762
  Gene Symbol: KRT34
  Gene Name: keratin 34, type I
  ENSP ID: ENSP00000458934
MLYAKPPPTINGIKGLQRKERLKPAHIHLQQLTCFSITCSSTMSYSCCLPSLGCRTSCSSRPCVPPSCHGYTLPGACNIPANVSNCNWFCEGSFNGSEKETMQFLNDRLASYLEKVRQLERDNAELEKLIQERSQQQEPLLCPSYQSYFKTIEELQQKILCAKAENARLVVNIDNAKLASDDFRSKYQTEQSLRLLVESDINSIRRILDELTLCKSDLESQVESLREELICLKKNHEEEVNTLRSQLGDRLNVEVDTAPTVDLNQVLNETRSQYEALVETNRREVEQWFATQTEELNKQVVSSSEQLQSCQAEIIELRRTVNALEIELQAQHNLRDSLENTLTESEARYSSQLSQVQSLITNVESQLAEIRCDLERQNQEYQVLLDVRARLECEINTYRSLLESEDCKLPCNPCATTNASGNSCGPCGTSQKGCCN

SEQ ID NO: 42995 - protein, 425 aa, Homo sapiens
  Payload ID: 8763
  Gene Symbol: KRT35
  Gene Name: keratin 35, type I
  ENSP ID: ENSP00000246639
MYSSSSCKLPSLSPVARSFSACSVGLGRSSYRATSCLPALCLPAGGFATSYSGGGGWFGEGILTGNEKETMQSLNDRLAGYLEKVRQLEQENASLESRIREWCEQQVPYMCPDYQSYFRTIEELQKKTLCSKAENARLVVEIDNAKLAADDFRTKYETEVSLRQLVESDINGLRRILDDLTLCKSDLEAQVESLKEELLCLKKNHEEEVNSLRCQLGDRLNVEVDAAPPVDLNRVLEEMRCQYETLVENNRRDAEDWLDTQSEELNQQVVSSSEQLQSCQAEIIELRRTVNALEIELQAQHSMRDALESTLAETEARYSSQLAQMQCMITNVEAQLAEIRADLERQNQEYQVLLDVRARLECEINTYRGLLESEDSKLPCNPCAPDYSPSKSCLPCLPAASCGPSAARTNCSPRPICVPCPGGRF

SEQ ID NO: 42996 - protein, 455 aa, Homo sapiens
  Payload ID: 8763
  Gene Symbol: KRT35
  Gene Name: keratin 35, type I
  Uniprot ID: Q92764
  ENSP ID: ENSP00000377558
MASKCLKAGFSSGSLKSPGGASGGSTRVSAMYSSSSCKLPSLSPVARSFSACSVGLGRSSYRATSCLPALCLPAGGFATSYSGGGGWFGEGILTGNEKETMQSLNDRLAGYLEKVRQLEQENASLESRIREWCEQQVPYMCPDYQSYFRTIEELQKKTLCSKAENARLVVEIDNAKLAADDFRTKYETEVSLRQLVESDINGLRRILDDLTLCKSDLEAQVESLKEELLCLKKNHEEEVNSLRCQLGDRLNVEVDAAPPVDLNRVLEEMRCQYETLVENNRRDAEDWLDTQSEELNQQVVSSSEQLQSCQAEIIELRRTVNALEIELQAQHSMRDALESTLAETEARYSSQLAQMQCMITNVEAQLAEIRADLERQNQEYQVLLDVRARLECEINTYRGLLESEDSKLPCNPCAPDYSPSKSCLPCLPAASCGPSAARTNCSPRPICVPCPGGRF

SEQ ID NO: 42997 - protein, 467 aa, Homo sapiens
  Payload ID: 8764
  Gene Symbol: KRT36
  Gene Name: keratin 36, type I
  Uniprot ID: O76013
  ENSP ID: ENSP00000329165
MATQTCTPTFSTGSIKGLCGTAGGISRVSSIRSVGSCRVPSLAGAAGYISSARSGLSGLGSCLPGSYLSSECHTSGFVGSGGWFCEGSFNGSEKETMQFLNDRLANYLEKVRQLERENAELESRIQEWYEFQIPYICPDYQSYFKTIEDFQQKILLTKSENARLVLQIDNAKLAADDFRTKYETELSLRQLVEADINGLRRILDELTLCKADLEAQVESLKEELMCLKKNHEEEVSVLRCQLGDRLNVEVDAAPPVDLNKILEDMRCQYEALVENNRRDVEAWFNTQTEELNQQVVSSSEQLQCCQTEIIELRRTVNALEIELQAQHSMRNSLESTLAETEARYSSQLAQMQCLISNVEAQLSEIRCDLERQNQEYQVLLDVKARLEGEIATYRHLLEGEDCKLPPQPCATACKPVIRVPSVPPVPCVPSVPCTPAPQVGTQIRTITEEIRDGKVISSREHVQSRPL

SEQ ID NO: 42998 - protein, 417 aa, Homo sapiens
  Payload ID: 8764
  Gene Symbol: KRT36
  Gene Name: keratin 36, type I
  Uniprot ID: O76013
  ENSP ID: ENSP00000377555
MLRSGLSGLGSCLPGSYLSSECHTSGFVGSGGWFCEGSFNGSEKETMQFLNDRLANYLEKVRQLERENAELESRIQEWYEFQIPYICPDYQSYFKTIEDFQQKILLTKSENARLVLQIDNAKLAADDFRTKYETELSLRQLVEADINGLRRILDELTLCKADLEAQVESLKEELMCLKKNHEEEVSVLRCQLGDRLNVEVDAAPPVDLNKILEDMRCQYEALVENNRRDVEAWFNTQTEELNQQVVSSSEQLQCCQTEIIELRRTVNALEIELQAQHSMRNSLESTLAETEARYSSQLAQMQCLISNVEAQLSEIRCDLERQNQEYQVLLDVKARLEGEIATYRHLLEGEDCKLPPQPCATACKPVIRVPSVPPVPCVPSVPCTPAPQVGTQIRTITEEIRDGKVISSREHVQSRPL

SEQ ID NO: 42999 - protein, 449 aa, Homo sapiens
  Payload ID: 8765
  Gene Symbol: KRT37
  Gene Name: keratin 37, type I
  Uniprot ID: O76014
  ENSP ID: ENSP00000225550
MTSFYSTSSCPLGCTMAPGARNVFVSPIDVGCQPVAEANAASMCLLANVAHANRVRVGSTPLGRPSLCLPPTSHTACPLPGTCHIPGNIGICGAYGKNTLNGHEKETMKFLNDRLANYLEKVRQLEQENAELETTLLERSKCHESTVCPDYQSYFRTIEELQQKILCSKAENARLIVQIDNAKLAADDFRIKLESERSLHQLVEADKCGTQKLLDDATLAKADLEAQQESLKEEQLSLKSNHEQEVKILRSQLGEKFRIELDIEPTIDLNRVLGEMRAQYEAMVETNHQDVEQWFQAQSEGISLQAMSCSEELQCCQSEILELRCTVNALEVERQAQHTLKDCLQNSLCEAEDRYGTELAQMQSLISNLEEQLSEIRADLERQNQEYQVLLDVKARLENEIATYRNLLESEDCKLPCNPCSTPASCTSCPSCGPVTGGSPSGHGASMGR

SEQ ID NO: 43000 - protein, 449 aa, Homo sapiens; identical to SEQ ID NO: 42999
  Payload ID: 8765
  Gene Symbol: KRT37
  Gene Name: keratin 37, type I
  Uniprot ID: O76014
  ENSP ID: ENSP00000458693

SEQ ID NO: 43001 - protein, 456 aa, Homo sapiens
  Payload ID: 8766
  Gene Symbol: KRT38
  Gene Name: keratin 38, type I
  Uniprot ID: O76015
  ENSP ID: ENSP00000246646
MTSSYSSSSCPLGCTMAPGARNVSVSPIDIGCQPGAEANIAPMCLLANVAHANRVRVGSTPLGRPSLCLPPTCHTACPLPGTCHIPGNIGICGAYGENTLNGHEKETMQFLNDRLANYLEKVRQLEQENAELEATLLERSKCHESTVCPDYQSYFHTIEELQQKILCSKAENARLIVQIDNAKLAADDFRIKLESERSLRQLVEADKCGTQKLLDDATLAKADLEAQQESLKEEQLSLKSNHEQEVKILRSQLGEKLRIELDIEPTIDLNRVLGEMRAQYEAMLETNRQDVEQWFQAQSEGISLQDMSCSEELQCCQSEILELRCTVNALEVERQAQHTLKDCLQNSLCEAEDRFGTELAQMQSLISNVEEQLSEIRADLERQNQEYQVLLDVKTRLENEIATYRNLLESEDCKLPCNPCSTSPSCVTAPCAPRPSCGPCTTCGPTCGASTTGSRF

SEQ ID NO: 43002 - protein, 491 aa, Homo sapiens
  Payload ID: 8767
  Gene Symbol: KRT39
  Gene Name: keratin 39, type I
  Uniprot ID: Q6A163
  ENSP ID: ENSP00000347823
MDTKGCTTTNSPSTPCQNCSRITNVSTISSNNGCHPGGLTVNNCQPAGHVLRIPWDQGCQPTPRFCRKPIYLMNNFNARFSLDDCSWYGEGINSNEKETMQILNERLANYLQKVRMLERENAELESKIQEESNKELPVLCPDYLSYYTTIEELQQKILCTKAENSRLVSQIDNTKLTADDLRAKYEAEVSLRQLVESDANGLKQILNVLTLGKADLEAQVQSLKEELLCLKNNHKEEINSLQCQLGERLDIEVTAAPSADLNQVLQEMRCQYEPIMETNRKDVEQWFNTQIEELNQQVVTSSQQQQCCQKEIIELRRSVNTLEVELQAQHRMRDSQECILTETEARYTALLTQIQSLIDNLEAQLAEIRCALERQNQEYEILLDVKSRLECEITTYRSLLESSDGKRPCYPRATKCEPSPWTSCKSGAIESTAPACTSSSPCSLKEHCSACGPLSRILVKICTITKEIKDGKVISSYEHVQPCFIIRPAKV

SEQ ID NO: 43003 - protein, 491 aa, Homo sapiens; identical to SEQ ID NO: 43002
  Payload ID: 8767
  Gene Symbol: KRT39
  Gene Name: keratin 39, type I
  Uniprot ID: Q6A163
  ENSP ID: ENSP00000459016

SEQ ID NO: 43004 - protein, 184 aa, Homo sapiens
  Payload ID: 8767
  Gene Symbol: KRT39
  Gene Name: keratin 39, type I
  ENSP ID: ENSP00000463609
MDTKGCTTTNSPSTPCQNCSRITNVSTISSNNGCHPGGLTVNNCQPAGHVLRIPWDQGCQPTPRFCRKPIYLMNNFNARFSLDDCSWYGEGINSNEKETMQILNERLANYLQKVRMLERENAELESKIQEESNKELPVLCPDYLSYYTTIEELQQKILCTKAENSRLVSQIDNTKLTADDLRAK

SEQ ID NO: 43005 - protein, 184 aa, Homo sapiens; identical to SEQ ID NO: 43004
  Payload ID: 8767
  Gene Symbol: KRT39
  Gene Name: keratin 39, type I
  ENSP ID: ENSP00000464180

SEQ ID NO: 43006 - protein, 86 aa, Homo sapiens
  Payload ID: 8768
  Gene Symbol: KRT4
  Gene Name: keratin 4, type II
  ENSP ID: ENSP00000447320
MIARQQCVRGGPRGFSCGSAIVGGGKRGAFSSVSMSGGAGRCSSGGFGSRSLYNLRGNKSISMSVAGSRQGGHHQPELAHPPPRGD

SEQ ID NO: 43007 - protein, 520 aa, Homo sapiens
  Payload ID: 8768
  Gene Symbol: KRT4
  Gene Name: keratin 4, type II
  Uniprot ID: P19013
  ENSP ID: ENSP00000448220
MIARQQCVRGGPRGFSCGSAIVGGGKRGAFSSVSMSGGAGRCSSGGFGSRSLYNLRGNKSISMSVAGSRQGACFGGAGGFGTGGFGGGFGGSFSGKGGPGFPVCPAGGIQEVTINQSLLTPLHVEIDPEIQKVRTEEREQIKLLNNKFASFIDKVQFLEQQNKVLETKWNLLQQQTTTTSSKNLEPLFETYLSVLRKQLDTLGNDKGRLQSELKTMQDSVEDFKTKYEEEINKRTAAENDFVVLKKDVDAAYLNKVELEAKVDSLNDEINFLKVLYDAELSQMQTHVSDTSVVLSMDNNRNLDLDSIIAEVRAQYEEIAQRSKAEAEALYQTKVQQLQISVDQHGDNLKNTKSEIAELNRMIQRLRAEIENIKKQCQTLQVSVADAEQRGENALKDAHSKRVELEAALQQAKEELARMLREYQELMSVKLALDIEIATYRKLLEGEEYRMSGECQSAVSISVVSGSTSTGGISGGLGSGSGFGLSSGFGSGSGSGFGFGGSVSGSSSSKIISTTTLNKRR

SEQ ID NO: 43008 - protein, 78 aa, Homo sapiens
  Payload ID: 8768
  Gene Symbol: KRT4
  Gene Name: keratin 4, type II
  ENSP ID: ENSP00000449755
MIARQQCVRGGPRGFSCGSAIVGGGKRGAFSSVSMSGGAGRCSSGGFGSRSLYNLRGNKSISMSVAGSRQGAVLRATE

SEQ ID NO: 43009 - protein, 431 aa, Homo sapiens
  Payload ID: 8769
  Gene Symbol: KRT40
  Gene Name: keratin 40, type I
  Uniprot ID: Q6A162
  ENSP ID: ENSP00000366984
MTSDCSSTHCSPESCGTASGCAPASSCSVETACLPGTCATSRCQTPSFLSRSRGLTGCLLPCYFTGSCNSPCLVGNCAWCEDGVFTSNEKETMQFLNDRLASYLEKVRSLEETNAELESRIQEQCEQDIPMVCPDYQRYFNTIEDLQQKILCTKAENSRLAVQLDNCKLATDDFKSKYESELSLRQLLEADISSLHGILEELTLCKSDLEAHVESLKEDLLCLKKNHEEEVNLLREQLGDRLSVELDTAPTLDLNRVLDEMRCQCETVLANNRREAEEWLAVQTEELNQQQLSSAEQLQGCQMEILELKRTASALEIELQAQQSLTESLECTVAETEAQYSSQLAQIQCLIDNLENQLAEIRCDLERQNQEYQVLLDVKARLEGEINTYWGLLDSEDSRLSCSPCSTTCTSSNTCEPCSAYVICTVENCCL

SEQ ID NO: 43010 - protein, 431 aa, Homo sapiens; identical to SEQ ID NO: 43009
  Payload ID: 8769
  Gene Symbol: KRT40
  Gene Name: keratin 40, type I
  Uniprot ID: Q6A162
  ENSP ID: ENSP00000381500

SEQ ID NO: 43011 - protein, 236 aa, Homo sapiens
  Payload ID: 8769
  Gene Symbol: KRT40
  Gene Name: keratin 40, type I
  ENSP ID: ENSP00000434458
MTSDCSSTHCSPESCGTASGCAPASSCSVETACLPGTCATSRCQTPSFLSRSRGLTGCLLPCYFTGSCNSPCLVGNCAWCEDGVFTSNEKETMQFLNDRLASYLEKVRSLEETNAELESRIQEQCEQDIPMVCPDYQRYFNTIEDLQQKILCTKAENSRLAVQLDNCKLATDDFKSKYESELSLRQLLEADISSLHGILEELTLCKSDLEAHVESLKEDLLCLKKNHEETKKLRPF

SEQ ID NO: 43012 - protein, 236 aa, Homo sapiens; identical to SEQ ID NO: 43011
  Payload ID: 8769
  Gene Symbol: KRT40
  Gene Name: keratin 40, type I
  ENSP ID: ENSP00000458481

SEQ ID NO: 43013 - protein, 431 aa, Homo sapiens; identical to SEQ ID NO: 43009
  Payload ID: 8769
  Gene Symbol: KRT40
  Gene Name: keratin 40, type I
  Uniprot ID: Q6A162
  ENSP ID: ENSP00000459621

SEQ ID NO: 43014 - protein, 431 aa, Homo sapiens; identical to SEQ ID NO: 43009
  Payload ID: 8769
  Gene Symbol: KRT40
  Gene Name: keratin 40, type I
  Uniprot ID: Q6A162
  ENSP ID: ENSP00000479080

SEQ ID NO: 43015 - protein, 590 aa, Homo sapiens
  Payload ID: 8770
  Gene Symbol: KRT5
  Gene Name: keratin 5, type II
  Uniprot ID: P13647
  ENSP ID: ENSP00000252242
MSRQSSVSFRSGGSRSFSTASAITPSVSRTSFTSVSRSGGGGGGGFGRVSLAGACGVGGYGSRSLYNLGGSKRISISTSGGSFRNRFGAGAGGGYGFGGGAGSGFGFGGGAGGGFGLGGGAGFGGGFGGPGFPVCPPGGIQEVTVNQSLLTPLNLQIDPSIQRVRTEEREQIKTLNNKFASFIDKVRFLEQQNKVLDTKWTLLQEQGTKTVRQNLEPLFEQYINNLRRQLDSIVGERGRLDSELRNMQDLVEDFKNKYEDEINKRTTAENEFVMLKKDVDAAYMNKVELEAKVDALMDEINFMKMFFDAELSQMQTHVSDTSVVLSMDNNRNLDLDSIIAEVKAQYEEIANRSRTEAESWYQTKYEELQQTAGRHGDDLRNTKHEISEMNRMIQRLRAEIDNVKKQCANLQNAIADAEQRGELALKDARNKLAELEEALQKAKQDMARLLREYQELMNTKLALDVEIATYRKLLEGEECRLSGEGVGPVNISVVTSSVSSGYGSGSGYGGGLGGGLGGGLGGGLAGGSSGSYYSSSSGGVGLGGGLSVGGSGFSASSGRGLGVGFGSGGGSSSSVKFVSTTSSSRKSFKS

SEQ ID NO: 43016 - protein, 178 aa, Homo sapiens
  Payload ID: 8770
  Gene Symbol: KRT5
  Gene Name: keratin 5, type II
  ENSP ID: ENSP00000447209
MSRQSSVSFRSGGSRGFGGPGFPVCPPGGIQEVTVNQSLLTPLNLQIDPSIQRVRTEEREQIKTLNNKFASFIDKVRFLEQQNKVLDTKWTLLQEQGTKTVRQNLEPLFEQYINNLRRQLDSIVGERGRLDSELRNMQDLVEDFKNKYEDEINKRTTAENEFVMLKKDVDAAYMNKVE

SEQ ID NO: 43017 - protein, 147 aa, Homo sapiens
  Payload ID: 8770
  Gene Symbol: KRT5
  Gene Name: keratin 5, type II
  ENSP ID: ENSP00000448041
MSRQSSVSFRSGGSRSFSTASAITPSVSRTSFTSVSRSGGGGGGGFGRVSLAGACGVGGYGFGGGAGSGFGFGGGAGGGFGLGGGAGFGGGFGGPGFPVCPPGGIQEVTVNQSLLTPLNLQIDPSIQRVRTEEREQIKTLNNKFASF

SEQ ID NO: 43018 - protein, 201 aa, Homo sapiens
  Payload ID: 8770
  Gene Symbol: KRT5
  Gene Name: keratin 5, type II
  ENSP ID: ENSP00000448767
  MOD_RES (1)..(1): Any amino acid
XDALMDEINFMKMFFDAELSQMQTHVSDTSVVLSMDNNRNLDLDSIIAEVKAQYEEIANRSRTEAESWYQTKYEELQQTAGRHGDDLRNTKHEISEMNRMIQRLRAEIDNVKKQCANLQNAIADAEQRGELALKDARNKLAELEEALQKAKQDMARLLREYQELMNTKLALDVEIATYRKLLEGEECRLSGEGVGPVNICK

SEQ ID NO: 43019 - protein, 132 aa, Homo sapiens
  Payload ID: 8770
  Gene Symbol: KRT5
  Gene Name: keratin 5, type II
  ENSP ID: ENSP00000449651
MSRQSSVSFRSGGSRSFSTASAITPSVSRTSFTSVSRSGGGGGGGFGRVSLAGACGVGGYGSRSLYNLGGSKRISISTSGGSFRNRFGAGAGGGYGFGGGAGSGFGFGGGAGGGFGLGGGAGFGGGFGGPGF

SEQ ID NO: 43020 - protein, 196 aa, Homo sapiens
  Payload ID: 8770
  Gene Symbol: KRT5
  Gene Name: keratin 5, type II
  ENSP ID: ENSP00000449783
  MOD_RES (1)..(1): Any amino acid
XDPAAGAGHQDCEAEPGAVVRAVHQQPQEAAGQHRGGTGPPGLRAEKHAGPGGRLQEQPLKAQKRTLEKLTRYEDEINKRTTAENEFVMLKKDVDAAYMNKVELEAKVDALMDEINFMKMFFDAELSQMQTHVSDTSVVLSMDNNRNLDLDSIIAEVKAQYEEIANRSRTEAESWYQTKYEELQQTAGRHGDDLRN

SEQ ID NO: 43021 - protein, 564 aa, Homo sapiens
  Payload ID: 8771
  Gene Symbol: KRT6A
  Gene Name: keratin 6A, type II
  Uniprot ID: P02538
  ENSP ID: ENSP00000369317
MASTSTTIRSHSSSRRGFSANSARLPGVSRSGFSSVSVSRSRGSGGLGGACGGAGFGSRSLYGLGGSKRISIGGGSCAISGGYGSRAGGSYGFGGAGSGFGFGGGAGIGFGLGGGAGLAGGFGGPGFPVCPPGGIQEVTVNQSLLTPLNLQIDPTIQRVRAEEREQIKTLNNKFASFIDKVRFLEQQNKVLETKWTLLQEQGTKTVRQNLEPLFEQYINNLRRQLDSIVGERGRLDSELRGMQDLVEDFKNKYEDEINKRTAAENEFVTLKKDVDAAYMNKVELQAKADTLTDEINFLRALYDAELSQMQTHISDTSVVLSMDNNRNLDLDSIIAEVKAQYEEIAQRSRAEAESWYQTKYEELQVTAGRHGDDLRNTKQEIAEINRMIQRLRSEIDHVKKQCANLQAAIADAEQRGEMALKDAKNKLEGLEDALQKAKQDLARLLKEYQELMNVKLALDVEIATYRKLLEGEECRLNGEGVGQVNISVVQSTVSSGYGGASGVGSGLGLGGGSSYSYGSGLGVGGGFSSSSGRAIGGGLSSVGGGSSTIKYTTTSSSSRKSYKH

SEQ ID NO: 43022 - protein, 564 aa, Homo sapiens
  Payload ID: 8772
  Gene Symbol: KRT6B
  Gene Name: keratin 6B, type II
  Uniprot ID: P04259
  ENSP ID: ENSP00000252252
MASTSTTIRSHSSSRRGFSANSARLPGVSRSGFSSISVSRSRGSGGLGGACGGAGFGSRSLYGLGGSKRISIGGGSCAISGGYGSRAGGSYGFGGAGSGFGFGGGAGIGFGLGGGAGLAGGFGGPGFPVCPPGGIQEVTVNQSLLTPLNLQIDPAIQRVRAEEREQIKTLNNKFASFIDKVRFLEQQNKVLDTKWTLLQEQGTKTVRQNLEPLFEQYINNLRRQLDNIVGERGRLDSELRNMQDLVEDLKNKYEDEINKRTAAENEFVTLKKDVDAAYMNKVELQAKADTLTDEINFLRALYDAELSQMQTHISDTSVVLSMDNNRNLDLDSIIAEVKAQYEEIAQRSRAEAESWYQTKYEELQITAGRHGDDLRNTKQEIAEINRMIQRLRSEIDHVKKQCANLQAAIADAEQRGEMALKDAKNKLEGLEDALQKAKQDLARLLKEYQELMNVKLALDVEIATYRKLLEGEECRLNGEGVGQVNISVVQSTVSSGYGGASGVGSGLGLGGGSSYSYGSGLGVGGGFSSSSGRATGGGLSSVGGGSSTIKYTTTSSSSRKSYKH

SEQ ID NO: 43023 - protein, 564 aa, Homo sapiens
  Payload ID: 8773
  Gene Symbol: KRT6C
  Gene Name: keratin 6C, type II
  Uniprot ID: P48668
  ENSP ID: ENSP00000252250
MASTSTTIRSHSSSRRGFSANSARLPGVSRSGFSSISVSRSRGSGGLGGACGGAGFGSRSLYGLGGSKRISIGGGSCAISGGYGSRAGGSYGFGGAGSGFGFGGGAGIGFGLGGGAGLAGGFGGPGFPVCPPGGIQEVTVNQSLLTPLNLQIDPAIQRVRAEEREQIKTLNNKFASFIDKVRFLEQQNKVLDTKWTLLQEQGTKTVRQNLEPLFEQYINNLRRQLDSIVGERGRLDSELRNMQDLVEDLKNKYEDEINKRTAAENEFVTLKKDVDAAYMNKVELQAKADTLTDEINFLRALYDAELSQMQTHISDTSVVLSMDNNRNLDLDSIIAEVKAQYEEIAQRSRAEAESWYQTKYEELQVTAGRHGDDLRNTKQEIAEINRMIQRLRSEIDHVKKQCASLQAAIADAEQRGEMALKDAKNKLEGLEDALQKAKQDLARLLKEYQELMNVKLALDVEIATYRKLLEGEECRLNGEGVGQVNVSVVQSTISSGYGGASGVGSGLGLGGGSSYSYGSGLGIGGGFSSSSGRAIGGGLSSVGGGSSTIKYTTTSSSSRKSYKH

SEQ ID NO: 43024 - protein, 469 aa, Homo sapiens
  Payload ID: 8774
  Gene Symbol: KRT7
  Gene Name: keratin 7, type II
  Uniprot ID: P08729
  ENSP ID: ENSP00000329243
MSIHFSSPVFTSRSAAFSGRGAQVRLSSARPGGLGSSSLYGLGASRPRVAVRSAYGGPVGAGIREVTINQSLLAPLRLDADPSLQRVRQEESEQIKTLNNKFASFIDKVRFLEQQNKLLETKWTLLQEQKSAKSSRLPDIFEAQIAGLRGQLEALQVDGGRLEAELRSMQDVVEDFKNKYEDEINHRTAAENEFVVLKKDVDAAYMSKVELEAKVDALNDEINFLRTLNETELTELQSQISDTSVVLSMDNSRSLDLDGIIAEVKAQYEEMAKCSRAEAEAWYQTKFETLQAQAGKHGDDLRNTRNEISEMNRAIQRLQAEIDNIKNQRAKLEAAIAEAEERGELALKDARAKQEELEAALQRGKQDMARQLREYQELMSVKLALDIEIATYRKLLEGEESRLAGDGVGAVNISVMNSTGGSSSGGGIGLTLGGTMGSNALSFSSSAGPGLLKAYSIRTASASRRSARD

SEQ ID NO: 43025 - protein, 523 aa, Homo sapiens
  Payload ID: 8775
  Gene Symbol: KRT71
  Gene Name: keratin 71, type II
  Uniprot ID: Q3SY84
  ENSP ID: ENSP00000267119
MSRQFTCKSGAAAKGGFSGCSAVLSGGSSSSFRAGSKGLSGGFGSRSLYSLGGVRSLNVASGSGKSGGYGFGRGRASGFAGSMFGSVALGPVCPTVCPPGGIHQVTVNESLLAPLNVELDPEIQKVRAQEREQIKALNNKFASFIDKVRFLEQQNQVLETKWELLQQLDLNNCKNNLEPILEGYISNLRKQLETLSGDRVRLDSELRNVRDVVEDYKKRYEEEINKRTAAENEFVLLKKDVDAAYANKVELQAKVESMDQEIKFFRCLFEAEITQIQSHISDMSVILSMDNNRNLDLDSIIDEVRTQYEEIALKSKAEAEALYQTKFQELQLAAGRHGDDLKNTKNEISELTRLIQRIRSEIENVKKQASNLETAIADAEQRGDNALKDARAKLDELEGALHQAKEELARMLREYQELMSLKLALDMEIATYRKLLESEECRMSGEFPSPVSISIISSTSGGSVYGFRPSMVSGGYVANSSNCISGVCSVRGGEGRSRGSANDYKDTLGKGSSLSAPSKKTSR

SEQ ID NO: 43026 - protein, 511 aa, Homo sapiens
  Payload ID: 8776
  Gene Symbol: KRT72
  Gene Name: keratin 72, type II
  Uniprot ID: Q14CN4
  ENSP ID: ENSP00000293745
MSRQLTHFPRGERLGFSGCSAVLSGGIGSSSASFRARVKGSASFGSKSLSCLGGSRSLALSAAARRGGGRLGGFVGTAFGSAGLGPKCPSVCPPGGIPQVTVNKSLLAPLNVEMDPEIQRVRAQEREQIKALNNKFASFIDKVRFLEQQNQVLETKWNLLQQLDLNNCRKNLEPIYEGYISNLQKQLEMLSGDGVRLDSELRNMQDLVEDYKKRYEVEINRRTAAENEFVVLKKDVDAAYMNKVELQAKVDSLTDEIKFFKCLYEGEITQIQSHISDTSIVLSMDNNRDLDLDSIIAEVRAQYEEIALKSKAEAETLYQTKIQELQVTAGQHGDDLKLTKAEISELNRLIQRIRSEIGNVKKQCADLETAIADAEQRGDCALKDARAKLDELEGALHQAKEELARMLREYQELVSLKLALDMEIATYRKLLESEECRMSGEYPNSVSISVISSTNAGAGGAGFSMGFGASSSYSYKTAAADVKTKGSCGSELKDPLAKTSGSSCATKKASR

SEQ ID NO: 43027 - protein, 469 aa, Homo sapiens
  Payload ID: 8776
  Gene Symbol: KRT72
  Gene Name: keratin 72, type II
  Uniprot ID: Q14CN4
  ENSP ID: ENSP00000346269
MSRQLTHFPRGERLGFSGCSAVLSGGIGSSSASFRARVKGSASFGSKSLSCLGGSRSLALSAAARRGGGRLGGFVGTAFGSAGLGPKCPSVCPPGGIPQVTVNKSLLAPLNVEMDPEIQRVRAQEREQIKALNNKFASFIDKVRFLEQQNQVLETKWNLLQQLDLNNCRKNLEPIYEGYISNLQKQLEMLSGDGVRLDSELRNMQDLVEDYKKRYEVEINRRTAAENEFVVLKKDVDAAYMNKVELQAKVDSLTDEIKFFKCLYEGEITQIQSHISDTSIVLSMDNNRDLDLDSIIAEVRAQYEEIALKSKAEAETLYQTKCADLETAIADAEQRGDCALKDARAKLDELEGALHQAKEELARMLREYQELVSLKLALDMEIATYRKLLESEECRMSGEYPNSVSISVISSTNAGAGGAGFSMGFGASSSYSYKTAAADVKTKGSCGSELKDPLAKTSGSSCATKKASR

SEQ ID NO: 43028 - protein, 511 aa, Homo sapiens; identical to SEQ ID NO: 43026
  Payload ID: 8776
  Gene Symbol: KRT72
  Gene Name: keratin 72, type II
  Uniprot ID: Q14CN4
  ENSP ID: ENSP00000441160

SEQ ID NO: 43029 - protein, 143 aa, Homo sapiens
  Payload ID: 8776
  Gene Symbol: KRT72
  Gene Name: keratin 72, type II
  ENSP ID: ENSP00000446881
  MOD_RES (1)..(1): Any amino acid
XFPRGERLGFSGCSAVLSGGIGSSSASFRARVKGSASFGSKSLSCLGGSRSLALSAAARRGGGRLGGFVGTAFGSAGLGPKCPSVCPPGGIPQVTVNKSLLAPLNVEMDPEIQRVRAQEREQIKALNNKFASFIDKKTPAFIA

SEQ ID NO: 43030 - protein, 192 aa, Homo sapiens
  Payload ID: 8776
  Gene Symbol: KRT72
  Gene Name: keratin 72, type II
  ENSP ID: ENSP00000449324
  MOD_RES (1)..(1): Any amino acid
XLQRLLRGPLWRDRQQLRLIPGPGQGLGLLWQQEPLLPWGQPKPGAQRCCTAGRRPPGRLRGHRLRQRRAGAQVSLRVPTRGHPSGHRQQEPPGPAQRGDGPRDPEGARPGAGADQGAKQQVRLLHRQDRVLFLVLEIQVRFLEQQNQVLETKWNLLQQLDLNNCRKNLEPIYEGYISNLQKQLEMLSGDGV

SEQ ID NO: 43031 - protein, 540 aa, Homo sapiens
  Payload ID: 8777
  Gene Symbol: KRT73
  Gene Name: keratin 73, type II
  Uniprot ID: Q86Y46
  ENSP ID: ENSP00000307014
MSRQFTYKSGAAAKGGFSGCSAVLSGGSSSSYRAGGKGLSGGFSSRSLYSLGGARSISFNVASGSGWAGGYGFGRGRASGFAGSMFGSVALGSVCPSLCPPGGIHQVTINKSLLAPLNVELDPEIQKVRAQEREQIKVLNNKFASFIDKVRFLEQQNQVLETKWELLQQLDLNNCKNNLEPILEGYISNLRKQLETLSGDRVRLDSELRSVREVVEDYKKRYEEEINKRTTAENEFVVLKKDVDAAYTSKVELQAKVDALDGEIKFFKCLYEGETAQIQSHISDTSIILSMDNNRNLDLDSIIAEVRAQYEEIARKSKAEAEALYQTKFQELQLAAGRHGDDLKHTKNEISELTRLIQRLRSEIESVKKQCANLETAIADAEQRGDCALKDARAKLDELEGALQQAKEELARMLREYQELLSVKLSLDIEIATYRKLLEGEECRMSGEYTNSVSISVINSSMAGMAGTGAGFGFSNAGTYGYWPSSVSGGYSMLPGGCVTGSGNCSPRGEARTRLGSASEFRDSQGKTLALSSPTKKTMR

SEQ ID NO: 43032 - protein, 285 aa, Homo sapiens
  Payload ID: 8777
  Gene Symbol: KRT73
  Gene Name: keratin 73, type II
  ENSP ID: ENSP00000449081
EEINKRTTAENEFVVLKKETAQIQSHISDTSIILSMDNNRNLDLDSIIAEVRAQYEEIARKSKAEAEALYQTKFQELQLAAGRHGDDLKHTKNEISELTRLIQRLRSEIESVKKQCANLETAIADAEQRGDCALKDARAKLDELEGALQQAKEELARMLREYQELLSVKLSLDIEIATYRKLLEGEECRMSGEYTNSVSISVINSSMAGMAGTGAGFGFSNAGTYGYWPSSVSGGYSMLPGGCVTGSGNCSPRGEARTRLGSASEFRDSQGKTLALSSPTKKTMR

SEQ ID NO: 43033 - protein, 529 aa, Homo sapiens
  Payload ID: 8778
  Gene Symbol: KRT74
  Gene Name: keratin 74, type II
  Uniprot ID: Q7RTS7
  ENSP ID: ENSP00000307240
MSRQLNIKSSGDKGNFSVHSAVVPRKAVGSLASYCAAGRGAGAGFGSRSLYSLGGNRRISFNVAGGGVRAGGYGFRPGSGYGGGRASGFAGSMFGSVALGPACLSVCPPGGIHQVTVNKSLLAPLNVELDPEIQKVRAQEREQIKVLNDKFASFIDKVRFLEQQNQVLETKWELLQQLDLNNCKKNLEPILEGYISNLRKQLETLSGDRVRLDSELRSMRDLVEDYKKRYEVEINRRTTAENEFVVLKKDADAAYAVKVELQAKVDSLDKEIKFLKCLYDAEIAQIQTHASETSVILSMDNNRDLDLDSIIAEVRMHYEEIALKSKAEAEALYQTKIQELQLAASRHGDDLKHTRSEMVELNRLIQRIRCEIGNVKKQRASLETAIADAEQRGDNALKDAQAKLDELEGALHQAKEELARMLREYQELMSLKLALDMEIATYRKLLEGEECRMSGENPSSVSISVISSSSYSYHHPSSAGVDLGASAVAGSSGSTQSGQTKTTEARGGDLKDTQGKSTPASIPARKATR

SEQ ID NO: 43034 - protein, 543 aa, Homo sapiens
  Payload ID: 8778
  Gene Symbol: KRT74
  Gene Name: keratin 74, type II
  ENSP ID: ENSP00000447447
MSRQLNIKSSGDKGNFSVHSAVVPRKAVGSLASYCAAGRGAGAGFGSRSLYSLGGNRRISFNVAGGGVRAGGYGFRPGSGYGGGRASGFAGSMFGSVALGPACLSVCPPGGIHQVTVNKSLLAPLNVELDPEIQKVRAQEREQIKVLNDKFASFIDKVRFLEQQNQVLETKWELLQQLDLNNCKKNLEPILEGYISNLRKQLETLSGDRVRLDSELRSMRDLVEDYKKRYEVEINRRTTAENEFVVLKKDADAAYAVKVELQAKVDSLDKEIKFLKCLYDAEIAQIQTHASETSVILSMDNNRDLDLDSIIAEVRMHYEEIALKSKAEAEALYQTKIQELQLAASRHGDDLKHTRSEMVELNRLIQRIRCEIGNVKKQIFSVSNEPAPCPLWRASLETAIADAEQRGDNALKDAQAKLDELEGALHQAKEELARMLREYQELMSLKLALDMEIATYRKLLEGEECRMSGENPSSVSISVISSSSYSYHHPSSAGVDLGASAVAGSSGSTQSGQTKTTEARGGDLKDTQGKSTPASIPARKATR

SEQ ID NO: 43035 - protein, 551 aa, Homo sapiens
  Payload ID: 8779
  Gene Symbol: KRT75
  Gene Name: keratin 75, type II
  Uniprot ID: O95678
  ENSP ID: ENSP00000252245
MSRQSSITFQSGSRRGFSTTSAITPAAGRSRFSSVSVARSAAGSGGLGRISSAGASFGSRSLYNLGGAKRVSINGCGSSCRSGFGGRASNRFGVNSGFGYGGGVGGGFSGPSFPVCPPGGIQEVTVNQSLLTPLHLQIDPTIQRVRAEEREQIKTLNNKFASFIDKVRFLEQQNKVLETKWALLQEQGSRTVRQNLEPLFDSYTSELRRQLESITTERGRLEAELRNMQDVVEDFKVRYEDEINKRTAAENEFVALKKDVDAAYMNKVELEAKVKSLPEEINFIHSVFDAELSQLQTQVGDTSVVLSMDNNRNLDLDSIIAEVKAQYEDIANRSRAEAESWYQTKYEELQVTAGRHGDDLRNTKQEISEMNRMIQRLRAEIDSVKKQCSSLQTAIADAEQRGELALKDARAKLVDLEEALQKAKQDMARLLREYQELMNIKLALDVEIATYRKLLEGEECRLSGEGVSPVNISVVTSTLSSGYGSGSSIGGGNLGLGGGSGYSFTTSGGHSLGAGLGGSGFSATSNRGLGGSGSSVKFVSTTSSSQKSYTH

SEQ ID NO: 43036 - protein, 638 aa, Homo sapiens
  Payload ID: 8780
  Gene Symbol: KRT76
  Gene Name: keratin 76, type II
  Uniprot ID: Q01546
  ENSP ID: ENSP00000330101
MNRQVCKKSFSGRSQGFSGRSAVVSGSSRMSCVARSGGAGGGACGFRSGAGSFGSRSLYNLGSNKSISISVAAGSSRAGGFGGGRSSCGFAGGYGGGFGGSYGGGFGGGRGVGSGFGGAGGFGGAGGFGGPGVFGGPGSFGGPGGFGPGGFPGGIQEVIVNQSLLQPLNVEIDPQIGQVKAQEREQIKTLNNKFASFIDKVRFLEQQNKVLETKWELLQQQTTGSGPSSLEPCFESYISFLCKQLDSLLGERGNLEGELKSMQDLVEDFKKKYEDEINKRTAAENEFVGLKKDVDAAFMNKVELQAKVDSLTDEVSFLRTLYEMELSQMQSHASDTSVVLSMDNNRCLDLGSIIAEVRAQYEEIAQRSKSEAEALYQTKLGELQTTAGRHGDDLRNTKSEIMELNRMIQRLRAEIENVKKQNANLQTAIAEAEQRGEMALKDANAKLQDLQTALQKAKDDLARLLRDYQELMNVKLALDVEIATYRKLLEGEECRMSGECQSAVCISVVSNVTSTSGSSGSSRGVFGGVSGSGSGGYKGGSSSSSSSGYGVSGGSGSGYGGVSSGSTGGRGSSGSYQSSSSGSRLGGAGSISVSHSGMGSSSGSIQTSGGSGYKSGGGGSTSIRFSQTTSSSQHSSTK

SEQ ID NO: 43037 - protein, 578 aa, Homo sapiens
  Payload ID: 8781
  Gene Symbol: KRT77
  Gene Name: keratin 77, type II
  Uniprot ID: Q7Z794
  ENSP ID: ENSP00000342710
MSHQFSSQSAFSSMSRRVYSTSSSAGSGGGSPAVGSVCYARGRCGGGGYGIHGRGFGSRSLYNLGGSRSISINLMGRSTSGFCQGGGVGGFGGGRGFGVGSTGAGGFGGGGFGGAGFGTSNFGLGGFGPYCPPGGIQEVTINQSLLEPLHLEVDPEIQRIKTQEREQIMVLNNKFASFIDKVRFLEQQNQVLQTKWELLQQVNTSTGTNNLEPLLENYIGDLRRQVDLLSAEQMRQNAEVRSMQDVVEDYKSKYEDEINKRTGSENDFVVLKKDVDAAYVSKVDLESRVDTLTGEVNFLKYLFLTELSQVQTHISDTNVILSMDNNRSLDLDSIIDAVRTQYELIAQRSKDEAEALYQTKYQELQITAGRHGDDLKNSKMEIAELNRTVQRLQAEISNVKKQIEQMQSLISDAEERGEQALQDAWQKLQDLEEALQQSKEELARLLRDYQAMLGVKLSLDVEIATYRQLLEGEESRMSGELQSHVSISVQNSQVSVNGGAGGGGSYGSGGYGGGSGGGYGGGRSYRGGGARGRSGGGYGSGCGGGGGSYGGSGRSGRGSSRVQIIQTSTNTSHRRILE

SEQ ID NO: 43038 - protein, 248 aa, Homo sapiens
  Payload ID: 8781
  Gene Symbol: KRT77
  Gene Name: keratin 77, type II
  ENSP ID: ENSP00000448207
MSHQFSSQSAFSSMSRRVYSTSSSAGSGGGSPAVGSVCYARGRCGGGGYGIHGRGFGSRSLYNLGGSRSISINLMGRSTSGFCQGGGVGGFGGGRGFGVGSTGAGGFGGGGFGGAGFGTSNFGLGGFGPYCPPGGIQEVTINQSLLEPLHLEVDPEIQRIKTQEREQIMVLNNKFASFIDKRKEPWGHQCLRCSETPFPYVGMDKLSVEGAIPGAAEPGATNKMGVAAAGEHLNWNQQPGAPLGELHR

SEQ ID NO: 43039 - protein, 520 aa, Homo sapiens
  Payload ID: 8782
  Gene Symbol: KRT78
  Gene Name: keratin 78, type II
  Uniprot ID: Q8N1N4
  ENSP ID: ENSP00000306261
MSLSPCRAQRGFSARSACSARSRGRSRGGFSSRGGFSSRSLNSFGGCLEGSRGSTWGSGGRLGVRFGEWSGGPGLSLCPPGGIQEVTINQNLLTPLKIEIDPQFQVVRTQETQEIRTLNNQFASFIDKVRFLEQQNKVLETKWHLLQQQGLSGSQQGLEPVFEACLDQLRKQLEQLQGERGALDAELKACRDQEEEYKSKYEEEAHRRATLENDFVVLKKDVDGVFLSKMELEGKLEALREYLYFLKHLNEEELGQLQTQASDTSVVLSMDNNRYLDFSSIITEVRARYEEIARSSKAEAEALYQTKYQELQVSAQLHGDRMQETKVQISQLHQEIQRLQSQTENLKKQNASLQAAITDAEQRGELALKDAQAKVDELEAALRMAKQNLARLLCEYQELTSTKLSLDVEIATYRRLLEGEECRMSGECTSQVTISSVGGSAVMSGGVGGGLGSTCGLGSGKGSPGSCCTSIVTGGSNIILGSGKDPVLDSCSVSGSSAGSSCHTILKKTVESSLKTSITY

SEQ ID NO: 43040 - protein, 410 aa, Homo sapiens
  Payload ID: 8782
  Gene Symbol: KRT78
  Gene Name: keratin 78, type II
  Uniprot ID: Q8N1N4
  ENSP ID: ENSP00000352479
MEGHEASPAQVGQGDRGKVRFLEQQNKVLETKWHLLQQQGLSGSQQGLEPVFEACLDQLRKQLEQLQGERGALDAELKACRDQEEEYKSKYEEEAHRRATLENDFVVLKKDVDGVFLSKMELEGKLEALREYLYFLKHLNEEELGQLQTQASDTSVVLSMDNNRYLDFSSIITEVRARYEEIARSSKAEAEALYQTKYQELQVSAQLHGDRMQETKVQISQLHQEIQRLQSQTENLKKQNASLQAAITDAEQRGELALKDAQAKVDELEAALRMAKQNLARLLCEYQELTSTKLSLDVEIATYRRLLEGEECRMSGECTSQVTISSVGGSAVMSGGVGGGLGSTCGLGSGKGSPGSCCTSIVTGGSNIILGSGKDPVLDSCSVSGSSAGSSCHTILKKTVESSLKTSITY

SEQ ID NO: 43041 - protein, 41 aa, Homo sapiens
  Payload ID: 8782
  Gene Symbol: KRT78
  Gene Name: keratin 78, type II
  ENSP ID: ENSP00000448562
  MOD_RES (1)..(1): Any amino acid
XDVEIATYRRLLEGEECSLGGRQRCHVWRSWWRLGEHLWTR

SEQ ID NO: 43042 - protein, 535 aa, Homo sapiens
  Payload ID: 8783
  Gene Symbol: KRT79
  Gene Name: keratin 79, type II
  Uniprot ID: Q5XKE5
  ENSP ID: ENSP00000328358
MRSSVSRQTYSTKGGFSSNSASGGSGSQARTSFSSVTVSRSSGSGGGAHCGPGTGGFGSRSLYNLGGHKSISVSVAGGALLGRALGGFGFGSRAFMGQGAGRQTFGPACPPGGIQEVTVNQSLLTPLHVEIDPEIQRVRTQEREQIKTLNNKFASFIDKVRFLEQQNKVLETKWALLQEQGQNLGVTRNNLEPLFEAYLGSMRSTLDRLQSERGRLDSELRNVQDLVEDFKNKYEDEINKHTAAENEFVVLKKDVDAAYMGRMDLHGKVGTLTQEIDFLQQLYEMELSQVQTHVSNTNVVLSMDNNRNLDLDSIIAEVKAQYELIAQRSRAEAEAWYQTKYEELQVTAGKHGDNLRDTKNEIAELTRTIQRLQGEADAAKKQCQQLQTAIAEAEQRGELALKDAQKKLGDLDVALHQAKEDLTRLLRDYQELMNVKLALDVEIATYRKLLESEESRMSGECPSAVSISVTGNSTTVCGGGAASFGGGISLGGSGGATKGGFSTNVGYSTVKGGPVSAGTSILRKTTTVKTSSQRY

SEQ ID NO: 43043 - protein, 119 aa, Homo sapiens
  Payload ID: 8783
  Gene Symbol: KRT79
  Gene Name: keratin 79, type II
  ENSP ID: ENSP00000449159
LHQAKEDLTRLLRDYQELMNVKLALDVEIATYRKLLESEESRMSGECPSAVSICEYLLPTSCSTPGQAPELCSVYATCTCPKACSPPFEPLETGSEGPSSGLLYPFPIALLLDFVLIPH

SEQ ID NO: 43044 - protein, 483 aa, Homo sapiens
  Payload ID: 8784
  Gene Symbol: KRT8
  Gene Name: keratin 8, type II
  Uniprot ID: P05787
  ENSP ID: ENSP00000293308
MSIRVTQKSYKVSTSGPRAFSSRSYTSGPGSRISSSSFSRVGSSNFRGGLGGGYGGASGMGGITAVTVNQSLLSPLVLEVDPNIQAVRTQEKEQIKTLNNKFASFIDKVRFLEQQNKMLETKWSLLQQQKTARSNMDNMFESYINNLRRQLETLGQEKLKLEAELGNMQGLVEDFKNKYEDEINKRTEMENEFVLIKKDVDEAYMNKVELESRLEGLTDEINFLRQLYEEEIRELQSQISDTSVVLSMDNSRSLDMDSIIAEVKAQYEDIANRSRAEAESMYQIKYEELQSLAGKHGDDLRRTKTEISEMNRNISRLQAEIEGLKGQRASLEAAIADAEQRGELAIKDANAKLSELEAALQRAKQDMARQLREYQELMNVKLALDIEIATYRKLLEGEESRLESGMQNMSIHTKTTSGYAGGLSSAYGGLTSPGLSYSLGSSFGSGAGSSSFSRTSSSRAVVVKKIETRDGKLVSESSDVLPK

SEQ ID NO: 43045 - protein, 289 aa, Homo sapiens
  Payload ID: 8784
  Gene Symbol: KRT8
  Gene Name: keratin 8, type II
  ENSP ID: ENSP00000447040
MEIQCSRILLSSLRFSVSRLLTLSRISAWFGPPASTPASTMSIRVTQKSYKVSTSGPRAFSSRSYTSGPGSRISSSSFSRVGSSNFRGGLGGGYGGASGMGGITAVTVNQSLLSPLVLEVDPNIQAVRTQEKEQIKTLNNKFASFIDKVRFLEQQNKMLETKWSLLQQQKTARSNMDNMFESYINNLRRQLETLGQEKLKLEAELGNMQGLVEDFKNKYEDEINKRTEMENEFVLIKKDVDEAYMNKVELESRLEGLTDEINFLRQLYEEEIRELQSQISDTSVVLSMD

SEQ ID NO: 43046 - protein, 483 aa, Homo sapiens; identical to SEQ ID NO: 43044
  Payload ID: 8784
  Gene Symbol: KRT8
  Gene Name: keratin 8, type II
  Uniprot ID: P05787
  ENSP ID: ENSP00000447402

SEQ ID NO: 43047 - protein, 483 aa, Homo sapiens; identical to SEQ ID NO: 43044
  Payload ID: 8784
  Gene Symbol: KRT8
  Gene Name: keratin 8, type II
  Uniprot ID: P05787
  ENSP ID: ENSP00000447566

SEQ ID NO: 43048 - protein, 273 aa, Homo sapiens
  Payload ID: 8784
  Gene Symbol: KRT8
  Gene Name: keratin 8, type II
  ENSP ID: ENSP00000447881
MSIRVTQKSYKVSTSGPRAFSSRSYTSGPGSRISSSSFSRVGSSNFRGGLGGGYGGASGMGGITAVTVNQSLLSPLVLEVDPNIQAVRTQEKEQIKTLNNKFASFIDKVRFLEQQNKMLETKWSLLQQQKTARSNMDNMFESYINNLRRQLETLGQEKLKLEAELGNMQGLVEDFKNKYEDEINKRTEMENEFVLIKKDVDEAYMNKVELESRLEGLTDEINFLRQLYEEEIRELQSQISDTSVVLSMDNSRSLDMDSIIAEVKAQYEDIANR

SEQ ID NO: 43049 - protein, 35 aa, Homo sapiens
  Payload ID: 8784
  Gene Symbol: KRT8
  Gene Name: keratin 8, type II
  ENSP ID: ENSP00000449010
  MOD_RES (1)..(1): Any amino acid
XLETLGQEKLKLEAELGNMQGLVEDFKNKMWMKLT

SEQ ID NO: 43050 - protein, 511 aa, Homo sapiens
  Payload ID: 8784
  Gene Symbol: KRT8
  Gene Name: keratin 8, type II
  Uniprot ID: P05787
  ENSP ID: ENSP00000449404
MNGVSWSQDLQEGISAWFGPPASTPASTMSIRVTQKSYKVSTSGPRAFSSRSYTSGPGSRISSSSFSRVGSSNFRGGLGGGYGGASGMGGITAVTVNQSLLSPLVLEVDPNIQAVRTQEKEQIKTLNNKFASFIDKVRFLEQQNKMLETKWSLLQQQKTARSNMDNMFESYINNLRRQLETLGQEKLKLEAELGNMQGLVEDFKNKYEDEINKRTEMENEFVLIKKDVDEAYMNKVELESRLEGLTDEINFLRQLYEEEIRELQSQISDTSVVLSMDNSRSLDMDSIIAEVKAQYEDIANRSRAEAESMYQIKYEELQSLAGKHGDDLRRTKTEISEMNRNISRLQAEIEGLKGQRASLEAAIADAEQRGELAIKDANAKLSELEAALQRAKQDMARQLREYQELMNVKLALDIEIATYRKLLEGEESRLESGMQNMSIHTKTTSGYAGGLSSAYGGLTSPGLSYSLGSSFGSGAGSSSFSRTSSSRAVVVKKIETRDGKLVSESSDVLPK

SEQ ID NO: 43051 - protein, 180 aa, Homo sapiens
  Payload ID: 8784
  Gene Symbol: KRT8
  Gene Name: keratin 8, type II
  ENSP ID: ENSP00000450228
MGKKLYICPPSRWSPPSLGQGYVTCPSPQGDLAVICWSSEFSFIQSPHHTLQYLPENPAPAIRISAWFGPPASTPASTMSIRVTQKSYKVSTSGPRAFSSRSYTSGPGSRISSSSFSRVGSSNFRGGLGGGYGGASGMGGITAVTVNQSLLSPLVLEVDPNIQAVRTQEKEQIKTLNNKF

SEQ ID NO: 43052 - protein, 113 aa, Homo sapiens
  Payload ID: 8784
  Gene Symbol: KRT8
  Gene Name: keratin 8, type II
  ENSP ID: ENSP00000450340
MLETKWSLLQQQKTARSNMDNMFESYINNLRRQLETLGQEKLKLEAELGNMQGLVEDFKNKYEDEINKRTEMENEFVLIKKDVDEAYMNKVELESRLEGLTDEINFLRQLYEE

SEQ ID NO: 43053 - protein, 32 aa, Homo sapiens
  Payload ID: 8784
  Gene Symbol: KRT8
  Gene Name: keratin 8, type II
  ENSP ID: ENSP00000489174
MEIQCSRILLSSLRFSVSRLLTLSRWRRCWRV

SEQ ID NO: 43054 - protein, 422 aa, Homo sapiens
  Payload ID: 8785
  Gene Symbol: KRT80
  Gene Name: keratin 80, type II
  Uniprot ID: Q6KB66
  ENSP ID: ENSP00000369361
MACRSCVVGFSSLSSCEVTPVGSPRPGTSGWDSCRAPGPGFSSRSLTGCWSAGTISKVTVNPGLLVPLDVKLDPAVQQLKNQEKEEMKALNDKFASLIGKVQALEQRNQLLETRWSFLQGQDSAIFDLGHLYEEYQGRLQEELRKVSQERGQLEANLLQVLEKVEEFRIRYEDEISKRTDMEFTFVQLKKDLDAECLHRTELETKLKSLESFVELMKTIYEQELKDLAAQVKDVSVTVGMDSRCHIDLSGIVEEVKAQYDAVAARSLEEAEAYSRSQLEEQAARSAEYGSSLQSSRSEIADLNVRIQKLRSQILSVKSHCLKLEENIKTAEEQGELAFQDAKTKLAQLEAALQQAKQDMARQLRKYQELMNVKLALDIEIATYRKLVEGEEGRMDSPSATVVSAVQSRCKTAPSLPYPLCSL

SEQ ID NO: 43055 - protein, 452 aa, Homo sapiens
  Payload ID: 8785
  Gene Symbol: KRT80
  Gene Name: keratin 80, type II
  Uniprot ID: Q6KB66
  ENSP ID: ENSP00000378292
MACRSCVVGFSSLSSCEVTPVGSPRPGTSGWDSCRAPGPGFSSRSLTGCWSAGTISKVTVNPGLLVPLDVKLDPAVQQLKNQEKEEMKALNDKFASLIGKVQALEQRNQLLETRWSFLQGQDSAIFDLGHLYEEYQGRLQEELRKVSQERGQLEANLLQVLEKVEEFRIRYEDEISKRTDMEFTFVQLKKDLDAECLHRTELETKLKSLESFVELMKTIYEQELKDLAAQVKDVSVTVGMDSRCHIDLSGIVEEVKAQYDAVAARSLEEAEAYSRSQLEEQAARSAEYGSSLQSSRSEIADLNVRIQKLRSQILSVKSHCLKLEENIKTAEEQGELAFQDAKTKLAQLEAALQQAKQDMARQLRKYQELMNVKLALDIEIATYRKLVEGEEGRMDSPSATVVSAVQSRCKTAASRSGLSKAPSRKKKGSKGPVIKITEMSEKYFSQESEVSE

SEQ ID NO: 43056 - protein, 505 aa, Homo sapiens
  Payload ID: 8786
  Gene Symbol: KRT81
  Gene Name: keratin 81, type II
  Uniprot ID: Q14533
  ENSP ID: ENSP00000369349
MTCGSGFGGRAFSCISACGPRPGRCCITAAPYRGISCYRGLTGGFGSHSVCGGFRAGSCGRSFGYRSGGVCGPSPPCITTVSVNESLLTPLNLEIDPNAQCVKQEEKEQIKSLNSRFAAFIDKVRFLEQQNKLLETKLQFYQNRECCQSNLEPLFEGYIETLRREAECVEADSGRLASELNHVQEVLEGYKKKYEEEVSLRATAENEFVALKKDVDCAYLRKSDLEANVEALIQEIDFLRRLYEEEILILQSHISDTSVVVKLDNSRDLNMDCIIAEIKAQYDDIVTRSRAEAESWYRSKCEEMKATVIRHGETLRRTKEEINELNRMIQRLTAEVENAKCQNSKLEAAVAQSEQQGEAALSDARCKLAELEGALQKAKQDMACLIREYQEVMNSKLGLDIEIATYRRLLEGEEQRLCEGIGAVNVCVSSSRGGVVCGDLCVSGSRPVTGSVCSAPCNGNVAVSTGLCAPCGQLNTTCGGGSCGVGSCGISSLGVGSCGSSCRKC

SEQ ID NO: 43057 - protein, 484 aa, Homo sapiens
  Payload ID: 8786
  Gene Symbol: KRT81
  Gene Name: keratin 81, type II
  ENSP ID: ENSP00000483796
MTCGSGFGGRAFSCISACGPRPGRCCITAAPYRGISCYRGLTGGFGSHSVCGGFRAGSCGRSFGYRSGGVCGPSPPCITTVSVNESLLTPLNLEIDPNAQCVKQEEKEQIKSLNSRFAAFIDKVRFLEQQNKLLETKLQFYQNRECCQSNLEPLFEGYIETLRREAECVEADSGRLASELNHVQEVLEGYKKKYEEEVSLRATAENEFVALKKDVDCAYLRKSDLEANVEALIQEIDFLRRLYEEEILILQSHISDTSVVVKLDNSRDLNMDCIIAEIKAQYDDIVTRSRAEAESWYRSKCEEMKATVIRHGETLRRTKEEINELNRMIQRLTAEVENAKCQNSKLEAAVAQSEQQGEAALSDARCKLAELEGALQKAKQDMACLIREYQEVMNSKLGLDIEIATYRRLLEGEEQRLCEGIGAVNVCVSSSRGGVVCGDLCVSGSRPVTGSVCSAPCNGNVAVSTGLCAPCGQVGSCGSSCRKC

SEQ ID NO: 43058 - protein, 513 aa, Homo sapiens
  Payload ID: 8787
  Gene Symbol: KRT82
  Gene Name: keratin 82, type II
  Uniprot ID: Q9NSB4
  ENSP ID: ENSP00000257974
MSYHSFQPGSRCGSQSFSSYSAVMPRMVTHYAVSKGPCRPGGGRGLRALGCLGSRSLCNVGFGRPRVASRCGGTLPGFGYRLGATCGPSACITPVTINESLLVPLALEIDPTVQRVKRDEKEQIKCLNNRFASFINKVRFLEQKNKLLETKWNFMQQQRCCQTNIEPIFEGYISALRRQLDCVSGDRVRLESELCSLQAALEGYKKKYEEELSLRPCVENEFVALKKDVDTAFLMKADLETNAEALVQEIDFLKSLYEEEICLLQSQISETSVIVKMDNSRELDVDGIIAEIKAQYDDIASRSKAEAEAWYQCRYEELRVTAGNHCDNLRNRKNEILEMNKLIQRLQQETENVKAQRCKLEGAIAEAEQQGEAALNDAKCKLAGLEEALQKAKQDMACLLKEYQEVMNSKLGLDIEIATYRRLLEGEEHRLCEGIGPVNISVSSSKGAFLYEPCGVSTPVLSTGVLRSNGGCSIVGTGELYVPCEPQGLLSCGSGRKSSMTLGAGGSSPSHKH

SEQ ID NO: 43059 - protein, 493 aa, Homo sapiens
  Payload ID: 8788
  Gene Symbol: KRT83
  Gene Name: keratin 83, type II
  Uniprot ID: P78385
  ENSP ID: ENSP00000293670
MTCGFNSIGCGFRPGNFSCVSACGPRPSRCCITAAPYRGISCYRGLTGGFGSHSVCGGFRAGSCGRSFGYRSGGVCGPSPPCITTVSVNESLLTPLNLEIDPNAQCVKQEEKEQIKSLNSRFAAFIDKVRFLEQQNKLLETKLQFYQNRECCQSNLEPLFAGYIETLRREAECVEADSGRLASELNHVQEVLEGYKKKYEEEVALRATAENEFVALKKDVDCAYLRKSDLEANVEALIQEIDFLRRLYEEEIRILQSHISDTSVVVKLDNSRDLNMDCIVAEIKAQYDDIATRSRAEAESWYRSKCEEMKATVIRHGETLRRTKEEINELNRMIQRLTAEVENAKCQNSKLEAAVAQSEQQGEAALSDARCKLAELEGALQKAKQDMACLIREYQEVMNSKLGLDIEIATYRRLLEGEEQRLCEGVEAVNVCVSSSRGGVVCGDLCVSGSRPVTGSVCSAPCNGNLVVSTGLCKPCGQLNTTCGGGSCGQGRH

SEQ ID NO: 43060 - protein, 600 aa, Homo sapiens
  Payload ID: 8789
  Gene Symbol: KRT84
  Gene Name: keratin 84, type II
  Uniprot ID: Q9NSB2
  ENSP ID: ENSP00000257951
MSCRSYRVSSGHRVGNFSSCSAMTPQNLNRFRANSVSCWSGPGFRGLGSFGSRSVITFGSYSPRIAAVGSRPIHCGVRFGAGCGMGFGDGRGVGLGPRADSCVGLGFGAGSGIGYGFGGPGFGYRVGGVGVPAAPSITAVTVNKSLLTPLNLEIDPNAQRVKKDEKEQIKTLNNKFASFIDKVRFLEQQNKLLETKWSFLQEQKCIRSNLEPLFESYITNLRRQLEVLVSDQARLQAERNHLQDVLEGFKKKYEEEVVCRANAENEFVALKKDVDAAFMNKSDLEANVDTLTQEIDFLKTLYMEEIQLLQSHISETSVIVKMDNSRDLNLDGIIAEVKAQYEEVARRSRADAEAWYQTKYEEMQVTAGQHCDNLRNIRNEINELTRLIQRLKAEIEHAKAQRAKLEAAVAEAEQQGEATLSDAKCKLADLECALQQAKQDMARQLCEYQELMNAKLGLDIEIATYRRLLEGEESRLCEGVGPVNISVSSSRGGLVCGPEPLVAGSTLSRGGVTFSGSSSVCATSGVLASCGPSLGGARVAPATGDLLSTGTRSGSMLISEACVPSVPCPLPTQGGFSSCSGGRSSSVRFVSTTTSCRTKY

SEQ ID NO: 43061 - protein, 507 aa, Homo sapiens
  Payload ID: 8790
  Gene Symbol: KRT85
  Gene Name: keratin 85, type II
  Uniprot ID: P78386
  ENSP ID: ENSP00000257901
MSCRSYRISSGCGVTRNFSSCSAVAPKTGNRCCISAAPYRGVSCYRGLTGFGSRSLCNLGSCGPRIAVGGFRAGSCGRSFGYRSGGVCGPSPPCITTVSVNESLLTPLNLEIDPNAQCVKQEEKEQIKSLNSRFAAFIDKVRFLEQQNKLLETKWQFYQNQRCCESNLEPLFSGYIETLRREAECVEADSGRLASELNHVQEVLEGYKKKYEEEVALRATAENEFVVLKKDVDCAYLRKSDLEANVEALVEESSFLRRLYEEEIRVLQAHISDTSVIVKMDNSRDLNMDCIIAEIKAQYDDVASRSRAEAESWYRSKCEEMKATVIRHGETLRRTKEEINELNRMIQRLTAEIENAKCQRAKLEAAVAEAEQQGEAALSDARCKLAELEGALQKAKQDMACLLKEYQEVMNSKLGLDIEIATYRRLLEGEEHRLCEGVGSVNVCVSSSRGGVSCGGLSYSTTPGRQITSGPSAIGGSITVVAPDSCAPCQPRSSSFSCGSSRSVRFA

SEQ ID NO: 43062 - protein, 295 aa, Homo sapiens
  Payload ID: 8790
  Gene Symbol: KRT85
  Gene Name: keratin 85, type II
  ENSP ID: ENSP00000440240
MVFKVQFLSSRPSLSHTQDVDCAYLRKSDLEANVEALVEESSFLRRLYEEEIRVLQAHISDTSVIVKMDNSRDLNMDCIIAEIKAQYDDVASRSRAEAESWYRSKCEEMKATVIRHGETLRRTKEEINELNRMIQRLTAEIENAKCQRAKLEAAVAEAEQQGEAALSDARCKLAELEGALQKAKQDMACLLKEYQEVMNSKLGLDIEIATYRRLLEGEEHRLCEGVGSVNVCVSSSRGGVSCGGLSYSTTPGRQITSGPSAIGGSITVVAPDSCAPCQPRSSSFSCGSSRSVRFA

SEQ ID NO: 43063 - protein, 486 aa, Homo sapiens
  Payload ID: 8791
  Gene Symbol: KRT86
  Gene Name: keratin 86, type II
  Uniprot ID: O43790
  ENSP ID: ENSP00000293525
MTCGSYCGGRAFSCISACGPRPGRCCITAAPYRGISCYRGLTGGFGSHSVCGGFRAGSCGRSFGYRSGGVCGPSPPCITTVSVNESLLTPLNLEIDPNAQCVKQEEKEQIKSLNSRFAAFIDKVRFLEQQNKLLETKLQFYQNRECCQSNLEPLFEGYIETLRREAECVEADSGRLASELNHVQEVLEGYKKKYEEEVSLRATAENEFVALKKDVDCAYLRKSDLEANVEALIQEIDFLRRLYEEEIRVLQSHISDTSVVVKLDNSRDLNMDCIIAEIKAQYDDIVTRSRAEAESWYRSKCEEMKATVIRHGETLRRTKEEINELNRMIQRLTAEVENAKCQNSKLEAAVAQSEQQGEAALSDARCKLAELEGALQKAKQDMACLIREYQEVMNSKLGLDIEIATYRRLLEGEEQRLCEGVGSVNVCVSSSRGGVVCGDLCASTTAPVVSTRVSSVPSNSNVVVGTTNACAPSARVGVCGGSCKRC

SEQ ID NO: 43064 - protein, 486 aa, Homo sapiens; identical to SEQ ID NO: 43063
  Payload ID: 8791
  Gene Symbol: KRT86
  Gene Name: keratin 86, type II
  Uniprot ID: O43790
  ENSP ID: ENSP00000444533

SEQ ID NO: 43065 - protein, 143 aa, Homo sapiens
  Payload ID: 8791
  Gene Symbol: KRT86
  Gene Name: keratin 86, type II
  ENSP ID: ENSP00000452237
MTCGSYCGGRAFSCISACGPRPGRCCITAAPYRGISCYRGLTGGFGSHSVCGGFRAGSCGRSFGYRSGGVCGPSPPCITTVSVNESLLTPLNLEIDPNAQCVKQEEKEQIKSLNSRFAAFIDKVRFLEQQNKLLETKLQFYQN

SEQ ID NO: 43066 - protein, 623 aa, Homo sapiens
  Payload ID: 8792
  Gene Symbol: KRT9
  Gene Name: keratin 9, type I
  Uniprot ID: P35527
  ENSP ID: ENSP00000246662
MSCRQFSSSYLSRSGGGGGGGLGSGGSIRSSYSRFSSSGGGGGGGRFSSSSGYGGGSSRVCGRGGGGSFGYSYGGGSGGGFSASSLGGGFGGGSRGFGGASGGGYSSSGGFGGGFGGGSGGGFGGGYGSGFGGFGGFGGGAGGGDGGILTANEKSTMQELNSRLASYLDKVQALEEANNDLENKIQDWYDKKGPAAIQKNYSPYYNTIDDLKDQIVDLTVGNNKTLLDIDNTRMTLDDFRIKFEMEQNLRQGVDADINGLRQVLDNLTMEKSDLEMQYETLQEELMALKKNHKEEMSQLTGQNSGDVNVEINVAPGKDLTKTLNDMRQEYEQLIAKNRKDIENQYETQITQIEHEVSSSGQEVQSSAKEVTQLRHGVQELEIELQSQLSKKAALEKSLEDTKNRYCGQLQMIQEQISNLEAQITDVRQEIECQNQEYSLLLSIKMRLEKEIETYHNLLEGGQEDFESSGAGKIGLGGRGGSGGSYGRGSRGGSGGSYGGGGSGGGYGGGSGSRGGSGGSYGGGSGSGGGSGGGYGGGSGGGHSGGSGGGHSGGSGGNYGGGSGSGGGSGGGYGGGSGSRGGSGGSHGGGSGFGGESGGSYGGGEEASGSGGGYGGGSGKSSHS

SEQ ID NO: 43067 - protein, 390 aa, Homo sapiens
  Payload ID: 8792
  Gene Symbol: KRT9
  Gene Name: keratin 9, type I
  ENSP ID: ENSP00000467932
MTLDDFRIKFEMEQNLRQGVDADINGLRQVLDNLTMEKSDLEMQYETLQEELMALKKNHKEEMSQLTGQNSGDVNVEINVAPGKDLTKTLNDMRQEYEQLIAKNRKDIENQYETQITQIEHEVSSSGQEVQSSAKEVTQLRHGVQELEIELQSQLSKKAALEKSLEDTKNRYCGQLQMIQEQISNLEAQITDVRQEIECQNQEYSLLLSIKMRLEKEIETYHNLLEGGQEDFESSGAGKIGLGGRGGSGGSYGRGSRGGSGGSYGGGGSGGGYGGGSGSRGGSGGSYGGGSGSGGGSGGGYGGGSGGGHSGGSGGGHSGGSGGNYGGGSGSGGGSGGGYGGGSGSRGGSGGSHGGGSGFGGESGGSYGGGEEASGSGGGYGGGSGKSSHS

SEQ ID NO: 43068 - protein, 282 aa, Homo sapiens
  Payload ID: 8793
  Gene Symbol: KRTAP10-1
  Gene Name: keratin associated protein 10-1
  Uniprot ID: P60331
  ENSP ID: ENSP00000383226
MAASTMSVCSSACSDSWQVDACPESCCEPHCCALSCCAPAPCLTLVCTPVSRVSSPCCQAACEPSPCQSGCTSSCTPSCCQQSSCQPACCTSSPCQQACCVPVCCKPVCCLPTCSKDSSSCCQQSSCQPTCCASSSSQQSCCVPVCCKPVCYVPTCSEDSSSCCQQSSCHPACCTSSPCQQACCVPVRCKPVCCKPICCVPVCSGASTSCCQQSSCQPACCTTSCCRPSSSVSLLCRPVCRPACCMPVSSCCAPASSCQASCCRPASCVSLLCRPACSRPAC

SEQ ID NO: 43069 - protein, 251 aa, Homo sapiens
  Payload ID: 8794
  Gene Symbol: KRTAP10-10
  Gene Name: keratin associated protein 10-10
  Uniprot ID: P60014
  ENSP ID: ENSP00000369438
MAASTMSICSSACTDSWRVVDCPESCCEPCCCAPAPSLTLVCTPVSCVSSPCCQTACEPSACQSGYTSSCTTPCYQQSSCQPDCCTSSPCQQACCVPVCCVPVCCVPVCNKPVCFVPTCSESSPSCCQQSSCQPTCCTSSPCQQACCVPVCSKSVCYVPVCSGASTSCCQQSSCQPACCTASCCRPSSSVSLLCHPVCKSTCCVPVPSCGASASSCQPSCCRTASCVSLLCRPVCSRPACYSLCSGQKSSC

SEQ ID NO: 43070 - protein, 298 aa, Homo sapiens
  Payload ID: 8795
  Gene Symbol: KRTAP10-11
  Gene Name: keratin associated protein 10-11
  Uniprot ID: P60412
  ENSP ID: ENSP00000334197
MAASTMSVCSSAYSDSWQVDDCPESCCEPPCSAPSCCAPAPSLSLVCTPVSCVSSPCCQAACEPSACQSGCTSSCTPSCCQQSSCQPACCTSSPCQQACCVPVCCKTVCCKPVCCVPVCCGAASSCCRQSSCQPACCASSSCQPACCVPVCCKPVCCVSTCSEDSSSCCQQSSCQPACCTSSSYQQACCVPVCCKTVYCKPICCVPVCSRASSSRCQQPSCQPACCTTSCCRPSSSVSLLCHPVCRSTCCVPVSSCCAPTSSCQSSCCRPASCVSLLCRPASSRLACYSLCSGKKSSC

SEQ ID NO: 43071 - protein, 245 aa, Homo sapiens
  Payload ID: 8796
  Gene Symbol: KRTAP10-12
  Gene Name: keratin associated protein 10-12
  Uniprot ID: P60413
  ENSP ID: ENSP00000383216
MSVCSSDLSYGSRVCLPGSCDSCSDSWQVDDCPESCCEPPCCAPAPCLSLVCTPVSRVSSPCCRVTCEPSPCQSGCTSSCTPSCCQQSSCQPACCTSSPCQQACCVPVCCKTVCCKPVCCMPVCCGPSSSCCQQSSCQPACCISSPCQQSCCVPVCCKPICCVPVCSGASSLCCQQSSCQPACCTTSCCRPSSSVSLLCRPVCRPARRVPVPSCCVPTSSCQPSCGRLASCGSLLCRPTCSRLAC

SEQ ID NO: 43072 - protein, 94 aa, Homo sapiens
  Payload ID: 8796
  Gene Symbol: KRTAP10-12
  Gene Name: keratin associated protein 10-12
  ENSP ID: ENSP00000482575
CTSSCTPSCCQQSSCQPACCTSSPCQQACCVPVCCKTVCCKPSSCQPACCISSPCQQSCCVPVCCKPICCVPPACCTTSCCRPSSSVSLLCRPV

SEQ ID NO: 43073 - protein, 255 aa, Homo sapiens
  Payload ID: 8797
  Gene Symbol: KRTAP10-2
  Gene Name: keratin associated protein 10-2
  Uniprot ID: P60368
  ENSP ID: ENSP00000375479
MAASTMSICSSACTNSWQVDDCPESCCELPCGTPSCCAPAPCLTLVCTPVSCVSSPCCQAACEPSACQSGCTSSCTPSCCQQSSCQPACCTSSPCQQACCVPVCCKPVCCVPVCCGASSCCQQSSCQPACCASSSCQQSCRVPVCCKAVCCVPTCSESSSSCCQQSSCQPACCTSSPCQQSCCVSVCCKPVCCKSICCVPVCSGASSPCCQQSSCQPACCTSSCCRPSSSVSLLCRPVCSRPASCSFSSGQKSSC

SEQ ID NO: 43074 - protein, 221 aa, Homo sapiens
  Payload ID: 8798
  Gene Symbol: KRTAP10-3
  Gene Name: keratin associated protein 10-3
  Uniprot ID: P60369
  ENSP ID: ENSP00000375478
MATSTMSVCSSAYSDSWQVDACPESCCEPPCCATSCCAPAPCLTLVCTPVSCVSSPCCQAACEPSPCQSGCTSSCTPSCCQQSSCQPACCTSSPCQQACCVPVCCKPVCCVPVCCKPVCCKPICCVPVCSGASSSCCQQSSRQPACCTTSCCRPSSSVSLLCRPVCRSTCCVPIPSCCAPASTCQPSCCRPASCVSLLCRPTCSRLSSACCGLSSGQKSSC

SEQ ID NO: 43075 - protein, 401 aa, Homo sapiens
  Payload ID: 8799
  Gene Symbol: KRTAP10-4
  Gene Name: keratin associated protein 10-4
  Uniprot ID: P60372
  ENSP ID: ENSP00000383225
MSVCSSDLSYSSRVCLPGSCDSCSDSWQVDDCPESCCEPPCCAPSCCAPAPCLSLVCTPVSRVSSPCCPVTCEPSPCQSGCTSSCTPSCCQQSSCQLACCASSPCQQACCVPVCCKTVCCKPVCCVPVCCGDSSCCQQSSCQSACCTSSPCQQACCVPICCKPVCSGISSSCCQQSSCVSCVSSPCCQAVCEPSPCQSGCISSCTPSCCQQSSCQPACCTSSSCQQACCVPVCCKTVCCKPVCSEDSSSCCQQSSCQPACCTSSPCQQACCVPVCCKPVCCKPVCSVPICSGASSLCCQQSSCQPACCTSSQSQQGCCVPVCCKPVSCVPVCSGASSSCCQQSSCQPACCTTSCCRPSSSVSLLCRPVCRPACCVPVPSCCAPTSSCQPSCCRPASCVSLL

SEQ ID NO: 43076 - protein, 271 aa, Homo sapiens
  Payload ID: 8800
  Gene Symbol: KRTAP10-5
  Gene Name: keratin associated protein 10-5
  Uniprot ID: P60370
  ENSP ID: ENSP00000383223
MAACTMSVCSSACSDSWRVDDCPESCCEPPCGTAPCLTLVCTPVSCVSSPCCQAACEPSPCQSGCTSSCTPSCCQPACCASSPCQQACCVPVCCKPVCCLPTCSKDSSSCCQQSSCQPTCCASSSCQQSCCVPVCCKPVCCVPTCSEDSSSCCQHSSCQPTCCTSSPCQQSCYVPVCCKPVCCKPICCVPVCSGASTSCCQQSSCQPACCTTSCCRPSSSVSLLCRPICRPACCLPISSCCAPASSYQASCCRPASCVSLLCRPACSPLAC

SEQ ID NO: 43077 - protein, 365 aa, Homo sapiens
  Payload ID: 8801
  Gene Symbol: KRTAP10-6
  Gene Name: keratin associated protein 10-6
  Uniprot ID: P60371
  ENSP ID: ENSP00000383219
MAASTMSVCSSDLSYGSRVCLPGSCDSCSDSWQVDDCPESCCEPPCCAPAPCLSLVCTPVSRVSSPCCPVTCEPSPCQSGCTSSCTPSCCQQSSCQLACCASSPCQQACCVPVCCKTVCCKPVCCVSVCCGDSSCCQQSSCQSACCTSSPCQQACCVPVCCKPVCSGISSSCCQQSSCVSCVSSPCCQAVCEPSPCQSGCTSSCTPSCCQQSSCQPTCCTSSPCQQACCVPVCCVPVCCVPTCSEDSSSCCQQSSCQPACCTSSPCQHACCVPVCSGASTSCCQQSSCQPACCTASCCRSSSSVSLLCHPVCKSTCCVPVPSCGASASSCQPSCCRTASCVSLLCRPMCSRPACYSLCSGQKSSC

SEQ ID NO: 43078 - protein, 244 aa, Homo sapiens
  Payload ID: 8801
  Gene Symbol: KRTAP10-6
  Gene Name: keratin associated protein 10-6
  ENSP ID: ENSP00000484068
MSVCSSDLSYGSRVCLPGSCDSCSDSWQVDDCPESCCEPPCCAPAPCLSLVCTPVSRVSSPCCPVTCEPSPCQSGCTSSCTPSCCQQSSCQLACCASSPCQQACCVPVCCKTVCCKPVCCVSVCCGDSSCCQQSSCQSACCTSSPCQQACCVPVCCKPICCVPVCSGASTSCCQQSSCQPACCTTSCCRPSSSVSLLCRPICRPACCLPISSCCAPASSYQASCCRPASCVSLLCRPACSPLAC

SEQ ID NO: 43079 - protein, 370 aa, Homo sapiens
  Payload ID: 8802
  Gene Symbol: KRTAP10-7
  Gene Name: keratin associated protein 10-7
  Uniprot ID: P60409
  ENSP ID: ENSP00000476821
MAASTMSVCSSDLSYGSRVCLPGSCDSCSDSWQVDDCPESCCEPPCCAPAPCLSLVCTPVSYVSSPCCRVTCEPSPCQSGCTSSCTPSCCQQSSCQLACCASSPCQQACCVPVCCKTVCCKPVYCVPVCSGDSSCCQQSSCQSACCTSSPCQQACCVPICCKPVCSGISSSCCQQSSCVSCVSSPCCQAVCEPSPCQSGCISSCTPSCCQQSSCKPACCTSSPCQQACCVPVCCKPVCCVPTCSDDSGSCCQPACCTSSQSQQGCCVPVCCKPVCCVPVCSGASTSCCQQSSCQPACCTTSCCRPSSSVSLLCRPVCRPACCVPVPSCCAPTSSCQASCCRPASCVSLLCRPACSRPACCGPTSTQKSSC

SEQ ID NO: 43080 - protein, 245 aa, Homo sapiens
  Payload ID: 8802
  Gene Symbol: KRTAP10-7
  Gene Name: keratin associated protein 10-7
  ENSP ID: ENSP00000481165
MSVCSSDLSYGSRVCLPGSCDSCSDSWQVDDCPESCCEPPCCAPAPCLSLVCTPVSYVSSPCCRVTCEPSPCQSGCTSSCTPSCCQQSSCQLACCASSPCQQACCVPVCCKTVCCKPVCCVPVCSGASTSCCQQSSCQSACCTFSPCQQACCVPICCKPICCVPVCSGASSLCCQKSSCQPACCTTSCCRPSSSVSLLCRPVCRPACCVPVPSCCVPASSCQPSCCHPASCLSFLCRPACSRLAC

SEQ ID NO: 43081 - protein, 259 aa, Homo sapiens
  Payload ID: 8803
  Gene Symbol: KRTAP10-8
  Gene Name: keratin associated protein 10-8
  Uniprot ID: P60410
  ENSP ID: ENSP00000335565
MADACCTRTYVIAASTMSVCSSDVGHVSRVSSPSTCTGSSWQVDNCQESCCEPRSCASSCCTPSCCAPAPCLALVCAPVSCEPSPCQSGCTDSCTPSCCQQSSCQPACCTSSPCQQACCVPVCCKSNCCKPVCCVSICSGASSPCCQQSSCQSACCTFSPCQQACCVPICCKPICCVPVCSGASSLCCQKSSCQPACCTTSCCRPSSSVSLLCRPVCRPACCVPVPSCCVPASSCQPSCCHPASCLSFLCRPACSRLAC

SEQ ID NO: 43082 - protein, 292 aa, Homo sapiens
  Payload ID: 8804
  Gene Symbol: KRTAP10-9
  Gene Name: keratin associated protein 10-9
  Uniprot ID: P60411
  ENSP ID: ENSP00000381009
MAASTMSIRSSAYSDSWQVDDCPESCCEPPCCATSCCAPAPCLTLVCTPVSRVSSPCCQVTCEPSPCQSGCTSSCTPSCCQQSSCQPAYCTSSPCQQACCVPVCCKPVCCVPVCCGASSCCQQSSYQPACCASSSCQPACCVPVCCKPVCCAPTCSEDSYSCCQQSSCQPACCTSSPCQQSYCVPVCCKPVCCKPICCVPVCSGASSLCCQQSGCQPACCTTSCCRPSSSVSLLCRPVCRPACCVPVSSCCAPTSSRQPSYCRQASCVSLLCRPVCSRPACYSFSSGQKSSC

SEQ ID NO: 43083 - protein, 192 aa, Homo sapiens [sequence omitted]

SEQ ID NO: 43084 - protein, 177 aa, Homo sapiens
  Payload ID: 8805
  Gene Symbol: KRTAP1-1
  Gene Name: keratin associated protein 1-1
  Uniprot ID: Q07627
  ENSP ID: ENSP00000305975
MACCQTSFCGFPSCSTSGTCGSSCCQPSCCETSSCQPRCCETSCCQPSCCQTSFCGFPSFSTGGTCDSSCCQPSCCETSCCQPSCYQTSSCGTGCGIGGGIGYGQEGSSGAVSTRIRWCRPDCRVEGTCLPPCCVVSCTPPSCCQLHHAEASCCRPSYCGQSCCRPVCCCYCSEPTC

SEQ ID NO: 43085 - protein, 177 aa, Homo sapiens; identical to SEQ ID NO: 43084
  Payload ID: 8805
  Gene Symbol: KRTAP1-1
  Gene Name: keratin associated protein 1-1
  Uniprot ID: Q07627
  ENSP ID: ENSP00000460787

SEQ ID NO: 43086 - protein, 163 aa, Homo sapiens
  Payload ID: 8806
  Gene Symbol: KRTAP11-1
  Gene Name: keratin associated protein 11-1
  Uniprot ID: Q8IUC1
  ENSP ID: ENSP00000330720
MSFNCSTRNCSSRPIGGRCIVPVAQVTTTSTTDADCLGGICLPSSFQTGSWLLDHCQETCCEPTACQPTCYRRTSCVSNPCQVTCSRQTTCISNPCSTTYSRPLTFVSSGCQPLGGISSVCQPVGGISTVCQPVGGVSTVCQPACGVSRTYQQSCVSSCRRTC

SEQ ID NO: 43087 - protein, 96 aa, Homo sapiens
  Payload ID: 8807
  Gene Symbol: KRTAP12-1
  Gene Name: keratin associated protein 12-1
  Uniprot ID: P59990
  ENSP ID: ENSP00000375475
MCHTSCSSGCQPACCAPSPCQASCYIPVGCQSSVCVPVSFKPAVCVPVRCQSSVCVPVSCRPVVYAAPSCQSSGCCQPSCTSVLCRPISCSTPSCC

SEQ ID NO: 43088 - protein, 146 aa, Homo sapiens
  Payload ID: 8808
  Gene Symbol: KRTAP12-2
  Gene Name: keratin associated protein 12-2
  Uniprot ID: P59991
  ENSP ID: ENSP00000354001
MCHTSCSSGCQPACCAPSPCQPACCVPSSCQASCCVPVGCQSSVCVPVSFKPAVCLPVSCQSSVCVPMSFKSAVCVPVSCQSSVCVPVSCRPIVCAAPSCQSSLCVPVSCRPVVYAAPSCQSSGCCQPSCTSVLCRPISYSISSCC

SEQ ID NO: 43089 - protein, 96 aa, Homo sapiens
  Payload ID: 8809
  Gene Symbol: KRTAP12-3
  Gene Name: keratin associated protein 12-3
  Uniprot ID: P60328
  ENSP ID: ENSP00000381005
MCHTSCSPACQPTCCIHSPCQASCYVPVSCQSSVCMPVSCTRIVCVAPSCQPSVCVPVSCRPIIYVTPSCQSSGCCQPPCTTALCRPISCSTPSCC

SEQ ID NO: 43090 - protein, 146 aa, Homo sapiens
  Payload ID: 8809
  Gene Symbol: KRTAP12-3
  Gene Name: keratin associated protein 12-3
  ENSP ID: ENSP00000479723
CQSGCTSSCTPSCCQQSSCQPACCTSSPCQQACCVPVCCKTVCCKPSSCQPACCASSSCQPACCVPVCCKPASCYVPVSCQSSVCMPVSCTRIVCVAPSCQPSVCVPVSCRPIIYVTPSCQSSGCCQPPCTTALCRPISCSTPSCC

SEQ ID NO: 43091 - protein, 112 aa, Homo sapiens
  Payload ID: 8810
  Gene Symbol: KRTAP12-4
  Gene Name: keratin associated protein 12-4
  Uniprot ID: P60329
  ENSP ID: ENSP00000375476
MCHTSHSSGCPMACPGSPCCVPSTCYPPEGYGTSCCCSAPCVALLCRPLCGVSTCCQPACCVPSPCQVACCVPVSCKPVLCVASFCPTSGCCQPFCPTLVYRPVTWSTPTGC

SEQ ID NO: 43092 - protein, 167 aa, Homo sapiens
  Payload ID: 8811
  Gene Symbol: KRTAP1-3
  Gene Name: keratin associated protein 1-3
  Uniprot ID: Q8IUG1
  ENSP ID: ENSP00000344420
MTCCQTSFCGYPSCSTSGTCGSSCCQPSCCETSCCQPSCCQTSFCGFPSFSTSGTCSSSCCQPSCCETSCCQPSCCQTSSCGTGCGIGGGIGYGQEGSSGAVSTRIRWCRPDCRVEGTCLPPCCVVSCTPPTCCQLHHAEASCCRPSYCGQSCCRPVCCCYSCEPTC

SEQ ID NO: 43093 - protein, 167 aa, Homo sapiens; identical to SEQ ID NO: 43092
  Payload ID: 8811
  Gene Symbol: KRTAP1-3
  Gene Name: keratin associated protein 1-3
  Uniprot ID: Q8IUG1
  ENSP ID: ENSP00000461303

SEQ ID NO: 43094 - protein, 172 aa, Homo sapiens
  Payload ID: 8812
  Gene Symbol: KRTAP13-1
  Gene Name: keratin associated protein 13-1
  Uniprot ID: Q8IUC0
  ENSP ID: ENSP00000347635
MSYNCCSGNFSSRSCGGYLHYPASSCGFSYPSNQVYSTDLCSPSTCQLGSSLYRGCQQTCWEPTSCQTSYVESSPCQTSCYRPRTSLLCSPCQTTYSGSLGFGSSSCRSLGYGSRSCYSVGCGSSGFRSLGYGGCGFPSLGYGVGFCRPTYLASRSCQSSCYRPTCGSGFYY

SEQ ID NO: 43095 - protein, 175 aa, Homo sapiens
  Payload ID: 8813
  Gene Symbol: KRTAP13-2
  Gene Name: keratin associated protein 13-2
  Uniprot ID: Q52LG2
  ENSP ID: ENSP00000382777
MSYNCCSGNFSSRSCGDYLRYPASSRGFSYPSNLVYSTDLCSPSTCQLGSSLYRGCQEICWEPTSCQTSYVESSPCQTSCYRPRTSLLCSPCKTTYSGSLGFGSSSCRSLGYGSRSCYSVGCGSSGVRSLGYGSCGFPSLGYGSGFCRPTYLASRSCQSPCYRPAYGSTFCRSTC

SEQ ID NO: 43096 - protein, 161 aa, Homo sapiens
  Payload ID: 8813
  Gene Symbol: KRTAP13-2
  Gene Name: keratin associated protein 13-2
  ENSP ID: ENSP00000477629
MSYNCCSRNFSSCSHGGYLHYPGSSYPSNLVYSTDLCSPSTCQLGSSLYRGCQEICWEPTSCQTSCYRPRSSVLCSPCQSTYSESLGFGSSSCRSLGYGSRSCYSVGRGSSGVRSLGYGGCGFPSLGYGSGFCHPTYVLFRTFQSSCYRPTCGSGFYRSTC

SEQ ID NO: 43097 - protein, 172 aa, Homo sapiens
  Payload ID: 8814
  Gene Symbol: KRTAP13-3
  Gene Name: keratin associated protein 13-3
  Uniprot ID: Q3SY46
  ENSP ID: ENSP00000375109
MSYNCCSRNFSSCSHGGYLHYPGSSCGSSYPSNLVYSTDLCSPSTCQLGSSLYRGCQETCWRPNSCQTLCVESSPCHTSCYYPRTHMLCNSCLTMHVGSRGFGSNSCCSLSCGSRSCSSLGCGSNGFRYLNYRIHTSPSQSYRSRFCHPIYFPPRRWFHSSCYQPFCRSGFY

SEQ ID NO: 43098 - protein, 160 aa, Homo sapiens
  Payload ID: 8815
  Gene Symbol: KRTAP13-4
  Gene Name: keratin associated protein 13-4
  Uniprot ID: Q3LI77
  ENSP ID: ENSP00000334834
MSYNCCSRNFSSRSFGGYLYYPGSYPSSLVYSTALCSPSTCQLRSSLYRDCQKTCWEPASCQKSCYRPRTSILCCPCQTTCSGSLGFRSSSCRSQGYGSRCCYSLGNGSSGFRFLKYGGCGFPSLSYGSRFCYPNYLASGAWQSSCYRPICGSRFYQFTC

SEQ ID NO: 43099 - protein, 121 aa, Homo sapiens
  Payload ID: 8816
  Gene Symbol: KRTAP1-4
  Gene Name: keratin associated protein 1-4
  Uniprot ID: P0C5Y4
  ENSP ID: ENSP00000366976
MASCSTSGTCGSSCCQPSCCETSCCQPSCCQTSSCGTGCGIGGGIGYGQEGSGGSVSTRIRWCHPDCHVEGTCLPPCYLVSCTPPSCCQLHHAEASCCRPSYCGQSCCRPACCCHCCEPTC

SEQ ID NO: 43100 - protein, 121 aa, Homo sapiens; identical to SEQ ID NO: 43099
  Payload ID: 8816
  Gene Symbol: KRTAP1-4
  Gene Name: keratin associated protein 1-4
  Uniprot ID: P0C5Y4
  ENSP ID: ENSP00000458243

SEQ ID NO: 43101 - protein, 174 aa, Homo sapiens
  Payload ID: 8817
  Gene Symbol: KRTAP1-5
  Gene Name: keratin associated protein 1-5
  Uniprot ID: Q9BYS1
  ENSP ID: ENSP00000355302
MTCCQTSFCGYPSFSISGTCGSSCCQPSCCETSCCQPRSCQTSFCGFPSFSTSGTCSSSCCQPSCCETSCCQPSCCETSCCQPSCCQISSCGTGCGIGGGISYGQEGSSGAVSTRIRWCRPDSRVEGTYLPPCCVVSCTPPSCCQLHHAQASCCRPSYCGQSCCRPVCCCEPTC

SEQ ID NO: 43102 - protein, 174 aa, Homo sapiens; identical to SEQ ID NO: 43101
  Payload ID: 8817
  Gene Symbol: KRTAP1-5
  Gene Name: keratin associated protein 1-5
  Uniprot ID: Q9BYS1
  ENSP ID: ENSP00000461651

SEQ ID NO: 43103 - protein, 137 aa, Homo sapiens
  Payload ID: 8818
  Gene Symbol: KRTAP15-1
  Gene Name: keratin associated protein 15-1
  Uniprot ID: Q3LI76
  ENSP ID: ENSP00000334866
MSYNCSSGNFSSCCFGSYLRYPVSTYNLFYPSNAIYSPNTCQLGSSLYNGCQETYCEPTSCQTSCTLARSYQTSCYCPKNSIFCSPRQTNYIRSLGCGNTGLGSLGCGSTGFQSLDCGSSFYHPTTFSSRNFQATCY

SEQ ID NO: 43104 - protein, 517 aa, Homo sapiens
  Payload ID: 8819
  Gene Symbol: KRTAP16-1
  Gene Name: keratin associated protein 16-1
  Uniprot ID: A8MUX0
  ENSP ID: ENSP00000375147
MSGSCSSRKCFSVPATSLCSTEVSCGGPICLPSSCQSQTWQLVTCQDSCGSSSCGPQCRQPSCPVSSCAQPLCCDPVICEPSCSVSSGCQPVCCEATTCEPSCSVSNCYQPVCFEATICEPSCSVSNCCQPVCFEATVCEPSCSVSSCAQPVCCEPAICEPSCSVSSCCQPVGSEATSCQPVLCVPTSCQPVLCKSSCCQPVVCEPSCCSAVCTLPSSCQPVVCEPSCCQPVCPTPTCSVTSSCQAVCCDPSPCEPSCSESSICQPATCVALVCEPVCLRPVCCVQSSCEPPSVPSTCQEPSCCVSSICQPICSEPSPCSPAVCVSSPCQPTCYVVKRCPSVCPEPVSCPSTSCRPLSCSPGSSASAICRPTCPRTFYIPSSSKRPCSATISYRPVSRPICRPICSGLLTYRQPYMTSISYRPACYRPCYSILRRPACVTSYSCRPVYFRPSCTESDSCKRDCKKSTSSQLDCVDTTPCKVDVSEEAPCQPTEAKPISPTTREAAAAQPAASKPANC

SEQ ID NO: 43105 - protein, 517 aa, Homo sapiens; identical to SEQ ID NO: 43104
  Payload ID: 8819
  Gene Symbol: KRTAP16-1
  Gene Name: keratin associated protein 16-1
  Uniprot ID: A8MUX0
  ENSP ID: ENSP00000460805

SEQ ID NO: 43106 - protein, 105 aa, Homo sapiens
  Payload ID: 8820
  Gene Symbol: KRTAP17-1
  Gene Name: keratin associated protein 17-1
  Uniprot ID: Q9BYP8
  ENSP ID: ENSP00000333993
MGCCPGDCFTCCTQEQNCCEECCCQPGCCGCCGSCCGCGGSGCGGSGCGGSCCGSSCCGSGCGGCGGCGGCGGGCCGSSCCGSSCCGSGCCGPVCCQPTPICDTK

SEQ ID NO: 43107 - protein, 105 aa, Homo sapiens; identical to SEQ ID NO: 43106
  Payload ID: 8820
  Gene Symbol: KRTAP17-1
  Gene Name: keratin associated protein 17-1
  Uniprot ID: Q9BYP8
  ENSP ID: ENSP00000460320

SEQ ID NO: 43108 - protein, 90 aa, Homo sapiens
  Payload ID: 8821
  Gene Symbol: KRTAP19-1
  Gene Name: keratin associated protein 19-1
  Uniprot ID: Q8IUB9
  ENSP ID: ENSP00000375108
MSHYGSYYGGLGYSCGGFGGLGYGYGCGCGSFCRRGSGCGYGGYGYGSGFGSYGYGSGFGGYGYGSGFGGYGYGCCRPSYNGGYGFSGFY

SEQ ID NO: 43109 - protein, 52 aa, Homo sapiens
  Payload ID: 8822
  Gene Symbol: KRTAP19-2
  Gene Name: keratin associated protein 19-2
  Uniprot ID: Q3LHN2
  ENSP ID: ENSP00000335660
MCYGYGCGCGSFCRLGYGCGYEGCRYGCGHRGCGDGCCCPSCYRRYRFTGFY

SEQ ID NO: 43110 - protein, 81 aa, Homo sapiens
  Payload ID: 8823
  Gene Symbol: KRTAP19-3
  Gene Name: keratin associated protein 19-3
  Uniprot ID: Q7Z4W3
  ENSP ID: ENSP00000386376
MSYYGSYYGGLGYGCGGFGGLGYGYGCGCGSFRRLGSGCGYGGYGYGSGFGGYGYGSGFGGYGYGCYRPSYYGGYGFSGFY

SEQ ID NO: 43111 - protein, 72 aa, Homo sapiens
  Payload ID: 8823
  Gene Symbol: KRTAP19-3
  Gene Name: keratin associated protein 19-3
  ENSP ID: ENSP00000484197
MSYYGSYYGGLGYGCGGFGGLGYGYGCGCGSFRRLGSGCGYGGYGYGSGFGGYGYGCCRPSYNGGYGFSGFY

SEQ ID NO: 43112 - protein, 84 aa, Homo sapiens
  Payload ID: 8824
  Gene Symbol: KRTAP19-4
  Gene Name: keratin associated protein 19-4
  Uniprot ID: Q3LI73
  ENSP ID: ENSP00000335567
MSYYGSYYRGLGYGCGGFGGLGYGYGCGCGSFRRLGYGCGFGGNGYGYCRPSCYGGYGFSILLKSYPEDTISEVIRRSFNLTKY

SEQ ID NO: 43113 - protein, 72 aa, Homo sapiens
  Payload ID: 8825
  Gene Symbol: KRTAP19-5
  Gene Name: keratin associated protein 19-5
  Uniprot ID: Q3LI72
  ENSP ID: ENSP00000334985
MNYYGNYYGGLGYGYGGFDDLGYGYGCGCGSFRRLGYGGGYGGYGYGSGFGGYGYRSCRPSCYGGYGFSGFY

SEQ ID NO: 43114 - protein, 58 aa, Homo sapiens
  Payload ID: 8826
  Gene Symbol: KRTAP19-6
  Gene Name: keratin associated protein 19-6
  Uniprot ID: Q3LI70
  ENSP ID: ENSP00000375107
MRYYGSYYRGLGYGCGGFGGLGYGCGCGGYRYGSGYGGYRYGCCRPSCREGYGFSGFY

SEQ ID NO: 43115 - protein, 63 aa, Homo sapiens
  Payload ID: 8827
  Gene Symbol: KRTAP19-7
  Gene Name: keratin associated protein 19-7
  Uniprot ID: Q3SYF9
  ENSP ID: ENSP00000334696
MSYSGSYYGGLGYGCGGFGGLGYGYSCGCGSFRRLGYGCGYGGYRYSCCHPSCYGGYWSSGFY

SEQ ID NO: 43116 - protein, 72 aa, Homo sapiens
  Payload ID: 8827
  Gene Symbol: KRTAP19-7
  Gene Name: keratin associated protein 19-7
  ENSP ID: ENSP00000484007
MSYSGSYYGGLGYGCGGFGGLGYGYSCGCGSFRRLGYGCGYGGYRYGSGYGGYRYGCCRPSCREGYGFSGFY

SEQ ID NO: 43117 - protein, 63 aa, Homo sapiens
  Payload ID: 8828
  Gene Symbol: KRTAP19-8
  Gene Name: keratin associated protein 19-8
  Uniprot ID: Q3LI54
  ENSP ID: ENSP00000372272
MSYYRSYYGGLGYGYGGFGGWGYGYGCGYGSFRRLGYGCGYGGYGFSCCRPLYYGGYGFSAFY

SEQ ID NO: 43118 - protein, 56 aa, Homo sapiens
  Payload ID: 8829
  Gene Symbol: KRTAP20-1
  Gene Name: keratin associated protein 20-1
  Uniprot ID: Q3LI63
  ENSP ID: ENSP00000335503
MIYYSNYYGGYGYGGLGCGYGCGYRGYGCGYGGYGGYGNGYYCPSCYGRYWSYGFY

SEQ ID NO: 43119 - protein, 65 aa, Homo sapiens
  Payload ID: 8830
  Gene Symbol: KRTAP20-2
  Gene Name: keratin associated protein 20-2
  Uniprot ID: Q3LI61
  ENSP ID: ENSP00000330746
MCYYSNYYGGLRYGYGVLGGGYGCGCGYGHGYGGLGCGYGRGYGGYGYGCCRPSCYGRYWSCGFY

SEQ ID NO: 43120 - protein, 44 aa, Homo sapiens
  Payload ID: 8831
  Gene Symbol: KRTAP20-3
  Gene Name: keratin associated protein 20-3
  Uniprot ID: Q3LI60
  ENSP ID: ENSP00000372276
MSYYGNYYGGLGYGYDCKYSYTSGFGAFRILDCGYRCGCGGVWI

SEQ ID NO: 43121 - protein, 44 aa, Homo sapiens
  Payload ID: 8832
  Gene Symbol: KRTAP20-4
  Gene Name: keratin associated protein 20-4
  Uniprot ID: Q3LI62
  ENSP ID: ENSP00000372278
MSYYSHLSGGLGCGLAVAVTMGRTVAVAEYGRCRHGCHSSYSAR

SEQ ID NO: 43122 - protein, 128 aa, Homo sapiens
  Payload ID: 8833
  Gene Symbol: KRTAP2-1
  Gene Name: keratin associated protein 2-1
  Uniprot ID: Q9BYU5
  ENSP ID: ENSP00000375238
MTGSCCGSTFSSLSYGGGCCQPCCCRDPCCCRPVTCQTTVCRPVTCVPRCTRPICEPCRRPVCCDPCSLQEGCCRPITCCPSSCTAVVCRPCCWATTCCQPVSVQSPCCRPPCGQPTPCSTTCRTSSC

SEQ ID NO: 43123 - protein, 124 aa, Homo sapiens
  Payload ID: 8833
  Gene Symbol: KRTAP2-1
  Gene Name: keratin associated protein 2-1
  ENSP ID: ENSP00000446373
MTGSCCGSTFSSLSYGGGCCQPCCCRDPCCCRPVTCQTTVCRPVTCVPRCTRPICEPCRRPVCCDPCSLQEGCCRPITCCPSSCTAVVCRPCCWATTCCQPPVSVQSPCGQPTPCSTTCRTSSC

SEQ ID NO: 43124 - protein, 128 aa, Homo sapiens; identical to SEQ ID NO: 43122
  Payload ID: 8833
  Gene Symbol: KRTAP2-1
  Gene Name: keratin associated protein 2-1
  Uniprot ID: Q9BYU5
  ENSP ID: ENSP00000458444

SEQ ID NO: 43125 - protein, 124 aa, Homo sapiens; identical to SEQ ID NO: 43123
  Payload ID: 8833
  Gene Symbol: KRTAP2-1
  Gene Name: keratin associated protein 2-1
  ENSP ID: ENSP00000484076

SEQ ID NO: 43126 - protein, 79 aa, Homo sapiens
  Payload ID: 8834
  Gene Symbol: KRTAP21-1
  Gene Name: keratin associated protein 21-1
  Uniprot ID: Q3LI58
  ENSP ID: ENSP00000335566
MCCNYYGNSCGYGSGCGCGYGSGSGCGCGYGTGYGCGYGCGFGSHYGCGYGTGYGCGYGSGSGYCGYRPFCFRRCYSSC

SEQ ID NO: 43127 - protein, 83 aa, Homo sapiens
  Payload ID: 8835
  Gene Symbol: KRTAP21-2
  Gene Name: keratin associated protein 21-2
  Uniprot ID: Q3LI59
  ENSP ID: ENSP00000334287
MCCNYYRNCCGGCGYGSGWSSGCGYGCGYGCGYGSGCRYGSGYGTGCGYGCGYGSGCGYGCGYSSSCCGYRPLCYRRCYSSCY

SEQ ID NO: 43128 - protein, 58 aa, Homo sapiens
  Payload ID: 8836
  Gene Symbol: KRTAP21-3
  Gene Name: keratin associated protein 21-3
  Uniprot ID: Q3LHN1
  ENSP ID: ENSP00000404517
MYFNYKSVCGSCGFGSCYGCGYGCIHSTHCGCNGYYGCYENKYSVIDDLIFFASKKCH

SEQ ID NO: 43129 - protein, 123 aa, Homo sapiens
  Payload ID: 8837
  Gene Symbol: KRTAP2-2
  Gene Name: keratin associated protein 2-2
  Uniprot ID: Q9BYT5
  ENSP ID: ENSP00000381494
MTGSCCGSTFSSLSYGGGCCQPCCCRDPCCCRPVTCQTTVCRPVTCVPRCTRPICEPCRRPVCCDPCSLQEGCCRPITCCPSSCTAVVCRPCCWATTCCQPVSVQSPCGQPTPCSTTCRTSSC

SEQ ID NO: 43130 - protein, 129 aa, Homo sapiens
  Payload ID: 8837
  Gene Symbol: KRTAP2-2
  Gene Name: keratin associated protein 2-2
  ENSP ID: ENSP00000437407
MTGSCCGSTFSSLSYGGGCCQPCCCRDPCCCRPVTCQTTVCRPVTCVPRCTRPICEPCRRPVCCDPCSLQEGCCRPITCCPSSCTAVVCRPCCWATTCCQPVSVQSPCGQPSPCGQPTPCSTTCRTSSC

SEQ ID NO: 43131 - protein, 128 aa, Homo sapiens; identical to SEQ ID NO: 43122
  Payload ID: 8837
  Gene Symbol: KRTAP2-2
  Gene Name: keratin associated protein 2-2
  ENSP ID: ENSP00000461385

SEQ ID NO: 43132 - protein, 123 aa, Homo sapiens; identical to SEQ ID NO: 43129
  Payload ID: 8837
  Gene Symbol: KRTAP2-2
  Gene Name: keratin associated protein 2-2
  ENSP ID: ENSP00000481658

SEQ ID NO: 43133 - protein, 48 aa, Homo sapiens
  Payload ID: 8838
  Gene Symbol: KRTAP22-1
  Gene Name: keratin associated protein 22-1
  Uniprot ID: Q3MIV0
  ENSP ID: ENSP00000333887
MSFDNNYHGGQGYAKGGLGCSYGCGLSGYGYACYCPWCYERSWFSGCF

SEQ ID NO: 43134 - protein, 45 aa, Homo sapiens
  Payload ID: 8839
  Gene Symbol: KRTAP22-2
  Gene Name: keratin associated protein 22-2
  Uniprot ID: Q3LI68
  ENSP ID: ENSP00000372281
MCYYHNYYGSLDYGCSYGSEYGNSGYACNFPCSYGRFLLAPRKKF

SEQ ID NO: 43135 - protein, 128 aa, Homo sapiens
  Payload ID: 8840
  Gene Symbol: KRTAP2-3
  Gene Name: keratin associated protein 2-3
  Uniprot ID: P0C7H8
  ENSP ID: ENSP00000375237
MTGSCCGSTLSSLSYGGGCCQPCCCRDPCCCRPVTCQTTVCRPVTCVPRCTRPICEPCRRPVCCDPCSLQEGCCRPITCCPSSCTAVVCRPCCWATTCCQPVSVQSPCCRPPCGQPTPCSTTCRTSSC

SEQ ID NO: 43136 - protein, 128 aa, Homo sapiens; identical to SEQ ID NO: 43135
  Payload ID: 8840
  Gene Symbol: KRTAP2-3
  Gene Name: keratin associated protein 2-3
  Uniprot ID: P0C7H8
  ENSP ID: ENSP00000459261

SEQ ID NO: 43137 - protein, 65 aa, Homo sapiens
  Payload ID: 8841
  Gene Symbol: KRTAP23-1
  Gene Name: keratin associated protein 23-1
  Uniprot ID: A1A580
  ENSP ID: ENSP00000346536
MSYNCCCGNFSSHSCEGYLCYSGYSRGGSSYPSNLVYSTEPLISQHLPAGFLSLQGLSGDLLGNP

SEQ ID NO: 43138 - protein, 128 aa, Homo sapiens; identical to SEQ ID NO: 43135
  Payload ID: 8842
  Gene Symbol: KRTAP2-4
  Gene Name: keratin associated protein 2-4
  Uniprot ID: Q9BYR9
  ENSP ID: ENSP00000377583

SEQ ID NO: 43139 - protein, 128 aa, Homo sapiens; identical to SEQ ID NO: 43135
  Payload ID: 8842
  Gene Symbol: KRTAP2-4
  Gene Name: keratin associated protein 2-4
  Uniprot ID: Q9BYR9
  ENSP ID: ENSP00000458927

SEQ ID NO: 43140 - protein, 254 aa, Homo sapiens
  Payload ID: 8843
  Gene Symbol: KRTAP24-1
  Gene Name: keratin associated protein 24-1
  Uniprot ID: Q3LI83
  ENSP ID: ENSP00000339238
MPAGSMSTTGYPGVCSTTSYRTHCYIPVTSSVTLSSSDLSPTFGHCLPSSYQGNLWLLDYCQESYGEAPTCKSPSCEPKTCSTTGCDPSNSSVPCNSPSAGQVFSVCETTNVSPSPSCSPSTQTNGYVCNCHIPTRNASKACQTLRNGSNCFGQLNCLSKSFQTLNHCRLSTLGYKSYQNPCFIPSYVSPLCYISNSCQPQSYLVRNYHYSSYRPTSCRPLSYLSRSFRSLSYIPSTFPPLRYLCSGSRPLKCY

SEQ ID NO: 43141 - protein, 102 aa, Homo sapiens
  Payload ID: 8844
  Gene Symbol: KRTAP25-1
  Gene Name: keratin associated protein 25-1
  Uniprot ID: Q3LHN0
  ENSP ID: ENSP00000398619
MHNRSQGFFFSSCHPQNHVSYGCQSPSFIFCRCQSLNFVSRTCYPLSYFSYGNQTIGSISNSFRSLNYVSHSFQPISFMHSSFQPACSDFVGWQSPFLRRTC

SEQ ID NO: 43142 - protein, 210 aa, Homo sapiens
  Payload ID: 8845
  Gene Symbol: KRTAP26-1
  Gene Name: keratin associated protein 26-1
  Uniprot ID: Q6PEX3
  ENSP ID: ENSP00000353742
MSCPNYCSGNSNSGSLRTSRHIPLTSIDLCPTSVSCGDVLYLPTSSQDHTWVTDNCQETCGEPTSCQPVHCETGNLETSCGSSTAYYVPRPCQGSSFLPASFFSSSCLPVSCRPQRYVSSGCRPLRPLLNSYQPIGDCVPNAYRPQFCLSKSCQPQNLLTSGCQPSSCLAYRPQSLHVVSSSLRPLGPLFSGCQPLTHVFSTCRPSCSGL

SEQ ID NO: 43143 - protein, 207 aa, Homo sapiens
  Payload ID: 8846
  Gene Symbol: KRTAP27-1
  Gene Name: keratin associated protein 27-1
  Uniprot ID: Q3LI81
  ENSP ID: ENSP00000372286
MPHSHCHSLRSFHNAPPLSAITHGTNPITFEDRLCLPSSFHSRTCFLDNFQETCNETTSCQMTNCEQDLFTDDSCVQSNCFPGVVQTTYSNSRPCERTACQSESSSAGLACVSQPCQSESTQQMGFVAQSCQPASLKGNSCPPKTSKSKNFETLERASSQCQCQSQNPESSSCRPLVNVAPEPQLLESSPGVEPTCCVTGGSQLPSK

SEQ ID NO: 43144 - protein, 341 aa, Homo sapiens
  Payload ID: 8847
  Gene Symbol: KRTAP29-1
  Gene Name: keratin associated protein 29-1
  Uniprot ID: A8MX34
  ENSP ID: ENSP00000375148
MADGCCPGNTTAIPAVPTITTYPVKGGFRHALCLPSSCHSRMWQLVTCQESCQPSIGAPSGCDPASCQPTRLPATSCVGFVCQPMCSHAACYQSGTGQSPCLVSSCQPSCSESTCCQEKCCDASPCQQSSCQESVCMSGSCQAACGQSVCCDAGSCQPSCSEVTSCPETSCLPTICTASPCQPTWCQGSSCQPVSGEGQPCKSTYYQPICYIFKPCQSALYMPVPCQPSTCVFSSCNTTCCVPSHCQPPHCQLVPSTCFIYQPVANCQAPCSTKNCCKPASCDTVISGQPTCDGPPSYNQSGCKSACCVTGLGTSPSSGSNCLPTSCQPSCESSFCKATLC

SEQ ID NO: 43145 - protein, 341 aa, Homo sapiens; identical to SEQ ID NO: 43144
  Payload ID: 8847
  Gene Symbol: KRTAP29-1
  Gene Name: keratin associated protein 29-1
  Uniprot ID: A8MX34
  ENSP ID: ENSP00000459109

SEQ ID NO: 43146 - protein, 341 aa, Homo sapiens; identical to SEQ ID NO: 43144
  Payload ID: 8847
  Gene Symbol: KRTAP29-1
  Gene Name: keratin associated protein 29-1
  Uniprot ID: A8MX34
  ENSP ID: ENSP00000461202

SEQ ID NO: 43147 - protein, 98 aa, Homo sapiens
  Payload ID: 8848
  Gene Symbol: KRTAP3-1
  Gene Name: keratin associated protein 3-1
  Uniprot ID: Q9BYR8
  ENSP ID: ENSP00000375430
MYCCALRSCSVPTGPATTFCSFDKSCRCGVCLPSTCPHEISLLQPICCDTCPPPCCKPDTYVPTCWLLNNCHPTPGLSGINLTTYVQPGCESPCEPRC

SEQ ID NO: 43148 - protein, 98 aa, Homo sapiens; identical to SEQ ID NO: 43147
  Payload ID: 8848
  Gene Symbol: KRTAP3-1
  Gene Name: keratin associated protein 3-1
  Uniprot ID: Q9BYR8
  ENSP ID: ENSP00000459883

SEQ ID NO: 43149 - protein, 98 aa, Homo sapiens
  Payload ID: 8849
  Gene Symbol: KRTAP3-2
  Gene Name: keratin associated protein 3-2
  Uniprot ID: Q9BYR7
  ENSP ID: ENSP00000375429
MDCCASRSCSVPTGPATTICSSDKSCRCGVCLPSTCPHTVWLLEPICCDNCPPPCHIPQPCVPTCFLLNSCQPTPGLETLNLTTFTQPCCEPCLPRGC

SEQ ID NO: 43150 - protein, 98 aa, Homo sapiens; identical to SEQ ID NO: 43149
  Payload ID: 8849
  Gene Symbol: KRTAP3-2
  Gene Name: keratin associated protein 3-2
  Uniprot ID: Q9BYR7
  ENSP ID: ENSP00000459215

SEQ ID NO: 43151 - protein, 98 aa, Homo sapiens
  Payload ID: 8850
  Gene Symbol: KRTAP3-3
  Gene Name: keratin associated protein 3-3
  Uniprot ID: Q9BYR6
  ENSP ID: ENSP00000375428
MDCCASRGCSVPTGPATTICSSDKSCRCGVCLPSTCPHTVWLLEPTCCDNCPPPCHIPQPCVPTCFLLNSCQPTPGLETLNLTTFTQPCCEPCLPRGC

SEQ ID NO: 43152 - protein, 98 aa, Homo sapiens; identical to SEQ ID NO: 43151
  Payload ID: 8850
  Gene Symbol: KRTAP3-3
  Gene Name: keratin associated protein 3-3
  Uniprot ID: Q9BYR6
  ENSP ID: ENSP00000458618

SEQ ID NO: 43153 - protein, 146 aa, Homo sapiens
  Payload ID: 8851
  Gene Symbol: KRTAP4-1
  Gene Name: keratin associated protein 4-1
  Uniprot ID: Q9BYQ7
  ENSP ID: ENSP00000381489
MVNSCCGSVCSDQGCDQGLCQETCCRPSCCQTTCCCPSCVVSSCCRPSCSQTTCCQTTCCRPSCCHPVCCQTTCRPSCGVSSCCRPLCCQTTCHPSCGMSSCCRPLCCQTTCRPSCGVSSCCRPLCCQTTCCRATCCRPSCCGSSC

SEQ ID NO: 43154 - protein, 127 aa, Homo sapiens
  Payload ID: 8851
  Gene Symbol: KRTAP4-1
  Gene Name: keratin associated protein 4-1
  ENSP ID: ENSP00000481610
MVNSCCGSVCSDQGCDQGLCQETCCRPSCCQTTCCCPSCVVSSCCRPSCSQTTCCQTTCCRPSCCHPVCCQTTCRPSCGVSSCCRPLCCQTTCRPSCGVSSCCRPLCCQTTCCRATCCRPSCCGSSC

SEQ ID NO: 43155 - protein, 195 aa, Homo sapiens
  Payload ID: 8852
  Gene Symbol: KRTAP4-11
  Gene Name: keratin associated protein 4-11
  Uniprot ID: Q9BYQ6
  ENSP ID: ENSP00000375232
MVNSCCGSVCSHQGCGRDLCQETCCRPSCCETTCCRTTYCRPSCCVSSCCRPQCCQSVCCQPTCCRPRCCISSCCRPSCCVSSCCKPQCCQSMCCQPTCCRPRCCISSCCRPSCCVSSCCRPQCCQSVCCQPTCCHPSCSISSCCRPSCCESSCCRPCCCLRPVCGRVSCHTTCYRPTCVISSCPRPLCCASSCC

SEQ ID NO: 43156 - protein, 195 aa, Homo sapiens
  Payload ID: 8852
  Gene Symbol: KRTAP4-11
  Gene Name: keratin associated protein 4-11
  Uniprot ID: Q9BYQ6
  ENSP ID: ENSP00000460506
MVNSCCGSVCSHQGCGQDLCQETCCRPSCCETTCCRTTYCRPSCCVSSCCRPQCCQSVCCQPTCCRPRCCISSCCRPSCCVSSCCKPQCCQSMCCQPTCCRPRCCISSCCRPSCCVSSCCRPQCCQSVCCQPTCCHPSCSISSCCRPSCCESSCCRPCCCLRPVCGGVSCHTTCYRPTCVISSCPRPLCCASSCC

SEQ ID NO: 43157 - protein, 210 aa, Homo sapiens
  Payload ID: 8852
  Gene Symbol: KRTAP4-11
  Gene Name: keratin associated protein 4-11
  ENSP ID: ENSP00000479909
MVNSCCGSVCSDQGCGPVCCQPTCCRPSCCQTTCCRTTCCRPSCCVSSCCRPQCCQSVCCQPTCCRPSCCQTTCCRPRCCISSCCRPSCCVSSCCKPQCCQSMCCQPTCCRPRCCISSCCRPSCCVSSCCRPQCCQSVCCQPTCCHPSCSISSCCRPSCCESSCCRPCCCRPCCCVRPVCGRVSCHTTCYRPTCVISTCPRPVCCASSCC

SEQ ID NO: 43158 - protein, 201 aa, Homo sapiens
  Payload ID: 8853
  Gene Symbol: KRTAP4-12
  Gene Name: keratin associated protein 4-12
  Uniprot ID: Q9BQ66
  ENSP ID: ENSP00000377582
MVNSCCGSVCSDQGCGLENCCRPSCCQTTCCRTTCCRPSCCVSSCCRPQCCQSVCCQPTCCRPSCCQTTCCRTTCCRPSCCVSSCCRPQCCQSVCCQPTCCRPSCCQTTCCRTTCCRPSCCVSSCCRPQCCQSVCCQPTCCRPSCCISSSCCPSCCESSCCRPCCCLRPVCGRVSCHTTCYRPTCVISTCPRPLCCASSCC

SEQ ID NO: 43159 - protein, 201 aa, Homo sapiens; identical to SEQ ID NO: 43158
  Payload ID: 8853
  Gene Symbol: KRTAP4-12
  Gene Name: keratin associated protein 4-12
  Uniprot ID: Q9BQ66
  ENSP ID: ENSP00000458979

SEQ ID NO: 43160 - protein, 235 aa, Homo sapiens
  Payload ID: 8854
  Gene Symbol: KRTAP4-16P
  Gene Name: keratin associated protein 4-16, pseudogene
  ENSP ID: ENSP00000411198
MCSSKMPCSPSASSLCAASPPNCCHPSCCQTTCCRTTSCSHSCSVSSCCRPQCCHSVCCQPTCCRPSCCQTTCCRTTCCHPSCCVSSCCRPQCCHSVCFQPTCCHPSCCISSSCCPSCCESSCCCPCCCLRPVCGRVSCHVTCYHPTCVISTCPHPLCCASPPLPLPFPSPPVPLPFFLSLALPSPPRPSPPLLSPVLIPSPSPSPSLPSLSPPLPSPPLPSPHFPSVNPKSMLQ

SEQ ID NO: 43161 - protein, 235 aa, Homo sapiens; identical to SEQ ID NO: 43160
  Payload ID: 8854
  Gene Symbol: KRTAP4-16P
  Gene Name: keratin associated protein 4-16, pseudogene
  ENSP ID: ENSP00000461664

SEQ ID NO: 43162 - protein, 136 aa, Homo sapiens
  Payload ID: 8855
  Gene Symbol: KRTAP4-2
  Gene Name: keratin associated protein 4-2
  Uniprot ID: Q9BYR5
  ENSP ID: ENSP00000366955
MVNSCCGSVCSDQGCGLENCCRPSCCQTTCCRTTCCRPSCCVSSCCRPQCCQSVCCQPTCCSPSCCQTTCCRTTCCRPSCCVSSCFRPQCCQSVYCQPTCCRPSCGQTTCCRTTCYRPSCCVSTCCRPTCSSGSCC

SEQ ID NO: 43163 - protein, 195 aa, Homo sapiens
  Payload ID: 8856
  Gene Symbol: KRTAP4-3
  Gene Name: keratin associated protein 4-3
  Uniprot ID: Q9BYR4
  ENSP ID: ENSP00000375151
MVSSCCGSVCSDQSCGQGLGQESCCRPSCCQTTCCRTTCCRPSCCISSCCRPSCCISSCCKPSCCRTTCCRPSCCISSCCRPSCCISSCCKPSCCRTTCCRPSCCISSCCRPSCCISSCCKPSCCQTTCCRPSCCISSCYRPQCCQPSCCRPACCISSCCHPSCCVSSCRCPFSCPTTCCRTTCFHPICCGSSCC

SEQ ID NO: 43164 - protein, 166 aa, Homo sapiens
  Payload ID: 8857
  Gene Symbol: KRTAP4-4
  Gene Name: keratin associated protein 4-4
  Uniprot ID: Q9BYR3
  ENSP ID: ENSP00000375076
MVNSCCGSVCSDQGCGLENCCRPSYCQTTCCRTTCCRPSCCVSSCCRPQCCQTTCCRTTCCHPSCCVSSCCRPQCCQSVCCQPTCCRPQCCQTTCCRTTCCRPSCCRPQCCQSVCCQPTCCCPSYCVSSCCRPQCCQTTCCRTTCCRPSCCVSRCYRPHCGQSLCC

SEQ ID NO: 43165 - protein, 181 aa, Homo sapiens
  Payload ID: 8858
  Gene Symbol: KRTAP4-5
  Gene Name: keratin associated protein 4-5
  Uniprot ID: Q9BYR2
  ENSP ID: ENSP00000340546
MVSSCCGSVSSEQSCGLENCCRPSCCQTTCCRTTCCRPSCCKPQCCQSVCYQPTCCHPSCCISSCCRPYCCESSCCRPCCCQTTCCRTTCCRTTCCCPSCCVSSCCRPQCCQSVCCQPTCCRPSCCISSCCHPSCCESSCCRPCCCVRPVCGRVSCHTTCYRPTCVISTCPRPLCCASSCC

SEQ ID NO: 43166 - protein, 205 aa, Homo sapiens
  Payload ID: 8859
  Gene Symbol: KRTAP4-6
  Gene Name: keratin associated protein 4-6
  Uniprot ID: Q9BYQ5
  ENSP ID: ENSP00000328270
MVSSCCGSVCSDQGCGLETCCRPSCCQTTCCRTTCCRPSCCVSSCCRPQCCQSVCCQPTCCRPSCCPSCCQTTCCRTTCCRPSCCVSSCCRPQCCQSVCCQPTCCRPSCSISSCCRPSCCVSRCCRSQCCQSVCCQPTCCRPSCCISSCCRPSCCESSCCRPCCCRPCCCLRPVCGRVSCHTTCYRPTCVISTCPRPLCCASSCC

SEQ ID NO: 43167 - protein, 155 aa, Homo sapiens
  Payload ID: 8860
  Gene Symbol: KRTAP4-7
  Gene Name: keratin associated protein 4-7
  Uniprot ID: Q9BYR0
  ENSP ID: ENSP00000375236
MVSSCCGSVCSDQGCSQDLCQETCCRPSCCQTTCCRTTCYRPSCCVSSCCRPQCCQSVCCQPTCCRPTCCETTCCHPRCCISSCCRPSCCMSSCCKPQCCQSVCCQPTCCRPSCCRPCCCLRPVCGRVSCHTTCYRPTCVISTCPRPLCCASSCC

SEQ ID NO: 43168 - protein, 140 aa, Homo sapiens
  Payload ID: 8860
  Gene Symbol: KRTAP4-7
  Gene Name: keratin associated protein 4-7
  ENSP ID: ENSP00000480672
MVSSCCGSVCSDQGCSQDLCQETCCRPSCCQTTCCRTTCYRPSCCVSSCCRPQCCQSVCCQPTCCRPTCCETTCCHPRCCISSCCRPSCCMSSCCKPQCCQSVCCQPTCCRPSCCRPCCCRPTCVISTCPRPLCCASSCC

SEQ ID NO: 43169 - protein, 205 aa, Homo sapiens
  Payload ID: 8860
  Gene Symbol: KRTAP4-7
  Gene Name: keratin associated protein 4-7
  ENSP ID: ENSP00000482443
MVSSCCGSVCSDQGCSQDLCQETCCRPSCCQTTCCRTTCYRPSCCVSSCCRPQCCQSVCCQPTCCRPTCCETTCCHPRCCISSCCRPSCCMSSCCKPQCCQSVCCQPTCCRPSCCISSCCRPSCCVSSCCKPQCCQSVCCQPNCCRPSCSISSCCRPSCCESSCCRPCCCVRPVCGRVSCHTTCYRPTCVISSCPRPLCCASSCC

SEQ ID NO: 43170 - protein, 155 aa, Homo sapiens
  Payload ID: 8861
  Gene Symbol: KRTAP4-8
  Gene Name: keratin associated protein 4-8
  ENSP ID: ENSP00000325023
MVNSCCGSVCSDQGCGQDLCQETCCCPSCCQTTCCRTTCYRPSYSVSCCCRPQCCQSVCCQPTCCRPSCCVPTCCHPSCCISSCCRPSCCVSSCCKPQCCQSVCCQPNCCRPSCCRPCCCLRPVCGRVSCHTTCYRPACVISTCPRPVCCASSCC

SEQ ID NO: 43171 - protein, 185 aa, Homo sapiens
  Payload ID: 8861
  Gene Symbol: KRTAP4-8
  Gene Name: keratin associated protein 4-8
  Uniprot ID: Q9BYQ9
  ENSP ID: ENSP00000328444
MVNSCCGSVCSDQGCGQDLCQETCCCPSCCQTTCCRTTCYRPSYSVSCCCRPQCCQSVCCQPTCCRPSCCVSSCCKPQCCQSVCCQPTCCHPSCCISSCCRPSCCVSSCCKPQCCQSVCCQPNCCRPSCSISSCCRPSCCESSCCRPCCCLRPVCGRVSCHTTCYRPACVISTCPRPVCCASSCC

SEQ ID NO: 43172 - protein, 195 aa, Homo sapiens
  Payload ID: 8861
  Gene Symbol: KRTAP4-8
  Gene Name: keratin associated protein 4-8
  ENSP ID: ENSP00000461030
MVNSCCGSVCSDQGCGQDLCQETCCCPSCCQTTCCRTTCYRPSYSVSCCCRPQCCQSVCCQPTCCRPRCCISSCCRPSCCVSSCCKPQCCQSVCCQPTCCHPSCCISSCCRPSCCVSSCCKPQCCQSVCCQPTCCHPSCSISSCCRPSCCESSCCRPCCCVRPVCGRVSCHTTCYRPTCVISTCPRPVCCASSCC

SEQ ID NO: 43173 - protein, 185 aa, Homo sapiens
  Payload ID: 8861
  Gene Symbol: KRTAP4-8
  Gene Name: keratin associated protein 4-8
  ENSP ID: ENSP00000484022
MVNSCCGSVCSDQGCGQDLCQETCCCPSCCQTTCCRTTCYRPSYSVSCCCRPQCCQSVCCQPTCCRPSCCVSSCCKPQCCQSVCCQPTCCHPSCCISSCCRPSCCVSSCCKPQCCQSVCCQPTCCHPSCSISSCCRPSCCESSCCRPCCCVRPVCGRVSCHTTCYRPTCVISTCPRPVCCASSCC

SEQ ID NO: 43174 - protein, 210 aa, Homo sapiens
  Payload ID: 8862
  Gene Symbol: KRTAP4-9
  Gene Name: keratin associated protein 4-9
  Uniprot ID: Q9BYQ8
  ENSP ID: ENSP00000375234
MVSSCCGSVCSDQGCGQDLCQETCCRPSCCETTCCRTTCCRPSCCVSSCCRPQCCQSVCCQPTCSRPSCCQTTCCRTTCYRPSCCVSSCCRPQCCQPACCQPTCCRPSCCETTCCHPRCCISSCCRPSCCVSSCCKPQCCQSVCCQPNCCRPSCSISSCCRPSCCESSCCRPCCCVRPVCGRVSCHTTCYRPTCVISSCPRPLCCASSCC

SEQ ID NO: 43175 - protein, 210 aa, Homo sapiens
  Payload ID: 8862
  Gene Symbol: KRTAP4-9
  Gene Name: keratin associated protein 4-9
  ENSP ID: ENSP00000461444
MVSSCCGSVCSDQGCGQDLCQETCCRPSCCETTCCRTTCCRPSCCVSSCCRPQCCQSVCCQPTCSRPSCCQTTCCRTTCYRPSCCVSSCCRPQCCQPVCCQPTCCRPSCCETTCCHPRCCISSCCRPSCCVSSCCKPQCCQSVCCQPNCCRPSCSISSCCRPSCCESSCCRPCCCVRPVCGRVSCHTTCYRPTCVISSCPRPLCCASSCC

SEQ ID NO: 43176 - protein, 185 aa, Homo sapiens
  Payload ID: 8862
  Gene Symbol: KRTAP4-9
  Gene Name: keratin associated protein 4-9
  ENSP ID: ENSP00000483635
MVSSCCGSVCSDQGCGQDLCQETCCRPSCCETTCCRTTCCRPSCCVSSCCRPQCCQSVCCQPTCYRPSCCVSSCCRPQCCQPACCQPTCCRPRCCISSCCRPSCCVSSCCKPQCCQSVCCQPNCCRPSCSISSCCRPSCCESSCCRPCCCVRPVCGRVSCHTTCYRPTCVISSCPRPLCCASSCC

SEQ ID NO: 43177 - protein, 278 aa, Homo sapiens
  Payload ID: 8863
  Gene Symbol: KRTAP5-1
  Gene Name: keratin associated protein 5-1
  Uniprot ID: Q6L8H4
  ENSP ID: ENSP00000371606
MGCCGCSGGCGSSCGGCGSGCGGCGSGCGGCGSGCGGSGSSCCVPVCCCKPVCCRVPTCSCSSCGKGGCGSSGGSKGGCGSCGGCKGGCGSCGGSKGGCGSCGGSKGGCGSCGGSKGGCGSGCGGCGSSCCVPVCCCKPMCCCVPACSCSSCGKGGCGSCGCSKGACGSCGGSKGGCGSCGGCKGGCGSCGGSKGGCGSGCGGCGSGCGVPVCCCSCSSCGSCAGSKGGCGSSCSQCSCCKPCCCSSGCGSSCCQSSCCKPCCSQSSCCVPVCCQCKI

SEQ ID NO: 43178 - protein, 278 aa, Homo sapiens; identical to SEQ ID NO: 43177
  Payload ID: 8863
  Gene Symbol: KRTAP5-1
  Gene Name: keratin associated protein 5-1
  Uniprot ID: Q6L8H4
  ENSP ID: ENSP00000481419

SEQ ID NO: 43179 - protein, 278 aa, Homo sapiens; identical to SEQ ID NO: 43177
  Payload ID: 8863
  Gene Symbol: KRTAP5-1
  Gene Name: keratin associated protein 5-1
  Uniprot ID: Q6L8H4
  ENSP ID: ENSP00000486084

SEQ ID NO: 43180 - protein, 167 aa, Homo sapiens
  Payload ID: 8864
  Gene Symbol: KRTAP5-10
  Gene Name: keratin associated protein 5-10
  ENSP ID: ENSP00000365719
MGCCGCSGGCGSGCGGCGSGCGGCGSGCGGYGSGCGGCGSSCCVPVCCCKPVCCCVPACSCSSCGSCGGSKGGCGSCGGSKGGCGSCGCSQCNCCKPCCCSSGCGSCCQSSCCNPCCCQSSCCVPVCCQSSCCKPCCCQSSCCVSSCCRSCCSKSSCCVPICCQYKI

SEQ ID NO: 43181 - protein, 202 aa, Homo sapiens
  Payload ID: 8864
  Gene Symbol: KRTAP5-10
  Gene Name: keratin associated protein 5-10
  Uniprot ID: Q6L8G5
  ENSP ID: ENSP00000381542
MGCCGCSGGCGSGCGGCGSGCGGCGSGCGGYGSGCGGCGSSCCVPVCCCKPVCCCVPACSCSSCGSCGGSKGDCGSCGGSKGGCGSCGGSKGGCGSCGGSKGGCGSCGGSKGGCGSCGGSKGGCGSCGGSKGGCGSCGCSQCNCCKPCCCSSGCGSCCQSSCCNPCCCQSSCCVPVCCQSSCCKPCCCQSSCCVPVCCQCKI

SEQ ID NO: 43182 - protein, 156 aa, Homo sapiens
  Payload ID: 8865
  Gene Symbol: KRTAP5-11
  Gene Name: keratin associated protein 5-11
  Uniprot ID: Q6L8G4
  ENSP ID: ENSP00000381541
MGCCGCSGGCGSGCGGCGSGSGGCGSGCGGCGSSCCVPICCCKPVCCCVPACSCSSCGSCGGSKGGCGSCGSSKGGCGSCGCSQSNCCKPCCSSSGCGSFCCQSSCSKPCCCQSSCCQSSCCKPCCCQSSCCQSSCFKPCCCQSSCCVPVCCQCKI

SEQ ID NO: 43183 - protein, 176 aa, Homo sapiens
  Payload ID: 8865
  Gene Symbol: KRTAP5-11
  Gene Name: keratin associated protein 5-11
  ENSP ID: ENSP00000478101
MGCCGCSGGCGSGCGGCGSGSGGCGSGCGGCGSSCCVPICCCKPVCCCVPACSCSSCGSCGGSKGGCGSCGSSKGGCGSCGCSQSNCCKPCCSSSGCGSFCCQSSCSKPCCCQSSCCQSSCCKPCCCQSSCCQSSCFKPCCCQSSCCVPVCCHSSCCKPCCSQSSCCVPICCQYKI

SEQ ID NO: 43184 - protein, 185 aa, Homo sapiens
  Payload ID: 8865
  Gene Symbol: KRTAP5-11
  Gene Name: keratin associated protein 5-11
  ENSP ID: ENSP00000481216
MGCCGCSGGCGSGCGGCGSGSGGCGSGCGGCGSSCCVPICCCKPVCCCVPACSCSSCGSCGGSKGGCGSCGSSKGGCGSCGCSQSNCCKPCCSSSGCGSFCCQSSCSKPCCCQSSCCQSSCCKPCCCQSSCCQSSCFKPCCCQSSCCKLCCCSSGCGSTCSQSSCCKPCCSQSSCCVPICCQYKI

SEQ ID NO: 43185 - protein, 177 aa, Homo sapiens
  Payload ID: 8866
  Gene Symbol: KRTAP5-2
  Gene Name: keratin associated protein 5-2
  Uniprot ID: Q701N4
  ENSP ID: ENSP00000400041
MGCCGCSRGCGSGCGGCGSSCGGCGSGCGGCGSGRGGCGSGCGGCSSSCGGCGSRCYVPVCCCKPVCSWVPACSCTSCGSCGGSKGGCGSCGGSKGGCGSCGGSKGGCGSCGCSQSSCCKPCCCSSGCGSSCCQSSCCKPCCCQSSCCVPVCCQSSCCKPCCCQSNCCVPVCCQCKI

SEQ ID NO: 43186 - protein, 177 aa, Homo sapiens; identical to SEQ ID NO: 43185
  Payload ID: 8866
  Gene Symbol: KRTAP5-2
  Gene Name: keratin associated protein 5-2
  Uniprot ID: Q701N4
  ENSP ID: ENSP00000484511

SEQ ID NO: 43187 - protein, 177 aa, Homo sapiens; identical to SEQ ID NO: 43185
  Payload ID: 8866
  Gene Symbol: KRTAP5-2
  Gene Name: keratin associated protein 5-2
  Uniprot ID: Q701N4
  ENSP ID: ENSP00000487099

SEQ ID NO: 43188 - protein, 238 aa, Homo sapiens
  Payload ID: 8867
  Gene Symbol: KRTAP5-3
  Gene Name: keratin associated protein 5-3
  Uniprot ID: Q6L8H2
  ENSP ID: ENSP00000382592
MGCSGCSGGCGSSCGGCGSSCGGCGSGYGGCGSGCCVPVCCCKPVCCCVPACSCSSCGSCGGSKGVCGSCGGCKGGCGSCGGSKGGCGSSCCVPVCCSSSCGSCGGSKGVCGFRGGSKGGCGSCGCSQCSCYKPCCCSSGCGSSCCQSSCCKPSCSQSSCCKPCCSQSSCCKPCCCSSGCGSSCCQSSCCKPCCSQSSCCKPCCCSSGCGSSCCQSSCCKPCSSQSSCCVPICCQCKI

SEQ ID NO: 43189 - protein, 238 aa, Homo sapiens; identical to SEQ ID NO: 43188
  Payload ID: 8867
  Gene Symbol: KRTAP5-3
  Gene Name: keratin associated protein 5-3
  Uniprot ID: Q6L8H2
  ENSP ID: ENSP00000478585

SEQ ID NO: 43190 - protein, 169 aa, Homo sapiens
  Payload ID: 8867
  Gene Symbol: KRTAP5-3
  Gene Name: keratin associated protein 5-3
  ENSP ID: ENSP00000484325
MGCSGCSGGCGSSCGGCGSSCGGCGSGYGGCGSGCCVPVCCCKPVCCCVPACSCSSCGKGGCGSCGGSKGGCGSCGCSQCSCCKPCCCSSGCGSSCCQSSCCKPCCSQSSCCKPCCCSSGCGSSCCQSSCCKPCCCSSGCGSSCCQSSCCKPCCSQSSCCVPVCCQCKI

SEQ ID NO: 43191 - protein, 238 aa, Homo sapiens; identical to SEQ ID NO: 43188
  Payload ID: 8867
  Gene Symbol: KRTAP5-3
  Gene Name: keratin associated protein 5-3
  Uniprot ID: Q6L8H2
  ENSP ID: ENSP00000487561

SEQ ID NO: 43192 - protein, 228 aa, Homo sapiens
  Payload ID: 8868
  Gene Symbol: KRTAP5-4
  Gene Name: keratin associated protein 5-4
  ENSP ID: ENSP00000382590
MGCCGCSGGCGSGCGGCGSGCGGCGSGCGGCGSGCGGCGSGCGGCGSSCCVPICCCKPVCCCVPACSCSSCGSCGGSKGGYGSCGGSKGGCVSCGGSKGGCGSCGGSKGGCGSCGGSKGGCGSCGGSKGGCGSCGCSQCSCCKPCCFSSGCGSSCCQSSCCKPCCSSSGCGSSCCQSSCCKPYCCQSSCCKPCCSSSGCGSSCCQSSCCNPCCSQSSCCVPVCCQCKI

SEQ ID NO: 43193 - protein, 219 aa, Homo sapiens
  Payload ID: 8868
  Gene Symbol: KRTAP5-4
  Gene Name: keratin associated protein 5-4
  ENSP ID: ENSP00000478428
MGCCGCSGGCGSGCGGCGSGCGGCGSGCGGCGSGCGGCGSGCGGCGSSCCVPICCCKPVCCCVPACSCSSCGSCGGSKGGYGSCGGSKGGCVSCGGSKGGCGSCGGSKGGCGSCGGSKGGCGSCGGSKGGCGSCGCSQCSCCKPCCFSSGCGSSCCQSSCCKPSCCQSSCCKPYCCQSSCCKPCCSSSGCGSSCCQSSCCNPCCSQSSCCVPVCCQCKI

SEQ ID NO: 43194 - protein, 219 aa, Homo sapiens; identical to SEQ ID NO: 43193
  Payload ID: 8868
  Gene Symbol: KRTAP5-4
  Gene Name: keratin associated protein 5-4
  ENSP ID: ENSP00000480265

SEQ ID NO: 43195 - protein, 187 aa, Homo sapiens
  Payload ID: 8868
  Gene Symbol: KRTAP5-4
  Gene Name: keratin associated protein 5-4
  ENSP ID: ENSP00000481071
MGCCGCSGGCGSGCGGCGSGCGGCGSGCCVPICCCKPVCCCVPACSCSSCGSCGGSKGGCGSCGGSKGGCGSCGGSKGGCGSCGCSQCSCCKPCCCSSGCGSSCCQSSCCKPCCSQSSCCKPCCCSSGCGSSCCQSSCCKPCCSQSSCCKPCCCSSGCGSSCCQSSCCKPCSSQSSCCVPICCQCKI

SEQ ID NO: 43196 - protein, 165 aa, Homo sapiens
  Payload ID: 8868
  Gene Symbol: KRTAP5-4
  Gene Name: keratin associated protein 5-4
  ENSP ID: ENSP00000484814
MGCCGCSGGCGSGCGGCGSGCGGCGSGCGGCGSSCCVPICCCKPVCCCVPACSCSSCGSCGGSKGGCGSCGGSKGGCGSCGGSKGGCGSCGCSQCSCCKPCCCSSGCGSSCCQSSCCKPCCCQSSCCKPCCSSSGCGSSCCQSSCCNPCCSQSSCCVPVCCQCKI

SEQ ID NO: 43197 - protein, 288 aa, Homo sapiens
  Payload ID: 8868
  Gene Symbol: KRTAP5-4
  Gene Name: keratin associated protein 5-4
  Uniprot ID: Q6L8H1
  ENSP ID: ENSP00000486225
MGCCGCSGGCGSGCGGCGSGCGGCGSGCGGCGSGCGGCGSGCGGCGSSCCVPICCCKPVCCCVPACSCSSCGSCGGSKGGYGSCGGSKGGCVSCGGSKGGCGSCGGSKGGCGSCGGSKGGCGSCGGSKGGCVSCGGSKGGCGSCGGSKGGCVSCGGSKGGCGSCGGSKGGCGSCGGSKGGCGSCGGSKGGCGSCGCSQCSCCKPCCCSSGCGSSCCQSSCCKPCCSSSGCGSSCCQSSCCKPYCCQSSCCKPCCSSSGCGSSCCQSSCCNPCCSQSSCCVPVCCQCKI

SEQ ID NO: 43198 - protein, 228 aa, Homo sapiens; identical to SEQ ID NO: 43192
  Payload ID: 8868
  Gene Symbol: KRTAP5-4
  Gene Name: keratin associated protein 5-4
  ENSP ID: ENSP00000486418

SEQ ID NO: 43199 - protein, 237 aa, Homo sapiens
  Payload ID: 8869
  Gene Symbol: KRTAP5-5
  Gene Name: keratin associated protein 5-5
  Uniprot ID: Q701N2
  ENSP ID: ENSP00000382584
MGCCGCSGGCGSGCGGRGSGCGGCGSGCGGCGSGCGGCGSGCGGCGGCGSGCAGCGGCGSGCCVPVCCCKPMCCCVPACSCSSCGKGGCGSCGGSKRGCVSCGVSKGACGSCGGSKGGCGSCGGSKGGCGSCGGSKGGCGSCGGSKGGCGSYGCSQSSCCKPCCCSSGCGSSCCQSSCCKPYCCQSSCCKPYCCQSSCCKPCSCFSGCGSSCCQSSCYKPCCCQSSCCVPVCCQCKI

SEQ ID NO: 43200 - protein, 185 aa, Homo sapiens
  Payload ID: 8869
  Gene Symbol: KRTAP5-5
  Gene Name: keratin associated protein 5-5
  ENSP ID: ENSP00000480306
GGCGSGCGGRGSGCGGCGSGCGGCGSGCGGCGSGCGGCGGCGSGCSCSCSSCGKGGCGSCGGSKRGCVSCGVSKGACGSCGGSKGGCGSCGGSKGGCGSCGGSKGGCGSYGCSQCSCCKPCCCSSGCGSSCCQSSCCKPYCCQSSCCKPCSCFSGCGSSCCQSSCYKPCCCQSSCCVPVCCQCKI

SEQ ID NO: 43201 - protein, 237 aa, Homo sapiens; identical to SEQ ID NO: 43199
  Payload ID: 8869
  Gene Symbol: KRTAP5-5
  Gene Name: keratin associated protein 5-5
  Uniprot ID: Q701N2
  ENSP ID: ENSP00000481348

SEQ ID NO: 43202 - protein, 221 aa, Homo sapiens
  Payload ID: 8869
  Gene Symbol: KRTAP5-5
  Gene Name: keratin associated protein 5-5
  ENSP ID: ENSP00000487288
MGCCGCSGGCGSGCGGLGSGCGGCGSGCGGRGSGCGGCGSGCGGCGSGCGGCGSGCGGCGGCGSGCCVPVCCCKPMCCCVPACSCSSCGKGGCGSCGGSKRGCVSCGVSKGACGSCGGSKGGCGSCGGSKGGCGSCGGSKGGCGSYGCSQCSCCKPCCCSSGCGSSCCQSSCCKPYCCQSSCCKPCSCFSGCGSSCCQSSCYKPCCCQSSCCVPVCCQCKI

SEQ ID NO: 43203 - protein, 129 aa, Homo sapiens
  Payload ID: 8870
  Gene Symbol: KRTAP5-6
  Gene Name: keratin associated protein 5-6
  Uniprot ID: Q6L8G9
  ENSP ID: ENSP00000371595
MGCCGCSGGCGSGCGGCGSGCGGCGSSCCVPICCCKPVCCCVPACSCTSCGSCGGSKGCCGSCGGSKGGCGSCGGSKGGCGSCGCSQCSCCKPCYCSSGCGSSCCQSSCCKPCCSQASCCVPICCQCKI

SEQ ID NO: 43204 - protein, 129 aa, Homo sapiens; identical to SEQ ID NO: 43203
  Payload ID: 8870
  Gene Symbol: KRTAP5-6
  Gene Name: keratin associated protein 5-6
  Uniprot ID: Q6L8G9
  ENSP ID: ENSP00000479098

SEQ ID NO: 43205 - protein, 165 aa, Homo sapiens
  Payload ID: 8871
  Gene Symbol: KRTAP5-7
  Gene Name: keratin associated protein 5-7
  Uniprot ID: Q6L8G8
  ENSP ID: ENSP00000417330
MGCCGCSEGCGSGCGGCGSGCGGCGSGCGGCGSSCCVPVCCCKPVCCCVPACSCSSCGSCGGSKGGCGSCGGSKGGCGSCGGSKGGCGSCGCSQCSCYKPCCCSSGCGSSCCQSSCCKPCCCQSSCCKPCCCSSGCGSSCCQSSCCNPCCSQSSCCVPVCCQCKI

SEQ ID NO: 43206 - protein, 187 aa, Homo sapiens
  Payload ID: 8872
  Gene Symbol: KRTAP5-8
  Gene Name: keratin associated protein 5-8
  Uniprot ID: O75690
  ENSP ID: ENSP00000420723
MGCCGCSGGCGSGCGGCGSGCGGCGSSCCVPICCCKPVCCCVPACSCSSCGSCGGSKGGRGSCGGSKGDCGSCGGSKGGCGSCGCSQCSCYKPCCCSSGCGSSCCQSSCCKPCCSQSSCCKPCSCSSGCGSSCCQSSCCKPCCSQSSCCKPCCCSSGCGSSCCQSSCCKPCCSQSSCCVPICCQCKI

SEQ ID NO: 43207 - protein, 169 aa, Homo sapiens
  Payload ID: 8873
  Gene Symbol: KRTAP5-9
  Gene Name: keratin associated protein 5-9
  Uniprot ID: P26371
  ENSP ID: ENSP00000431443
MGCCGCSGGCGSSCGGCDSSCGSCGSGCRGCGPSCCAPVYCCKPVCCCVPACSCSSCGKRGCGSCGGSKGGCGSCGCSQCSCCKPCCCSSGCGSSCCQCSCCKPYCSQCSCCKPCCSSSGRGSSCCQSSCCKPCCSSSGCGSSCCQSSCCKPCCSQSRCCVPVCYQCKI

SEQ ID NO: 43208 - protein, 71 aa, Homo sapiens
  Payload ID: 8874
  Gene Symbol: KRTAP6-1
  Gene Name: keratin associated protein 6-1
  Uniprot ID: Q3LI64
  ENSP ID: ENSP00000332690
MCGSYYGNYYGTPGYGFCGYGGLGYGYGGLGCGYGSCCGCGFRRLGCGYGYGSRSLCGYGYGCGSGSGYYY

SEQ ID NO: 43209 - protein, 62 aa, Homo sapiens
  Payload ID: 8875
  Gene Symbol: KRTAP6-2
  Gene Name: keratin associated protein 6-2
  Uniprot ID: Q3LI66
  ENSP ID: ENSP00000334560
MCGSYYGNYYGDHGYGCCGYEGLGYGYGSLRCGYSSCCGYGHGYGSRFFCGCGYGCGSGYYY

SEQ ID NO: 43210 - protein, 110 aa, Homo sapiens
  Payload ID: 8876
  Gene Symbol: KRTAP6-3
  Gene Name: keratin associated protein 6-3
  Uniprot ID: Q3LI67
  ENSP ID: ENSP00000375482
MTSTTNTMCGSYYRNYNGGHGYGCCGYGGLGCGYGGCGYGCCGYGGLGFGYGGLDCGYGGLGCGYGSFCGCGYRGLDCGYGCGYGYVSHSFCGCGYRCGSGYGSSFGYYY

SEQ ID NO: 43211 - protein, 87 aa, Homo sapiens
  Payload ID: 8877
  Gene Symbol: KRTAP7-1
  Gene Name: keratin associated protein 7-1 (gene/pseudogene)
  Uniprot ID: Q8IUC3
  ENSP ID: ENSP00000479656
MTRYFCCGSYFPGYPIYGTNFHGTFRATPLNCVVPLGSPLNYGCGCNGYSSLGYSFGGSNINNLGGCYGGSFYRPWGSGSGFGYSTY

SEQ ID NO: 43212 - protein, 63 aa, Homo sapiens
  Payload ID: 8878
  Gene Symbol: KRTAP8-1
  Gene Name: keratin associated protein 8-1
  Uniprot ID: Q8IUC2
  ENSP ID: ENSP00000332805
MLCDNFPGAVFPGCYWGSYGYPLGYSVGCGYGSTYSPVGYGFGYGYNGCGAFGYRRYSPFALY

SEQ ID NO: 43213 - protein, 250 aa, Homo sapiens
  Payload ID: 8879
  Gene Symbol: KRTAP9-1
  Gene Name: keratin associated protein 9-1
  Uniprot ID: A8MXZ3
  ENSP ID: ENSP00000381488
MTHCCSPCCQPTCCRTTCCRTTCWKPTTVTTCSSTPCCQPSCCVPSCCQPCCHPTCCQNTCCRTTCCQPTCVASCCQPSCCSTPCCQPTCCGSSCCGQTSCGSSCCQPICGSSCCQPCCHPTCYQTICFRTTCCQPTCCQPTCCRNTSCQPTCCGSSCCQPCCHPTCCQTICRSTCCQPSCVTRCCSTPCCQPTCGGSSCCSQTCNESSYCLPCCRPTCCQTTCYRTTCCRPSCCCSPCCVSSCCQPSCC

SEQ ID NO: 43214 - protein, 116 aa, Homo sapiens [sequence omitted]

SEQ ID NO: 43215 - protein, 123 aa, Homo sapiens
  Payload ID: 8879
  Gene Symbol: KRTAP9-1
  Gene Name: keratin associated protein 9-1
  ENSP ID: ENSP00000488996
CCQPTCCRTTCCRPSCCVPSCCQPCCHPTCCQNTCCRTTCCQPTCVASCCQPSCCSTPCCQPTCCGSSCCGQTSCGSSCCQPICGSSCCQPCCHPTTCCQPTCCQPTCCRNTSCQPTCCGSSC

SEQ ID NO: 43216 - protein, 110 aa, Homo sapiens
  Payload ID: 8879
  Gene Symbol: KRTAP9-1
  Gene Name: keratin associated protein 9-1
  ENSP ID: ENSP00000489312
CQPTCCRTTCCRTTCWKPTTPSCCVPSCCQPCCHPTCCQNTCCRTTCCQPTCVASCCQPSCCSTPCCQPTCCGQTCNESSYCLPCCRPTCCQTTCYRTTCCRPSCCCSPC

SEQ ID NO: 43217 - protein, 174 aa, Homo sapiens
  Payload ID: 8880
  Gene Symbol: KRTAP9-2
  Gene Name: keratin associated protein 9-2
  Uniprot ID: Q9BYQ4
  ENSP ID: ENSP00000366950
MTHCCSPCCQPTCCRTTCCRTTCWKPTTVTTCSSTPCCQPACCVSSCCQPCCRPTCCQNTCCRTTCCQPTCVTSCCQPSCCSTPCCQPTCCGSSCCGQTSCGSSCGQSSSCAPVYCRRTCYYPTTVCLPGCLNQSCGSNCCQPCCRPACCETTCCRTTCFQPTCVSSCCQPSCC

SEQ ID NO: 43218 - protein, 174 aa, Homo sapiens [sequence omitted]

SEQ ID NO: 43219 - protein, 174 aa, Homo sapiens
  Payload ID: 8880
  Gene Symbol: KRTAP9-2
  Gene Name: keratin associated protein 9-2
  ENSP ID: ENSP00000458595
MTHCCSPCCQPTCCRTTCCRTTCWKPTTVTTCSSTPCCQPACCVSSCCQPCCRPTCCQNTCCRTTCCQPTCVTSCCQPSCCSTTCCQPTCCGSSCCGQTSCGSSCGQSSSCAPVYCRRTCYYPTTVCLPGCLNQSCGSNCCQPCCRPACCETTCCRTTCFQPTCVSSCCQPSCC

SEQ ID NO: 43220 - protein, 154 aa, Homo sapiens
  Payload ID: 8880
  Gene Symbol: KRTAP9-2
  Gene Name: keratin associated protein 9-2
  ENSP ID: ENSP00000480860
MTHCCSPCCQPTCCRTTCCRTTCWKPTTVTTCSSTSCCQPACCVSSCCQPCCRPTSCQNTCCQPICVTSCCQPSCCSTPCCQPTCCGSSCGQSSSCAPVYCRRTCYHPTTVCLPGCLNQSCGSSCCQPCCRPACCETTCFQPTCVYSCCQPSCC

SEQ ID NO: 43221 - protein, 159 aa, Homo sapiens
  Payload ID: 8881
  Gene Symbol: KRTAP9-3
  Gene Name: keratin associated protein 9-3
  Uniprot ID: Q9BYQ3
  ENSP ID: ENSP00000392189
MTHCCSPCCQPTCCRTTCWQPTTVTTCSSTPCCQPSCCVSSCCQPCCHPTCCQNTCCRTTCCQPICVTSCCQPSCCSTPCCQPTCCGSSCGQSSSCAPVYCRRTCYHPTSVCLPGCLNQSCGSNCCQPCCRPACCETTCCRTTCFQPTCVYSCCQPSCC

SEQ ID NO: 43222 - protein, 159 aa, Homo sapiens; identical to SEQ ID NO: 43221
  Payload ID: 8881
  Gene Symbol: KRTAP9-3
  Gene Name: keratin associated protein 9-3
  Uniprot ID: Q9BYQ3
  ENSP ID: ENSP00000458819

SEQ ID NO: 43223 - protein, 154 aa, Homo sapiens
  Payload ID: 8882
  Gene Symbol: KRTAP9-4
  Gene Name: keratin associated protein 9-4
  Uniprot ID: Q9BYQ2
  ENSP ID: ENSP00000334922
MTHCCSPCCQPTCCRTTCCRTTCWKPTTVTTCSSTPCCQPSCCVSSCCQPCCRPTCCQNTCCQPTCVTSCCQPSCCSTPCCQPTCCGSSCDQSSSCAPVYCRRTCYYPTTVCLPGCLNQSCGSNCCQPCCRPACCETTCFQPTCVSSCCQPFCC

SEQ ID NO: 43224 - protein, 154 aa, Homo sapiens
  Payload ID: 8882
  Gene Symbol: KRTAP9-4
  Gene Name: keratin associated protein 9-4
  Uniprot ID: Q9BYQ2
  ENSP ID: ENSP00000461584
MTHCCSPCCQPTCCRTTCCRTTCWKPTTVTTCSSTPCCQPSCCVSSCCQPCCRPTCCQNTCCQPTCVTSCCQPSCCSTPCCQPTCCGSSCDQSSSCAPVYCRRTCYYPTTVCLPGCLNQSCGSNCCQPCCRPACCETTCFQPTCVYSCCQPFCC

SEQ ID NO: 43225 - protein, 154 aa, Homo sapiens; identical to SEQ ID NO: 43223
  Payload ID: 8882
  Gene Symbol: KRTAP9-4
  Gene Name: keratin associated protein 9-4
  Uniprot ID: Q9BYQ2
  ENSP ID: ENSP00000461634

SEQ ID NO: 43226 - protein, 160 aa, Homo sapiens
  Payload ID: 8883
  Gene Symbol: KRTAP9-6
  Gene Name: keratin associated protein 9-6
  Uniprot ID: A8MVA2
  ENSP ID: ENSP00000375150
MTHCCSPGCQPTCCRTTCCRTTCWQPTIVTTCSSTPCCQPSCCVSSCCQPYCHPTCCQNTCCRTTCCQPTCVTSCCQPSCCSTPCYQPICCGSSCCGQTSCGSSCGQSSSCAPVYCRRTCYHPTTVCLPGCLNQSCGSSCCQPCYCPACCVSSCCQHSCC

SEQ ID NO: 43227 - protein, 174 aa, Homo sapiens
  Payload ID: 8883
  Gene Symbol: KRTAP9-6
  Gene Name: keratin associated protein 9-6
  ENSP ID: ENSP00000460240
MTHCCSPGCQPTCCRTTCCRTTCWQPTIVTTCSSTPCCQPSCCVSSCCQPCCHPTCCQNTCCRTTCCQPTCVTSCYQPSCCSTPCCQPICCGSSCCGQTSCGSSCCQPSSCAPIYCRRTCYHPTSVYLPGCLNQSCGSSCCQPCCRPACCETTCCRTTCFQPTCVTSCCQPACC

SEQ ID NO: 43228 - protein, 160 aa, Homo sapiens; identical to SEQ ID NO: 43226
  Payload ID: 8883
  Gene Symbol: KRTAP9-6
  Gene Name: keratin associated protein 9-6
  Uniprot ID: A8MVA2
  ENSP ID: ENSP00000460691

SEQ ID NO: 43229 - protein, 169 aa, Homo sapiens
  Payload ID: 8884
  Gene Symbol: KRTAP9-7
  Gene Name: keratin associated protein 9-7
  Uniprot ID: A8MTY7
  ENSP ID: ENSP00000375149
MTHCCSPCCQPTCCRTTCWKPTTVTTCSSTPCCQPSCCVSSCCQPCCHPTCCQNTCCRTTCCQPTCVTSCCQPSCCSTPCCQPICCGSSCCGQTSCGSSCCQPSSCAPIYCRRTCYHPTSVYLPGCLNQSCGSSCCQPCCRPACCETTCCRTTCFQPTCVTSCCQPACC

SEQ ID NO: 43230 - protein, 169 aa, Homo sapiens; identical to SEQ ID NO: 43229
  Payload ID: 8884
  Gene Symbol: KRTAP9-7
  Gene Name: keratin associated protein 9-7
  Uniprot ID: A8MTY7
  ENSP ID: ENSP00000460369

SEQ ID NO: 43231 - protein, 159 aa, Homo sapiens
  Payload ID: 8885
  Gene Symbol: KRTAP9-8
  Gene Name: keratin associated protein 9-8
  Uniprot ID: Q9BYQ0
  ENSP ID: ENSP00000254072
MTHCCSPCCQPTCCRTTCWKPTTVTTCSSTPCCQPSCCVSSCCQPCCRPTCCQNTCCQPICVTSCCQPSCCSTPCCQPTCCGQTSCGSSCGQSSSCAPVYCRRTCYHPTTVCLPGCLNQSCGSNCCQPCCRPACCETTCCRTTCFQPTCVSSCCQPSCC

SEQ ID NO: 43232 - protein, 164 aa, Homo sapiens
  Payload ID: 8885
  Gene Symbol: KRTAP9-8
  Gene Name: keratin associated protein 9-8
  ENSP ID: ENSP00000477735
MTHCCSPCCQPTCCRTTCCRTTCWKPTTVTTCSSTPCCQPSCCVSSCCQPCCRPTCCQNTCCQPICVTSCCQPSCCSTPCCQPTCCGQTSCGSSCGQSSSCAPVYCRRTCYHPTTVCLPGCLNQSCGSNCCQPCCRPACCETTCCRTTCFQPTCVSSCCQPSCC

SEQ ID NO: 43233 - protein, 169 aa, Homo sapiens
  Payload ID: 8886
  Gene Symbol: KRTAP9-9
  Gene Name: keratin associated protein 9-9
  Uniprot ID: Q9BYP9
  ENSP ID: ENSP00000377576
MTHCCSPCCQPTCCRTTCWKPTTVTTCSSTPCCQPSCCVSSCCQPCCRPACCQNTCCRTTCCQPTCLTSCCQPSCCSTTCCQPICCGSSCCGQTSCGSSCGQSSSCAPVYCRRTCYYPTTVCLPGCLNQSCGSSCCQPCCRPACCETTCCRTTCFQPTCVSSCCQPSCC

SEQ ID NO: 43234 - protein, 169 aa, Homo sapiens; identical to SEQ ID NO: 43233
  Payload ID: 8886
  Gene Symbol: KRTAP9-9
  Gene Name: keratin associated protein 9-9
  Uniprot ID: Q9BYP9
  ENSP ID: ENSP00000460586

SEQ ID NO: 43235 - protein, 174 aa, Homo sapiens
  Payload ID: 8886
  Gene Symbol: KRTAP9-9
  Gene Name: keratin associated protein 9-9
  ENSP ID: ENSP00000464818
MTHCCSPCCQPTCCRTTCCRTTCWKPTTVTTCSSTPCCQPSCCVSSCCQPCCRPACCQNTCCRTTCCQPTCLTSCCQPSCCSTTCCQPICCGSSCCGQTSCGSSCGQSSSCAPVYCRRTCYYPTTVCLPGCLNQSCGSSCCQPCCRPACCETTCCRTTCFQPTCVSSCCQPSCC

SEQ ID NO: 43236 - protein, 154 aa, Homo sapiens
  Payload ID: 8886
  Gene Symbol: KRTAP9-9
  Gene Name: keratin associated protein 9-9
  Uniprot ID: Q9BYP9
  ENSP ID: ENSP00000478038
MTHCCSPCCQPTCCRTTCCRTTCWKPTTVTTCSSTPCCQPSCCVSSCCQPCCRPACCQNTCCRTTCCQPTCLSSCCGQTSCGSSCGQSSSCAPVYCRRTCYYPTTVCLPGCLNQSCGSSCCQPCCRPACCETTCCRTTCFQPTCVSSCCQPSCC

SEQ ID NO: 43237 - protein, 154 aa, Homo sapiens; identical to SEQ ID NO: 43236
  Payload ID: 8886
  Gene Symbol: KRTAP9-9
  Gene Name: keratin associated protein 9-9
  ENSP ID: ENSP00000480115

SEQ ID NO: 43238 - protein, 174 aa, Homo sapiens
  Payload ID: 8886
  Gene Symbol: KRTAP9-9
  Gene Name: keratin associated protein 9-9
  ENSP ID: ENSP00000481491
MTHCCSPCCQPTCCRTTCCRTTCWKPTTVTTCSSTPCCQPSCCVSSCCQPCCRPTCCQNTCCRTTCCQPTCLTSCCQPSCCSTTCCQPICCGSSCCGQTSCGSSCGQSSSCAPVYCRRTCYYPTTVCLPGCLNQSCGSSCCQPCCRPACCETTCCRTTCFQPTCVSSCCQPSCC

SEQ ID NO: 43239 - protein, 169 aa, Homo sapiens; identical to SEQ ID NO: 43233
  Payload ID: 8886
  Gene Symbol: KRTAP9-9
  Gene Name: keratin associated protein 9-9
  ENSP ID: ENSP00000484048

SEQ ID NO: 43240 - protein, 159 aa, Homo sapiens
  Payload ID: 8886
  Gene Symbol: KRTAP9-9
  Gene Name: keratin associated protein 9-9
  ENSP ID: ENSP00000484247
MTHCCSPCCQPTCCRTTCWKPTTVTTCSSTPCCQPSCCVSSCCQPCCRPACCQNTCFQPTCVSSCCQPSCCSTPCCQSSCCGQTSCGSSCGQSSSCAPVYCRRTCYHPTTVCLPGCLNQSCGSSCCQPCCRPACCETTCCRTTCFQPTSVISCCQPSCC

SEQ ID NO: 43241 - protein, 154 aa, Homo sapiens; identical to SEQ ID NO: 43236
  Payload ID: 8886
  Gene Symbol: KRTAP9-9
  Gene Name: keratin associated protein 9-9
  Uniprot ID: Q9BYP9
  ENSP ID: ENSP00000484433

SEQ ID NO: 43242 - protein, 295 aa, Homo sapiens; identical to SEQ ID NO: 42965
  Payload ID: 8887
  Gene Symbol: RP5-1028K7.3
  Gene Name: Keratin-like protein KRT222
  ENSP ID: ENSP00000463483

SEQ ID NO: 43243 - protein, 162 aa, Homo sapiens
  Payload ID: 8888
  Gene Symbol: KRTCAP2
  Gene Name: keratinocyte associated protein 2
  Uniprot ID: Q8N6L1
  ENSP ID: ENSP00000295682
MRIANRTRFSSPFLARGAGWTHGRGMMVVGTGTSLALSSLLSLLLFAGMQMYSRQLASTEWLTIQGGLLGSGLFVFSLTAFNNLENLVFGKGFQAKIFPEILLCLLLALFASGLIHRVCVTTCFIFSMVGLYYINKISSTLYQAAAPVLTPAKVTGKSKKRN

SEQ ID NO: 43244 - protein, 240 aa, Homo sapiens
  Payload ID: 8889
  Gene Symbol: KRTCAP3
  Gene Name: keratinocyte associated protein 3
  Uniprot ID: Q53RY4
  ENSP ID: ENSP00000288873
MRRCSLCAFDAARGPRRLMRVGLALILVGHVNLLLGAVLHGTVLRHVANPRGAVTPEYTVANVISVGSGLLSVSVGLVALLASRNLLRPPLHWVLLALALVNLLLSVACSLGLLLAVSLTVANGGRRLIADCHPGLLDPLVPLDEGPGHTDCPFDPTRIYDTALALWIPSLLMSAGEAALSGYCCVAALTLRGVGPCRKDGLQGQLEEMTELESPKCKRQENEQLLDQNQEIRASQRSWV

SEQ ID NO: 43245 - protein, 222 aa, Homo sapiens
  Payload ID: 8889
  Gene Symbol: KRTCAP3
  Gene Name: keratinocyte associated protein 3
  Uniprot ID: Q53RY4
  ENSP ID: ENSP00000384689
MRVGLALILVGHVNLLLGAVLHGTVLRHVANPRGAVTPEYTVANVISVGSGLLSVSVGLVALLASRNLLRPPLHWVLLALALVNLLLSVACSLGLLLAVSLTVANGGRRLIADCHPGLLDPLVPLDEGPGHTDCPFDPTRIYDTALALWIPSLLMSAGEAALSGYCCVAALTLRGVGPCRKDGLQGQLEEMTELESPKCKRQENEQLLDQNQEIRASQRSWV

SEQ ID NO: 43246 - protein, 62 aa, Homo sapiens
  Payload ID: 8889
  Gene Symbol: KRTCAP3
  Gene Name: keratinocyte associated protein 3
  ENSP ID: ENSP00000388115
ALSGYCCVAALTLRGVGPCRKDGLQGQLEEMTELESPKCKRQENEQLLDQNQEIRASQRSWV

SEQ ID NO: 43247 - protein, 68 aa, Homo sapiens
  Payload ID: 8889
  Gene Symbol: KRTCAP3
  Gene Name: keratinocyte associated protein 3
  ENSP ID: ENSP00000389860
MRRCSLCAFERFRGTCGPPGVQEPSSPSTALGPAGTSSGEPALVRCLLPGPPSCCVTHCGQRWPPPYC

SEQ ID NO: 43248 - protein, 240 aa, Homo sapiens; identical to SEQ ID NO: 43244
  Payload ID: 8889
  Gene Symbol: KRTCAP3
  Gene Name: keratinocyte associated protein 3
  Uniprot ID: Q53RY4
  ENSP ID: ENSP00000442400

SEQ ID NO: 43249 - protein, 398 aa, Homo sapiens
  Payload ID: 8890
  Gene Symbol: KDF1
  Gene Name: keratinocyte differentiation factor 1
  Uniprot ID: Q8NAX2
  ENSP ID: ENSP00000319179
MPRPGHPRPASGPPRLGPWERPTELCLETYDKPPQPPPSRRTRRPDPKDPGHHGPESITFISGSAEPALESPTCCLLWRPWVWEWCRAAFCFRRCRDCLQRCGACVRGCSPCLSTEDSTEGTAEANWAKEHNGVPPSPDRAPPSRRDGQRLKSTMGSSFSYPDVKLKGIPVYPYPRATSPAPDADSCCKEPLADPPPMRHSLPSTFASSPRGSEEYYSFHESDLDLPEMGSGSMSSREIDVLIFKKLTELFSVHQIDELAKCTSDTVFLEKTSKISDLISSITQDYHLDEQDAEGRLVRGIIRISTRKSRARPQTSEGRSTRAAAPTAAAPDSGHETMVGSGLSQDELTVQISQETTADAIARKLRPYGAPGYPASHDSSFQGTDTDSSGAPLLQVYC

SEQ ID NO: 43250 - protein, 207 aa, Homo sapiens
  Payload ID: 8890
  Gene Symbol: KDF1
  Gene Name: keratinocyte differentiation factor 1
  ENSP ID: ENSP00000481107
MPRPGHPRPASGPPRLGPWERPTELCLETYDKPPQPPPSRRTRRPDPKDPGHHGPESITFISGSAEPALESPTCLLRTPLRGLLKPTGPRSTMECPPALIVHPPAGGMASGSSQPWAAASATPMLSSKASLCIPTRGPPPQPLMRTPAARSHWPIPHPCDTACPAPLPVVLVAPRSTILSMSRTWTCRRWAVAPCRAEKLMCSSSRS

SEQ ID NO: 43251 - protein, 99 aa, Homo sapiens
  Payload ID: 8891
  Gene Symbol: KRTDAP
  Gene Name: keratinocyte differentiation-associated protein
  Uniprot ID: P60985
  ENSP ID: ENSP00000339251
MKIPVLPAVVLLSLLVLHSAQGATLGGPEEESTIENYASRPEAFNTPFLNIDKLRSAFKADEFLNWHALFESIKRKLPFLNWDAFPKLKGLRSATPDAQ

SEQ ID NO: 43252 - protein, 85 aa, Homo sapiens
  Payload ID: 8891
  Gene Symbol: KRTDAP
  Gene Name: keratinocyte differentiation-associated protein
  Uniprot ID: P60985
  ENSP ID: ENSP00000470713
MKIPVLPAVVLLSLLVLHSAQGATLGGPEEESTIENYASRPEAFKADEFLNWHALFESIKRKLPFLNWDAFPKLKGLRSATPDAQ

SEQ ID NO: 43253 - protein, 579 aa, Homo sapiens
  Payload ID: 8892
  Gene Symbol: KPRP
  Gene Name: keratinocyte proline-rich protein
  Uniprot ID: Q5T749
  ENSP ID: ENSP00000475216
MCDQQQIQCRLPLQQCCVKGPSFCSSQSPFAQSQVVVQAPCEMQIVDCPASCPVQVCQVSDQAPCQSQTTQVKCQSKTKQVKGQAQCQSKTTQVKGQAASQSQTSSVQSQAPCQSEVSYVQCEASQPVQTCFVECAPVCYTETCYVECPVQNYVPCPAPQPVQMYRGRPAVCQPQGRFSTQCQYQGSYSSCGPQFQSRATCNNYTPQFQLRPSYSSCFPQYRSRTSFSPCVPQCQTQGSYGSFTEQHRSRSTSRCLPPPRRLQLFPRSCSPPRRFEPCSSSYLPLRPSEGFPNYCTPPRRSEPIYNSRCPRRPISSCSQRRGPKCRIEISSPCCPRQVPPQRCPVEIPPIRRRSQSCGPQPSWGASCPELRPHVEPRPLPSFCPPRRLDQCPESPLQRCPPPAPRPRLRPEPCISLEPRPRPLPRQLSEPCLYPEPLPALRPTPRPVPLPRPGQCEIPEPRPCLQPCEHPEPCPRPEPIPLPAPCPSPEPCRETWRSPSPCWGPNPVPYPGDLGCHESSPHRLDTEAPYCGPSSYNQGQESGAGCGPGDVFPERRGQDGHGDQGNAFAGVKGEAKSAYF

SEQ ID NO: 43254 - protein, 352 aa, Homo sapiens
  Payload ID: 8893
  Gene Symbol: KERA
  Gene Name: keratocan
  Uniprot ID: O60938
  ENSP ID: ENSP00000266719
MAGTICFIMWVLFITDTVWSRSVRQVYEVHDSDDWTIHDFECPMECFCPPSFPTALYCENRGLKEIPAIPSRIWYLYLQNNLIETIPEKPFENATQLRWINLNKNKITNYGIEKGALSQLKKLLFLFLEDNELEEVPSPLPRSLEQLQLARNKVSRIPQGTFSNLENLTLLDLQNNKLVDNAFQRDTFKGLKNLMQLNMAKNALRNMPPRLPANTMQLFLDNNSIEGIPENYFNVIPKVAFLRLNHNKLSDEGLPSRGFDVSSILDLQLSHNQLTKVPRISAHLQHLHLDHNKIKSVNVSVICPSPSMLPAERDSFSYGPHLRYLRLDGNEIKPPIPMALMTCFRLLQAVII

SEQ ID NO: 43255 - protein, 298 aa, Homo sapiens
  Payload ID: 8894
  Gene Symbol: KHK
  Gene Name: ketohexokinase (fructokinase)
  Uniprot ID: P50053
  ENSP ID: ENSP00000260598
MEEKQILCVGLVVLDVISLVDKYPKEDSEIRCLSQRWQRGGNASNSCTVLSLLGAPCAFMGSMAPGHVADFLVADFRRRGVDVSQVAWQSKGDTPSSCCIINNSNGNRTIVLHDTSLPDVSATDFEKVDLTQFKWIHIEGRNASEQVKMLQRIDAHNTRQPPEQKIRVSVEVEKPREELFQLFGYGDVVFVSKDVAKHLGFQSAEEALRGLYGRVRKGAVLVCAWAEEGADALGPDGKLLHSDAFPPPRVVDTLGAGDTFNASVIFSLSQGRSVQEALRFGCQVAGKKCGLQGFDGIV

SEQ ID NO: 43256 - protein, 298 aa, Homo sapiens
  Payload ID: 8894
  Gene Symbol: KHK
  Gene Name: ketohexokinase (fructokinase)
  Uniprot ID: P50053
  ENSP ID: ENSP00000260599
MEEKQILCVGLVVLDVISLVDKYPKEDSEIRCLSQRWQRGGNASNSCTVLSLLGAPCAFMGSMAPGHVADFVLDDLRRYSVDLRYTVFQTTGSVPIATVIINEASGSRTILYYDRSLPDVSATDFEKVDLTQFKWIHIEGRNASEQVKMLQRIDAHNTRQPPEQKIRVSVEVEKPREELFQLFGYGDVVFVSKDVAKHLGFQSAEEALRGLYGRVRKGAVLVCAWAEEGADALGPDGKLLHSDAFPPPRVVDTLGAGDTFNASVIFSLSQGRSVQEALRFGCQVAGKKCGLQGFDGIV

SEQ ID NO: 43257 - protein, 279 aa, Homo sapiens
  Payload ID: 8894
  Gene Symbol: KHK
  Gene Name: ketohexokinase (fructokinase)
  ENSP ID: ENSP00000404741
MEEKQILCVGLVVLDVISLVDKYPKEDSEIRCLSQRWQRGGNASNSCTVLSLLGAPCAFMGSMAPGHVADFVLDDLRRYSVDLRYTVFQTTGSVPIATVIINEASGSRTILYYDSFLVADFRRRGVDVSQVAWQSKGDTPSSCCIINNSNGNRTIVLHDTSLPDVSATDFEKVDLTQFKWIHIEGRNASEQVKMLQRIDAHNTRQPPEQKIRVSVEVEKPREELFQLFGYGDVVFVSKDVAKHLGFQSAEEALRGLYGRVRKGAVLVCAWAEEGADALG

SEQ ID NO: 43258 - protein, 678 aa, Homo sapiens
  Payload ID: 8895
  Gene Symbol: KHNYN
  Gene Name: KH and NYN domain containing
  Uniprot ID: O15037
  ENSP ID: ENSP00000251343
MPTWGARPASPDRFAVSAEAENKVREQQPHVERIFSVGVSVLPKDCPDNPHIWLQLEGPKENASRAKEYLKGLCSPELQDEIHYPPKLHCIFLGAQGFFLDCLAWSTSAHLVPRAPGSLMISGLTEAFVMAQSRVEELAERLSWDFTPGPSSGASQCTGVLRDFSALLQSPGDAHREALLQLPLAVQEELLSLVQEASSGQGPGALASWEGRSSALLGAQCQGVRAPPSDGRESLDTGSMGPGDCRGARGDTYAVEKEGGKQGGPREMDWGWKELPGEEAWEREVALRPQSVGGGARESAPLKGKALGKEEIALGGGGFCVHREPPGAHGSCHRAAQSRGASLLQRLHNGNASPPRVPSPPPAPEPPWHCGDRGDCGDRGDVGDRGDKQQGMARGRGPQWKRGARGGNLVTGTQRFKEALQDPFTLCLANVPGQPDLRHIVIDGSNVAMVHGLQHYFSSRGIAIAVQYFWDRGHRDITVFVPQWRFSKDAKVRESHFLQKLYSLSLLSLTPSRVMDGKRISSYDDRFMVKLAEETDGIIVSNDQFRDLAEESEKWMAIIRERLLPFTFVGNLFMVPDDPLGRNGPTLDEFLKKPARTQGSSKAQHPSRGFAEHGKQQQGREEEKGSGGIRKTRETERLRRQLLEVFWGQDHKVDFILQREPYCRDINQLSEALLSLNF

SEQ ID NO: 43259 - protein, 678 aa, Homo sapiens; identical to SEQ ID NO: 43258
  Payload ID: 8895
  Gene Symbol: KHNYN
  Gene Name: KH and NYN domain containing
  Uniprot ID: O15037
  ENSP ID: ENSP00000450799

SEQ ID NO: 43260 - protein, 134 aa, Homo sapiens
  Payload ID: 8895
  Gene Symbol: KHNYN
  Gene Name: KH and NYN domain containing
  ENSP ID: ENSP00000451004
MPTWGARPASPDRFAVSAEAENKVREQQPHVERIFSVGVSVLPKDCPDNPHIWLQLEGPKENASRAKEYLKGLCSPELQDEIHYPPKLHCIFLGAQGFFLDCLAWSTSAHLVPRAPGSLMISGLTEAFVMAQSR

SEQ ID NO: 43261 - protein, 678 aa, Homo sapiens; identical to SEQ ID NO: 43258
  Payload ID: 8895
  Gene Symbol: KHNYN
  Gene Name: KH and NYN domain containing
  Uniprot ID: O15037
  ENSP ID: ENSP00000451106

SEQ ID NO: 43262 - protein, 123 aa, Homo sapiens
  Payload ID: 8895
  Gene Symbol: KHNYN
  Gene Name: KH and NYN domain containing
  ENSP ID: ENSP00000451227
MAIIRERLLPFTFVGNLFMVPDDPLGRNGPTLDEFLKKPARTQGSSKAQHPSRGFAEHGKQQQGREEEKGSGGIRKTRETERLRRQLLEVFWGQDHKVDFILQREPYCRDINQLSEALLSLNF

SEQ ID NO: 43263 - protein, 217 aa, Homo sapiens
  Payload ID: 8896
  Gene Symbol: KHDC3L
  Gene Name: KH domain containing 3-like, subcortical maternal complex member
  Uniprot ID: Q587J8
  ENSP ID: ENSP00000359392
MDAPRRFPTLVQLMQPKAMPVEVLGHLPKRFSWFHSEFLKNPKVVRLEVWLVEKIFGRGGERIPHVQGMSQILIHVNRLDPNGEAEILVFGRPSYQEDTIKMIMNLADYHRQLQAKGSGKALAQDVATQKAETQRSSIEVREAGTQRSVEVREAGTQRSVEVQEVGTQGSPVEVQEAGTQQSLQAANKSGTQRSPEAASKAVTQRFREDARDPVTRL

SEQ ID NO: 43264 - protein, 443 aa, Homo sapiens
  Payload ID: 8897
  Gene Symbol: KHDRBS1
  Gene Name: KH domain containing, RNA binding, signal transduction associated 1
  Uniprot ID: Q07666
  ENSP ID: ENSP00000313829
MQRRDDPAARMSRSSGRSGSMDPSGAHPSVRQTPSRQPPLPHRSRGGGGGSRGGARASPATQPPPLLPPSATGPDATVGGPAPTPLLPPSATASVKMEPENKYLPELMAEKDSLDPSFTHAMQLLTAEIEKIQKGDSKKDDEENYLDLFSHKNMKLKERVLIPVKQYPKFNFVGKILGPQGNTIKRLQEETGAKISVLGKGSMRDKAKEEELRKGGDPKYAHLNMDLHVFIEVFGPPCEAYALMAHAMEEVKKFLVPDMMDDICQEQFLELSYLNGVPEPSRGRGVPVRGRGAAPPPPPVPRGRGVGPPRGALVRGTPVRGAITRGATVTRGVPPPPTVRGAPAPRARTAGIQRIPLPPPPAPETYEEYGYDDTYAEQSYEGYEGYYSQSQGDSEYYDYGHGEVQDSYEAYGQDDWNGTRPSLKAPPARPVKGAYREHPYGRY

SEQ ID NO: 43265 - protein, 404 aa, Homo sapiens
  Payload ID: 8897
  Gene Symbol: KHDRBS1
  Gene Name: KH domain containing, RNA binding, signal transduction associated 1
  Uniprot ID: Q07666
  ENSP ID: ENSP00000417731
MQRRDDPAARMSRSSGRSGSMDPSGAHPSVRQTPSRQPPLPHRSRGGGGGSRGGARASPATQPPPLLPPSATGPDATVGGPAPTPLLPPSATASVKMEPENKYLPELMAEKDSLDPSFTHAMQLLTAEIEKIQKGDSKKDDEENYLDLFSHKNMKLKERVLIPVKQYPKEEELRKGGDPKYAHLNMDLHVFIEVFGPPCEAYALMAHAMEEVKKFLVPDMMDDICQEQFLELSYLNGVPEPSRGRGVPVRGRGAAPPPPPVPRGRGVGPPRGALVRGTPVRGAITRGATVTRGVPPPPTVRGAPAPRARTAGIQRIPLPPPPAPETYEEYGYDDTYAEQSYEGYEGYYSQSQGDSEYYDYGHGEVQDSYEAYGQDDWNGTRPSLKAPPARPVKGAYREHPYGRY

SEQ ID NO: 43266 - protein, 349 aa, Homo sapiens
  Payload ID: 8898
  Gene Symbol: KHDRBS2
  Gene Name: KH domain containing, RNA binding, signal transduction associated 2
  Uniprot ID: Q5VWX1
  ENSP ID: ENSP00000281156
MEEEKYLPELMAEKDSLDPSFVHASRLLAEEIEKFQGSDGKKEDEEKKYLDVISNKNIKLSERVLIPVKQYPKFNFVGKLLGPRGNSLKRLQEETGAKMSILGKGSMRDKAKEEELRKSGEAKYAHLSDELHVLIEVFAPPGEAYSRMSHALEEIKKFLVPDYNDEIRQEQLRELSYLNGSEDSGRGRGIRGRGIRIAPTAPSRGRGGAIPPPPPPGRGVLTPRGSTVTRGALPVPPVARGVPTPRARGAPTVPGYRAPPPPAHEAYEEYGYDDGYGGEYDDQTYETYDNSYATQTQSVPEYYDYGHGVSEDAYDSYAPEEWATTRSSLKAPPQRSARGGYREHPYGRY

SEQ ID NO: 43267 - protein, 346 aa, Homo sapiens
  Payload ID: 8899
  Gene Symbol: KHDRBS3
  Gene Name: KH domain containing, RNA binding, signal transduction associated 3
  Uniprot ID: O75525
  ENSP ID: ENSP00000348108
MEEKYLPELMAEKDSLDPSFTHALRLVNQEIEKFQKGEGKDEEKYIDVVINKNMKLGQKVLIPVKQFPKFNFVGKLLGPRGNSLKRLQEETLTKMSILGKGSMRDKAKEEELRKSGEAKYFHLNDDLHVLIEVFAPPAEAYARMGHALEEIKKFLIPDYNDEIRQAQLQELTYLNGGSENADVPVVRGKPTLRTRGVPAPAITRGRGGVTARPVGVVVPRGTPTPRGVLSTRGPVSRGRGLLTPRARGVPPTGYRPPPPPPTQETYGEYDYDDGYGTAYDEQSYDSYDNSYSTPAQSGADYYDYGHGLSEETYDSYGQEEWTNSRHKAPSARTAKGVYRDQPYGRY

SEQ ID NO: 43268 - protein, 195 aa, Homo sapiens
  Payload ID: 8899
  Gene Symbol: KHDRBS3
  Gene Name: KH domain containing, RNA binding, signal transduction associated 3
  ENSP ID: ENSP00000427841
  MOD_RES (1)..(1): Any amino acid
XLQEETLTKMSILGKGSMRDKAKEEELRKSGEAKYFHLNDDLHVLIEVFAPPAEAYARMGHALEEIKKFLIPDYNDEIRQAQLQELTYLNGGSENADVPVVRGKPTLRTRGVPAPAITRGRGGVTARPVGVVVPRGTPTPRGVLSTRGPVSRGRGLLTPRARGVPPTGYRPPPPPPTQETYGEYGKKSGLTQDTR

SEQ ID NO: 43269 - protein, 196 aa, Homo sapiens
  Payload ID: 8899
  Gene Symbol: KHDRBS3
  Gene Name: KH domain containing, RNA binding, signal transduction associated 3
  ENSP ID: ENSP00000427851
  MOD_RES (1)..(1): Any amino acid
XLGPRGNSLKRLQEETLTKMSILGKGSMRDKAKEEELRKSGEAKYFHLNDDLHVLIEVFAPPAEAYARMGHALEEIKKFLIPDYNDEIRQAQLQELTYLNGGSENADVPVVRGKPTLRTRGVPAPAITRGRGGVTARPVGVVVPRGTPTPRGVLSTRGPVSRGRGLLTPRARGVPPTGYRPPPPPPTQETYGEYWC

SEQ ID NO: 43270 - protein, 119 aa, Homo sapiens
  Payload ID: 8899
  Gene Symbol: KHDRBS3
  Gene Name: KH domain containing, RNA binding, signal transduction associated 3
  ENSP ID: ENSP00000428607
MHEIEKFQKGEGKDEEKYIDVVINKNMKLGQKVLIPVKQFPKDYDDGYGTAYDEQSYDSYDNSYSTPAQSGADYYDYGHGLSEETYDSYGQEEWTNSRHKAPSARTAKGVYRDQPYGRY

SEQ ID NO: 43271 - protein, 59 aa, Homo sapiens
  Payload ID: 8899
  Gene Symbol: KHDRBS3
  Gene Name: KH domain containing, RNA binding, signal transduction associated 3
  ENSP ID: ENSP00000428643
  MOD_RES (1)..(1): Any amino acid
XNSYSTPAQSGADYYDYGHGLSEETYDSYGQEEWTNSRHKAPSARTAKGVYRDQPYGRY

SEQ ID NO: 43272 - protein, 160 aa, Homo sapiens
  Payload ID: 8899
  Gene Symbol: KHDRBS3
  Gene Name: KH domain containing, RNA binding, signal transduction associated 3
  ENSP ID: ENSP00000430284
MHEIEKFQKGEGKDEEKYIDVVINKNMKLGQKVLIPVKQFPKFNFVGKLLGPRGNSLKRLQEETLTKMSILGKGSMRDKAKEEELRKSGEAKYFHLNDDLHVLIEVFAPPAEAYARMGHALEEIKKFLIPDYNDEIRQAQLQELTYLNGGSENADVPVVR

SEQ ID NO: 43273 - protein, 265 aa, Homo sapiens
  Payload ID: 8899
  Gene Symbol: KHDRBS3
  Gene Name: KH domain containing, RNA binding, signal transduction associated 3
  ENSP ID: ENSP00000431022
MEIEKFQKGEGKDEEKYIDVVINKNMKLGQKVLIPVKQFPKFNFVGKLLGPRGNSLKRLQEETLTKMSILGKGSMRDKAKEEELRKSGEAKYFHLNDDLHVLIEVFAPPAEAYARMGHALEEIKKFLIPDYNDEIRQAQLQELTYLNGGSENADVPVVRGKPTLRTRGVPAPAITRGRGGVTARPVGVVVPRGTPTPRGVLSTRGPVSRGRGLLTPRARGVPPTGYRPPPPPPTQETYGEYDYDDGYGTAYDEQSYDSYDNSYST

SEQ ID NO: 43274 - protein, 164 aa, Homo sapiens
  Payload ID: 8900
  Gene Symbol: KHDC1
  Gene Name: KH homology domain containing 1
  Uniprot ID: Q4VXA5
  ENSP ID: ENSP00000257765
MDMGTSALSKKPWWTLPQNFHAPMVFHMEEDQEELIFGHGDTYLRCIEVHSHTLIQLESWFTATGQTRVTVVGPHRARQWLLHMFCCVGSQDSYHHARGLEMLERVRSQPLTNDDLVTSISVPPYTGDLSLAPRISGTVCLSVPQPSPYQVIGCSGFHLSSLYP

SEQ ID NO: 43275 - protein, 237 aa, Homo sapiens
  Payload ID: 8900
  Gene Symbol: KHDC1
  Gene Name: KH homology domain containing 1
  Uniprot ID: Q4VXA5
  ENSP ID: ENSP00000359411
MLSAFQRLFRVLFVIETVSEYGVLIFIYGWPFLQTLAMLLIGTVSFHLWIRRNRERNSRSGKTRCRSKRSEQSMDMGTSALSKKPWWTLPQNFHAPMVFHMEEDQEELIFGHGDTYLRCIEVHSHTLIQLESWFTATGQTRVTVVGPHRARQWLLHMFCCVGSQDSYHHARGLEMLERVRSQPLTNDDLVTSISVPPYTGDLSLAPRISGTVCLSVPQPSPYQVIGCSGFHLSSLYP

SEQ ID NO: 43276 - protein, 98 aa, Homo sapiens
  Payload ID: 8900
  Gene Symbol: KHDC1
  Gene Name: KH homology domain containing 1
  ENSP ID: ENSP00000406966
MDMGTSALSKKPWWTLPQNFHAPMVFHMEEDQEELIFGHGDTYLRCIEVHSHTLIQLESWFTATGQTRVTVVGPHRARQWLLHMFCCVGSQDSYHHAR

SEQ ID NO: 43277 - protein, 164 aa, Homo sapiens; identical to SEQ ID NO: 43274
  Payload ID: 8900
  Gene Symbol: KHDC1
  Gene Name: KH homology domain containing 1
  Uniprot ID: Q4VXA5
  ENSP ID: ENSP00000479158

SEQ ID NO: 43278 - protein, 128 aa, Homo sapiens
  Payload ID: 8900
  Gene Symbol: KHDC1
  Gene Name: KH homology domain containing 1
  ENSP ID: ENSP00000481490
MDMGTSALSKKPWWTLPQNFHAPMVFHMEEDQEELIFGHGDTYLRCIEVHSHTLIQLESWFTATGQTRVTVVGPHRARQWLLHMFCCVGSQDSYHHARGLEMLERVRSQPLTNDDLVTSISVPPYTGD

SEQ ID NO: 43279 - protein, 128 aa, Homo sapiens
  Payload ID: 8901
  Gene Symbol: KHDC1L
  Gene Name: KH homology domain containing 1-like
  Uniprot ID: Q5JSQ8
  ENSP ID: ENSP00000359415
MAVGTSALSKEPWWTLPENFHSPMVFHMEEDQEELIFGLDDTYLRCIELHSHTLIQLERCFTATGQTRVTVVGPPMAKQWLLLMFHCVGSQDSKCHARGLKMLERVRSQPLTNDDLVTSVSLPPYTGD

SEQ ID NO: 43280 - protein, 711 aa, Homo sapiens
  Payload ID: 8902
  Gene Symbol: KHSRP
  Gene Name: KH-type splicing regulatory protein
  Uniprot ID: Q92945
  ENSP ID: ENSP00000381216
MSDYSTGGPPPGPPPPAGGGGGAGGAGGGPPPGPPGAGDRGGGGPGGGGPGGGSAGGPSQPPGGGGPGIRKDAFADAVQRARQIAAKIGGDAATTVNNSTPDFGFGGQKRQLEDGDQPESKKLASQGDSISSQLGPIHPPPRTSMTEEYRVPDGMVGLIIGRGGEQINKIQQDSGCKVQISPDSGGLPERSVSLTGAPESVQKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEPPQPPPTGQSDYTKAWEEYYKKIGQQPQQPGAPPQQDYTKAWEEYYKKQAQVATGGGPGAPPGSQPDYSAAWAEYYRQQAAYYGQTPGPGGPQPPPTQQGQQQAQ

SEQ ID NO: 43281 - protein, 116 aa, Homo sapiens
  Payload ID: 8902
  Gene Symbol: KHSRP
  Gene Name: KH-type splicing regulatory protein
  ENSP ID: ENSP00000469431
MTEEYRVPDGMVGLIIGRGGEQINKIQQDSGCKVQISPDSGGLPERSVSLTGAPESVQKAKMMLDDIVSRGRGGPPGQFHDNANGGQNGTVQEIMIPAGKAGLVIGKGGETIKQLQ

SEQ ID NO: 43282 - protein, 114 aa, Homo sapiens
  Payload ID: 8902
  Gene Symbol: KHSRP
  Gene Name: KH-type splicing regulatory protein
  ENSP ID: ENSP00000469804
  MOD_RES (1)..(1): Any amino acid
XAAYYSHYYQQPPGPVPGPAPAPAAPPAQGEPPQPPPTGQSDYTKAWEEYYKKIGQQPQQPGAPPQQDYTKAWEEYYKKQAPSSLPPALAQLPRPRPSPLPGLVCCLFICSRGD

SEQ ID NO: 43283 - protein, 169 aa, Homo sapiens
  Payload ID: 8902
  Gene Symbol: KHSRP
  Gene Name: KH-type splicing regulatory protein
  ENSP ID: ENSP00000469830
MTEEYRVPDGMVGLIIGRGGEQINKIQQDSGCKVQISPDSGGLPERSVSLTGAPESVQKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGD

SEQ ID NO: 43284 - protein, 176 aa, Homo sapiens
  Payload ID: 8902
  Gene Symbol: KHSRP
  Gene Name: KH-type splicing regulatory protein
  ENSP ID: ENSP00000471146
  MOD_RES (1)..(1): Any amino acid
XNAAWAAYYSHYYQQPPGPVPGPAPAPAAPPAQGEPPQPPPTGQSDYTKAWEEYYKKIGQQPQQPGAPPQQDYTKAWEEYYKKQAQVATGGGPGAPPGSQPDYSAAWAEYYRQQAAYYGQTPGPGGPQPPPTQQGQQQASGNCHPPPPPFSFQPPATVHPALVGSAGNPFPCGVCP

SEQ ID NO: 43285 - protein, 279 aa, Homo sapiens
  Payload ID: 8902
  Gene Symbol: KHSRP
  Gene Name: KH-type splicing regulatory protein
  ENSP ID: ENSP00000471262
  MOD_RES (1)..(1): Any amino acid
XSQPPGGGGPGIRKDAFADAVQRARQIAAKIGGDAATTVNNSTPDFGFGGQKRQLEDGDQPESKKLASQGDSISSQLGPIHPPPRTSMTEEYRVPDGMVGLNSGGLPERSVSLTGAPESVQKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQ

SEQ ID NO: 43286 - protein, 79 aa, Homo sapiens
  Payload ID: 8902
  Gene Symbol: KHSRP
  Gene Name: KH-type splicing regulatory protein
  ENSP ID: ENSP00000472328
  MOD_RES (1)..(1): Any amino acid
XQQPGAPPQQDYTKAWEEYYKKQAQVATGGGPGAPPGSQPDYSAAWAEYYRQQAAYYGQTPGPGGPQPPPTQQGQQQPS

SEQ ID NO: 43287 - protein, 143 aa, Homo sapiens
  Payload ID: 8902
  Gene Symbol: KHSRP
  Gene Name: KH-type splicing regulatory protein
  ENSP ID: ENSP00000472347
YSHYYQQPPGPVPGPAPAPAAPPAQGQQPQQPGAPPQQDYTKAWEEYYKKQAQVATGGGPGAPPGSQPDYSAAWAEYYRQQAAYYGQTPGPGGPQPPPTQQGQQQASGNCHPPPPPFSFQPPATVHPALVGSAGNPFPCGVCP

SEQ ID NO: 43288 - protein, 269 aa, Homo sapiens
  Payload ID: 8902
  Gene Symbol: KHSRP
  Gene Name: KH-type splicing regulatory protein
  ENSP ID: ENSP00000473254
  MOD_RES (1)..(1): Any amino acid
XNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGQQPQQPGAPPQQDYTKAWEEYYKKQAQVATGGGPGAPPGSQPDYSAAWAEYYRQQAAYYGQTPGPGGPQPPPTQQGQQQAQ

SEQ ID NO: 43289 - protein, 711 aa, Homo sapiens
  Payload ID: 8902
  Gene Symbol: KHSRP
  Gene Name: KH-type splicing regulatory protein
  ENSP ID: ENSP00000478033
MSDYSTGGPPPGPPPPAGGGGGAGGAGGGPPPGPPGAGDRGGGGPGGGGPGGGSAGGPSQPPGGGGPGIRKDAFADAVQRARQIAAKIGGDAATTVNNSTPDFGFGGQKRQLEDGDQPESKKLASQGDSISSQLGPIHPPPRTSMTEEYRVPDGMVGLIIGRGGEQINKIQQDSGCKVQISPDSGGLPERSVSLTGAPESVQKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEPPQPPPTGQSDYTKAWEEYYKKIGQQPQQPGAPPQQDYTKAWEEYYKKQAQVATGGGPGAPPGSQDPFPQQPSPLLPPALAQLPRPRPSPLPGLVCCLFICSRGD

SEQ ID NO: 43290 - protein, 99 aa, Homo sapiens
  Payload ID: 8903
  Gene Symbol: KIAA0040
  Gene Name: KIAA0040
  ENSP ID: ENSP00000462172
MERISAFFSSIWDTILTKHQEGIYNTICLGVLLGLPLLVIITLLFICCHCCWSPPGKRGQQPEKNKKKKKKKKKKDEEDLWISAQPKLLQMEKRPSLPV

SEQ ID NO: 43291 - protein, 99 aa, Homo sapiens; identical to SEQ ID NO: 43290
  Payload ID: 8903
  Gene Symbol: KIAA0040
  Gene Name: KIAA0040
  ENSP ID: ENSP00000463734

SEQ ID NO: 43292 - protein, 99 aa, Homo sapiens; identical to SEQ ID NO: 43290
  Payload ID: 8903
  Gene Symbol: KIAA0040
  Gene Name: KIAA0040
  ENSP ID: ENSP00000464040

SEQ ID NO: 43293 - protein, 153 aa, Homo sapiens
  Payload ID: 8903
  Gene Symbol: KIAA0040
  Gene Name: KIAA0040
  Uniprot ID: Q15053
  ENSP ID: ENSP00000478803
MHYVHVHRVTTQPRNKPQTKCPSGGQSQGPRGQFLDTVLAAMCPIAMLLTADPGMPPTCLWHTPHAKHKEHLSIHLNMVPKCVHMHVTHTHTNSGSRYVGKYILLIKWSLAMYFVQGSTLSTVTKMSHGKALPDSDTYIQFPNQQGPHTPSIP

SEQ ID NO: 43294 - protein, 2235 aa, Homo sapiens
  Payload ID: 8904
  Gene Symbol: KIAA0100
  Gene Name: KIAA0100
  Uniprot ID: Q14667
  ENSP ID: ENSP00000436773
MPLFFSALLVLLLVALSALFLGRWLVVRLATKWCQRKLQAELKIGSFRFFWIQNVSLKFQQHQQTVEIDNLWISSKLLSHDLPHYVALCFGEVRIRTDLQKVSDLSAPFSQSAGVDQKELSFSPSLLKIFCQLFSIHVDAINIMVLKVDTSESLWHIQISRSRFLLDSDGKRLICEVSLCKINSKVLKSGQLEDTCLVELSLALDLCLKVGISSRHLTAITVDVWTLHAELHEGLFQSQLLCQGPSLASKPVPCSEVTENLVEPTLPGLFLLQQLPDQVKVKMENTSVVLSMNSQKRHLTWTLKLLQFLYHRDEDQLPLRSFTANSDMAQMSTELLLEDGLLLSQSRQRIVCLNSLKASVQVTTIDLSASLVLNTCIIHYRHQEFSHWLHLLALETQGSSSPVLKQRKKRTFPQILAPIIFSTSISNVNISIQLGDTPPFALGFNSISLDYQHLRPQSIHQRGVLTVDHLCWRVGSDSHIQRAPHPPNMHVWGEALVLDSFTLQGSYNQPLGLSSTQSDTLFLDCTIRGLQVEASDTCAQCLSRILSLMGPQSGKSAVSRHSSFGESVSLLWKVDLKVEDMNLFTLSALVGASEVRLDTLTILGSAETSTVGIQGLVLALVKSVTEKMQPCCKAPDIPTPVLSLSMLSITYHSSIRSLEVQCGAGLTLLWSPPDHMYLYQHVLATLQCRDLLRATVFPETVPSLALETSGTTSELEGRAPEPLPPKRLLNLTLEVSTAKLTAFVAEDKFITLAAESVSLSRHGGSLQAYCPELAAGFDGNSIFNFKEVEVQLLPELEEMILHRNPFPALQTLRNRVWLLSFGSVSVEFPYQYDFSRTLDEAVGVQKWLKGLHQGTRAWASPSPVPLPPDLLLKVEHFSWVFLDDVFEVKLHDNYELMKDESKESAKRLQLLDAKVAALRKQHGELLPARKIEELYASLERKNIEIYIQRSRRLYGNTPMRRALLTWSLAGLELVALADASFHGPEHVVEQVQELDPGSPFPPEGLDLVIQWCRMLKCNVKSFLVRIRDYPRYLFEIRDWRLMGRLVGTEQSGQPCSRRRQILHLGLPWGNVAVERNMPPLKFYHDFHSEIFQYTVVWGPCWDPAWTLIGQCVDLLTKPSADPSPPLPWWDKSRLLFHGDWHMDIEQANLHQLATEDPYNTTENMHWEWSHLSFHWKPGQFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTAEEELSARDGDPTFHTHQLHLVDLRISWTTTNRDIAFGLYDGYKKAAVLKRNLSTEALKGLKIDPQMPAKKPKRGVPTSASAPPRVNTPSFSGQPDKGSSGGAYMLQKLIEETDRFVVFTEEESGMSDQLCGIAACQTDDIYNRNCLIELVNCQMVLRGAETEGCVIVSAAKAQLLQCQHHPAWYGDTLKQKTSWTCLLDGMQYFATTESSPTEQDGRQLWLEVKNIEEHRQRSLDSVQELMESGQAVGGMVTTTTDWNQPAEAQQAQQVQRIISRCNCRMYYISYSHDIDPELATQIKPPEVLENQEKEDLLKKQEGAVDTFTLIHHELEISTNPAQYAMILDIVNNLLLHVEPKRKEHSEKKQRVRFQLEISSNPEEQRSSILHLQEAVRQHVAQIRQLEKQMYSIMKSLQDDSKNENLLDLNQKLQLQLNQEKANLQLESEELNILIRCFKDFQLQRANKMELRKQQEDVSVVRRTEFYFAQARWRLTEEDGQLGIAELELQRFLYSKVNKSDDTAEHLLELGWFTMNNLLPNAVYKVVLRPQSSCQSGRQLALRLFSKVRPPVGGISVKEHFEVNVVPLTIQLTHQFFHRMMGFFFPGRSVEDDEVGDEEDKSKLVTTGIPVVKPRQLIATDDAVPLGPGKGVAQGLTRSSGVRRSFRKSPEHPVDDIDKMKERAAMNNSFIYIKIPQVPLCVSYKGEKNSVDWGDLNLVLPCLEYHNNTWTWLDFAMAVKRDSRKALVAQVIKEKLRLKSATGSEVRGKLETKSDLNMQQQEEEEKARLLIGLSVGDKNPGKKSIFGRRK

SEQ ID NO: 43295 - protein, 2092 aa, Homo sapiens
  Payload ID: 8904
  Gene Symbol: KIAA0100
  Gene Name: KIAA0100
  ENSP ID: ENSP00000446443
MVLKVDTSESLWHIQISRSRFLLDSDGKRLICEVSLCKINSKVLKSGQLEDTCLVELSLALDLCLKVGISSRHLTAITVDVWTLHAELHEGLFQSQLLCQGPSLASKPVPCSEVTENLVEPTLPGLFLLQQLPDQVKVKMENTSVVLSMNSQKRHLTWTLKLLQFLYHRDEDQLPLRSFTANSDMAQMSTELLLEDGLLLSQSRQRIVCLNSLKASVQVTTIDLSASLVLNTCIIHYRHQEFSHWLHLLALETQGSSSPVLKQRKKRTFPQILAPIIFSTSISNVNISIQLGDTPPFALGFNSISLDYQHLRPQSIHQRGVLTVDHLCWRVGSDSHIQRAPHPPNMHVWGEALVLDSFTLQGSYNQPLGLSSTQSDTLFLDCTIRGLQVEASDTCAQCLSRILSLMGPQSGKSAVSRHSSFGESVSLLWKVDLKVEDMNLFTLSALVGASEVRLDTLTILGSAETSTVGIQGLVLALVKSVTEKMQPCCKAPDIPTPVLSLSMLSITYHSSIRSLEVQCGAGLTLLWSPPDHMYLYQHVLATLQCRDLLRATVFPETVPSLALETSGTTSELEGRAPEPLPPKRLLNLTLEVSTAKLTAFVAEDKFITLAAESVSLSRHGGSLQAYCPELAAGFDGNSIFNFKEVEVQLLPELEEMILHRNPFPALQTLRNRVWLLSFGSVSVEFPYQYDFSRTLDEAVGVQKWLKGLHQGTRAWASPSPVPLPPDLLLKVEHFSWVFLDDVFEVKLHDNYELMKDESKESAKRLQLLDAKVAALRKQHGELLPARKIEELYASLERKNIEIYIQRSRRLYGNTPMRRALLTWSLAGLELVALADASFHGPEHVVEQVQELDPGSPFPPEGLDLVIQWCRMLKCNVKSFLVRIRDYPRYLFEIRDWRLMGRLVGTEQSGQPCSRRRQILHLGLPWGNVAVERNMPPLKFYHDFHSEIFQYTVVWGPCWDPAWTLIGQCVDLLTKPSADPSPPLPWWDKSRLLFHGDWHMDIEQANLHQLATEDPYNTTENMHWEWSHLSFHWKPGQFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTAEEELSARDGDPTFHTHQLHLVDLRISWTTTNRDIAFGLYDGYKKAAVLKRNLSTEALKGLKIDPQMPAKKPKRGVPTSASAPPRVNTPSFSGQPDKGSSGGAYMLQKLIEETDRFVVFTEEESGMSDQLCGIAACQTDDIYNRNCLIELVNCQMVLRGAETEGCVIVSAAKAQLLQCQHHPAWYGDTLKQKTSWTCLLDGMQYFATTESSPTEQDGRQLWLEVKNIEEHRQRSLDSVQELMESGQAVGGMVTTTTDWNQPAEAQQAQQVQRIISRCNCRMYYISYSHDIDPELATQIKPPEVLENQEKEDLLKKQEGAVDTFTLIHHELEISTNPAQYAMILDIVNNLLLHVEPKRKEHSEKKQRVRFQLEISSNPEEQRSSILHLQEAVRQHVAQIRQLEKQMYSIMKSLQDDSKNENLLDLNQKLQLQLNQEKANLQLESEELNILIRCFKDFQLQRANKMELRKQQEDVSVVRRTEFYFAQARWRLTEEDGQLGIAELELQRFLYSKVNKSDDTAEHLLELGWFTMNNLLPNAVYKVVLRPQSSCQSGRQLALRLFSKVRPPVGGISVKEHFEVNVVPLTIQLTHQFFHRMMGFFFPGRSVEDDEVGDEEDKSKLVTTGIPVVKPRQLIATDDAVPLGPGKGVAQGLTRSSGVRRSFRKSPEHPVDDIDKMKERAAMNNSFIYIKIPQVPLCVSYKGEKNSVDWGDLNLVLPCLEYHNNTWTWLDFAMAVKRDSRKALVAQVIKEKLRLKSATGSEVRGKLETKSDLNMQQQEEEEKARLLIGLSVGDKNPGKKSIFGRRK

SEQ ID NO: 43296 - protein, 86 aa, Homo sapiens
  Payload ID: 8904
  Gene Symbol: KIAA0100
  Gene Name: KIAA0100
  ENSP ID: ENSP00000463618
MPLFFSALLVLLLVALSALFLGRWLVVRLATKWCQRKLQAELKIGSFRFFWIQNVSLKFQQHQQTVTLCGIVLWRSAYQNGPTESF

SEQ ID NO: 43297 - protein, 21 aa, Homo sapiens
  Payload ID: 8904
  Gene Symbol: KIAA0100
  Gene Name: KIAA0100
  ENSP ID: ENSP00000466636
  MOD_RES (1)..(1): Any amino acid
XQGPSLASKPVPCSAARPGQG

SEQ ID NO: 43298 - protein, 2092 aa, Homo sapiens
  Payload ID: 8904
  Gene Symbol: KIAA0100
  Gene Name: KIAA0100
  ENSP ID: ENSP00000467716
MVLKVDTSESLWHIQISRSRFLLDSDGKRLICEVSLCKINSKVLKSGQLEDTCLVELSLALDLCLKVGISSRHLTAITVDVWTLHAELHEGLFQSQLLCQGPSLASKPVPCSEVTENLVEPTLPGLFLLQQLPDQVKVKMENTSVVLSMNSQKRHLTWTLKLLQFLYHRDEDQLPLRSFTANSDMAQMSTELLLEDGLLLSQSRQRIVCLNSLKASVQVTTIDLSASLVLNTCIIHYRHQEFSHWLHLLALETQGSSSPVLKQRKKRTFPQILAPIIFSTSISNVNISIQLGDTPPFALGFNSISLDYQHLRPQSIHQRGVLTVDHLCWRVGSDSHIQRAPHPPNMHVWGEALVLDSFTLQGSYNQPLGLSSTQSDTLFLDCTIRGLQVEASDTCAQCLSRILSLMGPQSGKSAVSRHSSFGESVSLLWKVDLKVEDMNLFTLSALVGASEVRLDTLTILGSAETSTVGIQGLVLALVKSVTEKMQPCCKAPDIPTPVLSLSMLSITYHSSIRSLEVQCGAGLTLLWSPPDHMYLYQHVLATLQCRDLLRATVFPETVPSLALETSGTTSELEGRAPEPLPPKRLLNLTLEVSTAKLTAFVAEDKFITLAAESVSLSRHGGSLQAYCPELAAGFDGNSIFNFKEVEVQLLPELEEMILHRNPFPALQTLRNRVWLLSFGSVSVEFPYQYDFSRTLDEAVGVQKWLKGLHQGTRAWASPSPVPLPPDLLLKVEHFSWVFLDDVFEVKLHDNYELMKDESKESAKRLQLLDAKVAALRKQHGELLPARKIEELYASLERKNIEIYIQRSRRLYGNTPMRRALLTWSLAGLELVALADASFHGPEHVVEQVQELDPGSPFPPEGLDLVIQWCRMLKCNVKSFLVRIRDYPRYLFEIRDWRLMGRLVGTEQSGQPCSRRRQILHLGLPWGNVAVERNMPPLKFYHDFHSEIFQYTVVWGPCWDPAWTLIGQCVDLLTKPSADPSPPLPWWDKSRLLFHGDWHMDIEQANLHQLATEDPYNTTENMHWEWSHLSFHWKPGQFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTAEEELSARDGDPTFHTHQLHLVDLRISWTTTNRDIAFGLYDGYKKAAVLKRNLSTEALKGLKIDPQMPAKKPKRGVPTSASAPPRVNTPSFSGQPDKGSSGGAYMLQKLIEETDRFVVFTEEESGMSDQLCGIAACQTDDIYNRNCLIELVNCQMVLRGAETEGCVIVSAAKAQLLQCQHHPAWYGDTLKQKTSWTCLLDGMQYFATTESSPTEQDGRQLWLEVKNIEEHRQRSLDSVQELMESGQAVGGMVTTTTDWNQPAEAQQAQQVQRIISRCNCRMYYISYSHDIDPELATQIKPPEVLENQEKEDLLKKQEGAVDTFTLIHHELEISTNPAQYAMILDIVNNLLLHVEPKRKEHSEKKQRVRFQLEISSNPEEQRSSILHLQEAVRQHVAQIRQLEKQMYSIMKSLQDDSKNENLLDLNQKLQLQLNQEKANLQLESEELNILIRCFKDFQLQRANKMELRKQQEDVSVVRRTEFYFAQARWRLTEEDGQLGIAELELQRFLYSKVNKSDDTAEHLLELGWFTMNNLLPNAVYKAILRPQSSCQSGRQLALRLFSKVRPPVGGISVKEHFEVNVVPLTIQLTHQFFHRMMGFFFPGRSVEDDEVGDEEDKSKLVTTGIPVVKPRQLIATDDAVPLGPGKGVAQGLTRSSGVRRSFRKSPEHPVDDIDKMKERAAMNNSFIYIKIPQVPLCVSYKGEKNSVDWGDLNLVLPCLEYHNNTWTWLDFAMAVKRDSRKALVAQVIKEKLRLKSATGSEVRGKLETKSDLNMQQQEEEEKARLLIGLSVGDKNPGKKSIFGRRK

SEQ ID NO: 43299 - protein, 287 aa, Homo sapiens
  Payload ID: 8904
  Gene Symbol: KIAA0100
  Gene Name: KIAA0100
  ENSP ID: ENSP00000467944
DPSPPLPWWDKSRLLFHGDWHMDIEQANLHQLATEFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTA

SEQ ID NO: 43300 - protein, 111 aa, Homo sapiens; identical to SEQ ID NO: 20432
  Payload ID: 8905
  Gene Symbol: KIAA0101
  Gene Name: KIAA0101
  Uniprot ID: Q15004
  ENSP ID: ENSP00000300035

SEQ ID NO: 43301 - protein, 65 aa, Homo sapiens; identical to SEQ ID NO: 20431
  Payload ID: 8905
  Gene Symbol: KIAA0101
  Gene Name: KIAA0101
  Uniprot ID: Q15004
  ENSP ID: ENSP00000369608

SEQ ID NO: 43302 - protein, 84 aa, Homo sapiens
  Payload ID: 8905
  Gene Symbol: KIAA0101
  Gene Name: KIAA0101
  ENSP ID: ENSP00000452975
MVRTKADSVPGTYRKAENKYAGGNPVCVRPTPKWQKGIGEFFRLSPKDSEKENQIPEEAGSSGLGKAKRKACPLQPDHTNDEKE

SEQ ID NO: 43303 - protein, 115 aa, Homo sapiens
  Payload ID: 8905
  Gene Symbol: KIAA0101
  Gene Name: KIAA0101
  ENSP ID: ENSP00000453527
MVRTKADSVPGTYRKVVAARAPRKVLGSSTSATNSTSVSSRKAENKYAGGNPVCVRPTPKWQKGIGEFFRLSPKDSEKENQIPEEAGSSGLGKAKRNQEPPILQHTEQQAGHTAH

SEQ ID NO: 43304 - protein, 115 aa, Homo sapiens; identical to SEQ ID NO: 43303
  Payload ID: 8905
  Gene Symbol: KIAA0101
  Gene Name: KIAA0101
  ENSP ID: ENSP00000485699

SEQ ID NO: 43305 - protein, 515 aa, Homo sapiens
  Payload ID: 8906
  Gene Symbol: KIAA0141
  Gene Name: KIAA0141
  Uniprot ID: Q14154
  ENSP ID: ENSP00000194118
MWRLPGLLGRALPRTLGPSLWRVTPKSTSPDGPQTTSSTLLVPVPNLDRSGPHGPGTSGGPRSHGWKDAFQWMSSRVSPNTLWDAISWGTLAVLALQLARQIHFQASLPAGPQRVEHCSWHSPLDRFFSSPLWHPCSSLRQHILPSPDGPAPRHTGLREPRLGQEEASAQPRNFSHNSLRGARPQDPSEEGPGDFGFLHASSSIESEAKPAQPQPTGEKEQDKSKTLSLEEAVTSIQQLFQLSVSIAFNFLGTENMKSGDHTAAFSYFQKAAARGYSKAQYNAGLCHEHGRGTPRDISKAVLYYQLAASQGHSLAQYRYARCLLRDPASSWNPERQRAVSLLKQAADSGLREAQAFLGVLFTKEPYLDEQRAVKYLWLAANNGDSQSRYHLGICYEKGLGVQRNLGEALRCYQQSAALGNEAAQERLRALFSMGAAAPGPSDLTVTGLKSFSSPSLCSLNTLLAGTSRLPHASSTGNLGLLCRSGHLGASLEASSRAIPPHPYPLERSVVRLGFG

SEQ ID NO: 43306 - protein, 515 aa, Homo sapiens; identical to SEQ ID NO: 43305
  Payload ID: 8906
  Gene Symbol: KIAA0141
  Gene Name: KIAA0141
  Uniprot ID: Q14154
  ENSP ID: ENSP00000396225

SEQ ID NO: 43307 - protein, 322 aa, Homo sapiens
  Payload ID: 8906
  Gene Symbol: KIAA0141
  Gene Name: KIAA0141
  ENSP ID: ENSP00000422686
MWRLPGLLGRALPRTLGPSLWRVTPKSTSPDGPQTTSSTLLVPVPNLDRSGPHGPGTSGGPRSHGWKDAFQWMSSRVSPNTLWDAISWGTLAVLALQLARQIHFQASLPAGPQRVEHCSWHSPLDRFFSSPLWHPCSSLRQHILPSPDGPAPRHTGLREPRLGQEEASAQPRNFSHNSLRGARPQDPSEEGPGDFGFLHASSSIESEAKPAQPQPTGEKEQDKSKTLSLEEAVTSIQQLFQLSVSIAFNFLGTENMKSGDHTAAFSYFQKAAARGYSKAQYNAGLCHEHGRGTPRDISKLAASQGHSLAQYRYARCLLRDPA

SEQ ID NO: 43308 - protein, 216 aa, Homo sapiens
  Payload ID: 8906
  Gene Symbol: KIAA0141
  Gene Name: KIAA0141
  ENSP ID: ENSP00000426138
AVLYYQLAASQGHSLAQYRYARCLLRDPASSWNPERQRAVSLLKQAADSGLREAQAFLGVLFTKEPYLDEQRAVKYLWLAANNGDSQSRYHLGICYEKGLGVQRNLGEALRCYQQSAALGNEAAQERLRALFSMGAAAPGPSDLTVTGLKSFSSPSLCSLNTLLAGTSRLPHASSTGNLGLLCRSGHLGASLEASSRAIPPHPYPLERSVVRLGFG

SEQ ID NO: 43309 - protein, 1159 aa, Homo sapiens
  Payload ID: 8907
  Gene Symbol: KIAA0196
  Gene Name: KIAA0196
  Uniprot ID: Q12768
  ENSP ID: ENSP00000318016
MLDFLAENNLCGQAILRIVSCGNAIIAELLRLSEFIPAVFRLKDRADQQKYGDIIFDFSYFKGPELWESKLDAKPELQDLDEEFRENNIEIVTRFYLAFQSVHKYIVDLNRYLDDLNEGVYIQQTLETVLLNEDGKQLLCEALYLYGVMLLVIDQKIEGEVRERMLVSYYRYSAARSSADSNMDDICKLLRSTGYSSQPGAKRPSNYPESYFQRVPINESFISMVIGRLRSDDIYNQVSAYPLPEHRSTALANQAAMLYVILYFEPSILHTHQAKMREIVDKYFPDNWVISIYMGITVNLVDAWEPYKAAKTALNNTLDLSNVREQASRYATVSERVHAQVQQFLKEGYLREEMVLDNIPKLLNCLRDCNVAIRWLMLHTADSACDPNNKRLRQIKDQILTDSRYNPRILFQLLLDTAQFEFILKEMFKQMLSEKQTKWEHYKKEGSERMTELADVFSGVKPLTRVEKNENLQAWFREISKQILSLNYDDSTAAGRKTVQLIQALEEVQEFHQLESNLQVCQFLADTRKFLHQMIRTINIKEEVLITMQIVGDLSFAWQLIDSFTSIMQESIRVNPSMVTKLRATFLKLASALDLPLLRINQANSPDLLSVSQYYSGELVSYVRKVLQIIPESMFTSLLKIIKLQTHDIIEVPTRLDKDKLRDYAQLGPRYEVAKLTHAISIFTEGILMMKTTLVGIIKVDPKQLLEDGIRKELVKRVAFALHRGLIFNPRAKPSELMPKLKELGATMDGFHRSFEYIQDYVNIYGLKIWQEEVSRIINYNVEQECNNFLRTKIQDWQSMYQSTHIPIPKFTPVDESVTFIGRLCREILRITDPKMTCHIDQLNTWYDMKTHQEVTSSRLFSEIQTTLGTFGLNGLDRLLCFMIVKELQNFLSMFQKIILRDRTVQDTLKTLMNAVSPLKSIVANSNKIYFSAIAKTQKIWTAYLEAIMKVGQMQILRQQIANELNYSCRFDSKHLAAALENLNKALLADIEAHYQDPSLPYPKEDNTLLYEITAYLEAAGIHNPLNKIYITTKRLPYFPIVNFLFLIAQLPKLQYNKNLGMVCRKPTDPVDWPPLVLGLLTLLKQFHSRYTEQFLALIGQFICSTVEQCTSQKIPEIPADVVGALLFLEDYVRYTKLPRRVAEAHVPNFIFDEFRTVL

SEQ ID NO: 43310 - protein, 163 aa, Homo sapiens
  Payload ID: 8907
  Gene Symbol: KIAA0196
  Gene Name: KIAA0196
  ENSP ID: ENSP00000427946
MLLVIDQKIEGEVRERMLVSYYRYSAARSSADSNMDDICKLLRSTGYSSQPGAKRPSNYPESYFQRVPINESFISMVIGRLRSDDIYNQVSAYPLPEHRSTALANQAAMLYVILYFEPSILHTHQAKMREIVDKYFPDNWVISIYMGITVNLVDAWEPYKAAK

SEQ ID NO: 43311 - protein, 1011 aa, Homo sapiens
  Payload ID: 8907
  Gene Symbol: KIAA0196
  Gene Name: KIAA0196
  ENSP ID: ENSP00000429676
MLLVIDQKIEGEVRERMLVSYYRYSAARSSADSNMDDICKLLRSTGYSSQPGAKRPSNYPESYFQRVPINESFISMVIGRLRSDDIYNQVSAYPLPEHRSTALANQAAMLYVILYFEPSILHTHQAKMREIVDKYFPDNWVISIYMGITVNLVDAWEPYKAAKTALNNTLDLSNVREQASRYATVSERVHAQVQQFLKEGYLREEMVLDNIPKLLNCLRDCNVAIRWLMLHTADSACDPNNKRLRQIKDQILTDSRYNPRILFQLLLDTAQFEFILKEMFKQMLSEKQTKWEHYKKEGSERMTELADVFSGVKPLTRVEKNENLQAWFREISKQILSLNYDDSTAAGRKTVQLIQALEEVQEFHQLESNLQVCQFLADTRKFLHQMIRTINIKEEVLITMQIVGDLSFAWQLIDSFTSIMQESIRVNPSMVTKLRATFLKLASALDLPLLRINQANSPDLLSVSQYYSGELVSYVRKVLQIIPESMFTSLLKIIKLQTHDIIEVPTRLDKDKLRDYAQLGPRYEVAKLTHAISIFTEGILMMKTTLVGIIKVDPKQLLEDGIRKELVKRVAFALHRGLIFNPRAKPSELMPKLKELGATMDGFHRSFEYIQDYVNIYGLKIWQEEVSRIINYNVEQECNNFLRTKIQDWQSMYQSTHIPIPKFTPVDESVTFIGRLCREILRITDPKMTCHIDQLNTWYDMKTHQEVTSSRLFSEIQTTLGTFGLNGLDRLLCFMIVKELQNFLSMFQKIILRDRTVQDTLKTLMNAVSPLKSIVANSNKIYFSAIAKTQKIWTAYLEAIMKVGQMQILRQQIANELNYSCRFDSKHLAAALENLNKALLADIEAHYQDPSLPYPKEDNTLLYEITAYLEAAGIHNPLNKIYITTKRLPYFPIVNFLFLIAQLPKLQYNKNLGMVCRKPTDPVDWPPLVLGLLTLLKQFHSRYTEQFLALIGQFICSTVEQCTSQKIPEIPADVVGALLFLEDYVRYTKLPRRVAEAHVPNFIFDEFRTVL

SEQ ID NO: 43312 - protein, 505 aa, Homo sapiens
  Payload ID: 8908
  Gene Symbol: KIAA0226L
  Gene Name: KIAA0226-like
  ENSP ID: ENSP00000368057
MVSNHYFLLCVNLPLREIHTPGAVQVSRRTISSNSFSPEVFVLPVDVEKENAHFYVADMIISAMEKMKCNILSQQQTESWSKEVSGLLGSDQPDSEMTFDTNIKQESGSSTSSYSGYEGCAVLQVSPVTETRTYHDVKEICKCDVDEFVILELGDFNDITETCSCSCSSSKSVTYEPDFNSAELLAKELYRVFQKCWILSVVNSQLAGSLSAAGSIVVNEECVRKDFESSMNVVQEIKFKSRIRGTEDWAPPRFQIIFNIHPPLKRDLVVAAQNFFCAGCGTPVEPKFVKRLRYCEYLGKYFCDCCHSYAESCIPARILMMWDFKKYYVSNFSKQLLDSIWHQPIFNLLSIGQSLYAKAKELDRVKEIQEQLFHIKKLLKTCRFANSALKEFEQVPGHLTDELHLFSLEDLVRIKKGLLAPLLKDILKASLAHVAGCELCQGKGFICEFCQNTTVIFPFQTATCRRCSACRACFHKQCFQSSECPRCARITARRKLLESVASAAT

SEQ ID NO: 43313 - protein, 595 aa, Homo sapiens
  Payload ID: 8908
  Gene Symbol: KIAA0226L
  Gene Name: KIAA0226-like
  Uniprot ID: Q9H714
  ENSP ID: ENSP00000368061
MVSNHYFLLCVNLPLREIHTPGPSPSCLGDSLAETTLSEDTTDSVGSASPHGSSEKSSSFSLSSTEVHMVRPGYSHRVSLPTSPGILATSPYPETDSAFFEPSHLTSAADEGAVQVSRRTISSNSFSPEVFVLPVDVEKENAHFYVADMIISAMEKMKCNILSQQQTESWSKEVSGLLGSDQPDSEMTFDTNIKQESGSSTSSYSGYEGCAVLQVSPVTETRTYHDVKEICKCDVDEFVILELGDFNDITETCSCSCSSSKSVTYEPDFNSAELLAKELYRVFQKCWILSVVNSQLAGSLSAAGSIVVNEECVRKDFESSMNVVQEIKFKSRIRGTEDWAPPRFQIIFNIHPPLKRDLVVAAQNFFCAGCGTPVEPKFVKRLRYCEYLGKYFCDCCHSYAESCIPARILMMWDFKKYYVSNFSKQLLDSIWHQPIFNLLSIGQSLYAKAKELDRVKEIQEQLFHIKKLLKTCRFANSALKEFEQVPGHLTDELHLFSLEDLVRIKKGLLAPLLKDILKASLAHVAGCELCQGKGFICEFCQNTTVIFPFQTATCRRCSACRACFHKQCFQSSECPRCARITARRKLLESVASAAT

SEQ ID NO: 43314 - protein, 635 aa, Homo sapiens
  Payload ID: 8908
  Gene Symbol: KIAA0226L
  Gene Name: KIAA0226-like
  Uniprot ID: Q9H714
  ENSP ID: ENSP00000368064
MVSQSTVRQDSPVEPWEGISDHSGIIDGSPRLLNTDHPPCQLDIRLMRHKAVWINPQDVQQQPQDLQSQVPAAGNSGTHFVTDAASPSGPSPSCLGDSLAETTLSEDTTDSVGSASPHGSSEKSSSFSLSSTEVHMVRPGYSHRVSLPTSPGILATSPYPETDSAFFEPSHLTSAADEGAVQVSRRTISSNSFSPEVFVLPVDVEKENAHFYVADMIISAMEKMKCNILSQQQTESWSKEVSGLLGSDQPDSEMTFDTNIKQESGSSTSSYSGYEGCAVLQVSPVTETRTYHDVKEICKCDVDEFVILELGDFNDITETCSCSCSSSKSVTYEPDFNSAELLAKELYRVFQKCWILSVVNSQLAGSLSAAGSIVVNEECVRKDFESSMNVVQEIKFKSRIRGTEDWAPPRFQIIFNIHPPLKRDLVVAAQNFFCAGCGTPVEPKFVKRLRYCEYLGKYFCDCCHSYAESCIPARILMMWDFKKYYVSNFSKQLLDSIWHQPIFNLLSIGQSLYAKAKELDRVKEIQEQLFHIKKLLKTCRFANSCVKERALFVNFARIRLSSSHFRQQHVEDVQRAGLAFTNSASSPPSAPGVRGSQRGENFWKVWPLQQHDAPEYCEKDCSTCLMITPICVYYW

SEQ ID NO: 43315 - protein, 447 aa, Homo sapiens
  Payload ID: 8908
  Gene Symbol: KIAA0226L
  Gene Name: KIAA0226-like
  ENSP ID: ENSP00000368074
MIISAMEKMKCNILSQQQTESWSKEVSGLLGSDQPDSEMTFDTNIKQESGSSTSSYSGYEGCAVLQVSPVTETRTYHDVKEICKCDVDEFVILELGDFNDITETCSCSCSSSKSVTYEPDFNSAELLAKELYRVFQKCWILSVVNSQLAGSLSAAGSIVVNEECVRKDFESSMNVVQEIKFKSRIRGTEDWAPPRFQIIFNIHPPLKRDLVVAAQNFFCAGCGTPVEPKFVKRLRYCEYLGKYFCDCCHSYAESCIPARILMMWDFKKYYVSNFSKQLLDSIWHQPIFNLLSIGQSLYAKAKELDRVKEIQEQLFHIKKLLKTCRFANSALKEFEQVPGHLTDELHLFSLEDLVRIKKGLLAPLLKDILKASLAHVAGCELCQGKGFICEFCQNTTVIFPFQTATCRRCSACRACFHKQCFQSSECPRCARITARRKLLESVASAAT

SEQ ID NO: 43316 - protein, 662 aa, Homo sapiens
  Payload ID: 8908
  Gene Symbol: KIAA0226L
  Gene Name: KIAA0226-like
  Uniprot ID: Q9H714
  ENSP ID: ENSP00000374558
MVSQSTVRQDSPVEPWEGISDHSGIIDGSPRLLNTDHPPCQLDIRLMRHKAVWINPQDVQQQPQDLQSQVPAAGNSGTHFVTDAASPSGPSPSCLGDSLAETTLSEDTTDSVGSASPHGSSEKSSSFSLSSTEVHMVRPGYSHRVSLPTSPGILATSPYPETDSAFFEPSHLTSAADEGAVQVSRRTISSNSFSPEVFVLPVDVEKENAHFYVADMIISAMEKMKCNILSQQQTESWSKEVSGLLGSDQPDSEMTFDTNIKQESGSSTSSYSGYEGCAVLQVSPVTETRTYHDVKEICKCDVDEFVILELGDFNDITETCSCSCSSSKSVTYEPDFNSAELLAKELYRVFQKCWILSVVNSQLAGSLSAAGSIVVNEECVRKDFESSMNVVQEIKFKSRIRGTEDWAPPRFQIIFNIHPPLKRDLVVAAQNFFCAGCGTPVEPKFVKRLRYCEYLGKYFCDCCHSYAESCIPARILMMWDFKKYYVSNFSKQLLDSIWHQPIFNLLSIGQSLYAKAKELDRVKEIQEQLFHIKKLLKTCRFANSALKEFEQVPGHLTDELHLFSLEDLVRIKKGLLAPLLKDILKASLAHVAGCELCQGKGFICEFCQNTTVIFPFQTATCRRCSACRACFHKQCFQSSECPRCARITARRKLLESVASAAT

SEQ ID NO: 43317 - protein, 505 aa, Homo sapiens; identical to SEQ ID NO: 43312
  Payload ID: 8908
  Gene Symbol: KIAA0226L
  Gene Name: KIAA0226-like
  ENSP ID: ENSP00000386578

SEQ ID NO: 43318 - protein, 662 aa, Homo sapiens; identical to SEQ ID NO: 43316
  Payload ID: 8908
  Gene Symbol: KIAA0226L
  Gene Name: KIAA0226-like
  Uniprot ID: Q9H714
  ENSP ID: ENSP00000396935

SEQ ID NO: 43319 - protein, 129 aa, Homo sapiens
  Payload ID: 8908
  Gene Symbol: KIAA0226L
  Gene Name: KIAA0226-like
  ENSP ID: ENSP00000402357
MVRPGYSHRVSLPTSPGILATSPYPETDSAFFEPSHLTSAADEGAVQVSRRTISSNSFSPEVFVLPVDVEKENAHFYVADMIISAMEKMKCNILSQQQTESWSKEVSGLLGSDQPDSEMTFDTNIKQES

SEQ ID NO: 43320 - protein, 287 aa, Homo sapiens
  Payload ID: 8908
  Gene Symbol: KIAA0226L
  Gene Name: KIAA0226-like
  ENSP ID: ENSP00000412507
MVSQSTVRQDSPVEPWEGISDHSGIIDGSPRLLNTDHPPCQLDIRLMRHKAVWINPQDVQQQPQDLQSQVPAAGNSGTHFVTDAASPSGPSPSCLGDSLAETTLSEDTTDSVGSASPHGSSEKSSSFSLSSTEVHMVRPGYSHRVSLPTSPGILATSPYPETDSAFFEPSHLTSAADEGAVQVSRRTISSNSFSPEVFVLPVDVEKENAHFYVADMIISAMEKMKCNILSQQQTESWSKEVSGLLGSDQPDSEMTFDTNIKQESGSSTSSYSGYEGKLCCVTGQPSD

SEQ ID NO: 43321 - protein, 178 aa, Homo sapiens
  Payload ID: 8908
  Gene Symbol: KIAA0226L
  Gene Name: KIAA0226-like
  ENSP ID: ENSP00000414579
MVSQSTVRQDSPVEPWEGISDHSGIIDGSPRLLNTDHPPCQLDIRLMRHKAVWINPQDVQQQPQDLQSQVPAAGNSGTHFVTDAASPSGPSPSCLGDSLAETTLSEDTTDSVGSASPHGSSEKSSSFSLSSTEVHMVRPGYSHRVSLPTSPGILATSPYPETDSAFFEPSHLTSAADE

SEQ ID NO: 43322 - protein, 527 aa, Homo sapiens
  Payload ID: 8908
  Gene Symbol: KIAA0226L
  Gene Name: KIAA0226-like
  Uniprot ID: Q9H714
  ENSP ID: ENSP00000485932
MVRPGYSHRVSLPTSPGILATSPYPETDSAFFEPSHLTSAADEGAVQVSRRTISSNSFSPEVFVLPVDVEKENAHFYVADMIISAMEKMKCNILSQQQTESWSKEVSGLLGSDQPDSEMTFDTNIKQESGSSTSSYSGYEGCAVLQVSPVTETRTYHDVKEICKCDVDEFVILELGDFNDITETCSCSCSSSKSVTYEPDFNSAELLAKELYRVFQKCWILSVVNSQLAGSLSAAGSIVVNEECVRKDFESSMNVVQEIKFKSRIRGTEDWAPPRFQIIFNIHPPLKRDLVVAAQNFFCAGCGTPVEPKFVKRLRYCEYLGKYFCDCCHSYAESCIPARILMMWDFKKYYVSNFSKQLLDSIWHQPIFNLLSIGQSLYAKAKELDRVKEIQEQLFHIKKLLKTCRFANSALKEFEQVPGHLTDELHLFSLEDLVRIKKGLLAPLLKDILKASLAHVAGCELCQGKGFICEFCQNTTVIFPFQTATCRRCSACRACFHKQCFQSSECPRCARITARRKLLESVASAAT

SEQ ID NO: 43323 - protein, 1395 aa, Homo sapiens
  Payload ID: 8909
  Gene Symbol: KIAA0232
  Gene Name: KIAA0232
  Uniprot ID: Q92628
  ENSP ID: ENSP00000303928
MYPICTVVVDGLPSESSSSSYPGPVSVSEMSLLHALGPVQTWLGQELEKCGIDAMIYTRYVLSLLLHDSYDYDLQEQENDIFLGWEKGAYKKWGKSKKKCSDLTLEEMKKQAAVQCLRSASDESSGIETLVEELCSRLKDLQSKQEEKIHKKLEGSPSPEAELSPPAKDQVEMYYEAFPPLSEKPVCLQEIMTVWNKSKVCSYSSSSSSSTAPPASTDTSSPKDCNSESEVTKERSSEVPTTVHEKTQSKSKNEKENKFSNGTIEEKPALYKKQIRHKPEGKIRPRSWSSGSSEAGSSSSGNQGELKASMKYVKVRHKAREIRNKKGRNGQSRLSLKHGEKAERNIHTGSSSSSSSGSVKQLCKRGKRPLKEIGRKDPGSTEGKDLYMENRKDTEYKEEPLWYTEPIAEYFVPLSRKSKLETTYRNRQDTSDLTSEAVEELSESVHGLCISNNNLHKTYLAAGTFIDGHFVEMPAVINEDIDLTGTSLCSLPEDNKYLDDIHLSELTHFYEVDIDQSMLDPGASETMQGESRILNMIRQKSKENTDFEAECCIVLDGMELQGERAIWTDSTSSVGAEGLFLQDLGNLAQFWECCSSSSGDADGESFGGDSPVRLSPILDSTVLNSHLLAGNQELFSDINEGSGINSCFSVFEVQCSNSVLPFSFETLNLGNENTDSSANMLGKTQSRLLIWTKNSAFEENEHCSNLSTRTCSPWSHSEETRSDNETLNIQFEESTQFNAEDINYVVPRVSSNYVDEELLDFLQDETCQQNSRTLGEIPTLVFKKTSKLESVCGIQLEQKTENKNFETTQVCNESPHGDGYSSGVIKDIWTKMADTNSVATVEIERTDAELFSADVNNYCCCLDAEAELETLQEPDKAVRRSEYHLWEGQKESLEKRAFASSELSNVDGGDYTTPSKPWDVAQDKENTFILGGVYGELKTFNSDGEWAVVPPSHTKGSLLQCAASDVVTIAGTDVFMTPGNSFAPGHRQLWKPFVSFEQNDQPKSGENGLNKGFSFIFHEDLLGACGNFQVEDPGLEYSFSSFDLSNPFSQVLHVECSFEPEGIASFSPSFKPKSILCSDSDSEVFHPRICGVDRTQYRAIRISPRTHFRPISASELSPGGGSESEFESEKDEANIPIPSQVDIFEDPQADLKPLEEDAEKEGHYYGKSELESGKFLPRLKKSGMEKSAQTSLDSQEESTGILSVGKQNQCLECSMNESLEIDLESSEANCKIMAQCEEEINNFCGCKAGCQFPAYEDNPVSSGQLEEFPVLNTDIQGMNRSQEKQTWWEKALYSPLFPASECEECYTNAKGESGLEEYPDAKETPSNEERLLDFNRVSSVYEARCTGERDSGAKSDGFRGKMCSSASSTSEETGSEGGGEWVGPSEEELFSRTHL

SEQ ID NO: 43324 - protein, 1395 aa, Homo sapiens; identical to SEQ ID NO: 43323
  Payload ID: 8909
  Gene Symbol: KIAA0232
  Gene Name: KIAA0232
  Uniprot ID: Q92628
  ENSP ID: ENSP00000413739

SEQ ID NO: 43325 - protein, 75 aa, Homo sapiens
  Payload ID: 8909
  Gene Symbol: KIAA0232
  Gene Name: KIAA0232
  ENSP ID: ENSP00000426815
MYPICTVVVDGLPSESSSSSYPGPVSVSEMSLLHALGPVQTWLGQELEKCGIDAMIYTRYVLSLLLHDSYDYDLQ

SEQ ID NO: 43326 - protein, 1072 aa, Homo sapiens
  Payload ID: 8910
  Gene Symbol: KIAA0319
  Gene Name: KIAA0319
  Uniprot ID: Q5VV43
  ENSP ID: ENSP00000367459
MAPPTGVLSSLLLLVTIAGCARKQCSEGRTYSNAVISPNLETTRIMRVSHTFPVVDCTAACCDLSSCDLAWWFEGRCYLVSCPHKENCEPKKMGPIRSYLTFVLRPVQRPAQLLDYGDMMLNRGSPSGIWGDSPEDIRKDLTFLGKDWGLEEMSEYSDDYRELEKDLLQPSGKQEPRGSAEYTDWGLLPGSEGAFNSSVGDSPAVPAETQQDPELHYLNESASTPAPKLPERSVLLPLPTTPSSGEVLEKEKASQLQEQSSNSSGKEVLMPSHSLPPASLELSSVTVEKSPVLTVTPGSTEHSIPTPPTSAAPSESTPSELPISPTTAPRTVKELTVSAGDNLIITLPDNEVELKAFVAPAPPVETTYNYEWNLISHPTDYQGEIKQGHKQTLNLSQLSVGLYVFKVTVSSENAFGEGFVNVTVKPARRVNLPPVAVVSPQLQELTLPLTSALIDGSQSTDDTEIVSYHWEEINGPFIEEKTSVDSPVLRLSNLDPGNYSFRLTVTDSDGATNSTTAALIVNNAVDYPPVANAGPNHTITLPQNSITLNGNQSSDDHQIVLYEWSLGPGSEGKHVVMQGVQTPYLHLSAMQEGDYTFQLKVTDSSRQQSTAVVTVIVQPENNRPPVAVAGPDKELIFPVESATLDGSSSSDDHGIVFYHWEHVRGPSAVEMENIDKAIATVTGLQVGTYHFRLTVKDQQGLSSTSTLTVAVKKENNSPPRARAGGRHVLVLPNNSITLDGSRSTDDQRIVSYLWIRDGQSPAAGDVIDGSDHSVALQLTNLVEGVYTFHLRVTDSQGASDTDTATVEVQPDPRKSGLVELTLQVGVGQLTEQRKDTLVRQLAVLLNVLDSDIKVQKIRAHSDLSTVIVFYVQSRPPFKVLKAAEVARNLHMRLSKEKADFLLFKVLRVDTAGCLLKCSGHGHCDPLTKRCICSHLWMENLIQRYIWDGESNCEWSIFYVTVLAFTLIVLTGGFTWLCICCCKRQKRTKIRKKTKYTILDNMDEQERMELRPKYGIKHRSTEHNSSLMVSESEFDSDQDTIFSREKMERGNPKVSMNGSIRNGASFSYCSKDR

SEQ ID NO: 43327 - protein, 1027 aa, Homo sapiens
  Payload ID: 8910
  Gene Symbol: KIAA0319
  Gene Name: KIAA0319
  Uniprot ID: Q5VV43
  ENSP ID: ENSP00000401086
MRVSHTFPVVDCTAACCDLSSCDLAWWFEGRCYLVSCPHKENCEPKKMGPIRSYLTFVLRPVQRPAQLLDYGDMMLNRGSPSGIWGDSPEDIRKDLTFLGKDWGLEEMSEYSDDYRELEKDLLQPSGKQEPRGSAEYTDWGLLPGSEGAFNSSVGDSPAVPAETQQDPELHYLNESASTPAPKLPERSVLLPLPTTPSSGEVLEKEKASQLQEQSSNSSGKEVLMPSHSLPPASLELSSVTVEKSPVLTVTPGSTEHSIPTPPTSAAPSESTPSELPISPTTAPRTVKELTVSAGDNLIITLPDNEVELKAFVAPAPPVETTYNYEWNLISHPTDYQGEIKQGHKQTLNLSQLSVGLYVFKVTVSSENAFGEGFVNVTVKPARRVNLPPVAVVSPQLQELTLPLTSALIDGSQSTDDTEIVSYHWEEINGPFIEEKTSVDSPVLRLSNLDPGNYSFRLTVTDSDGATNSTTAALIVNNAVDYPPVANAGPNHTITLPQNSITLNGNQSSDDHQIVLYEWSLGPGSEGKHVVMQGVQTPYLHLSAMQEGDYTFQLKVTDSSRQQSTAVVTVIVQPENNRPPVAVAGPDKELIFPVESATLDGSSSSDDHGIVFYHWEHVRGPSAVEMENIDKAIATVTGLQVGTYHFRLTVKDQQGLSSTSTLTVAVKKENNSPPRARAGGRHVLVLPNNSITLDGSRSTDDQRIVSYLWIRDGQSPAAGDVIDGSDHSVALQLTNLVEGVYTFHLRVTDSQGASDTDTATVEVQPDPRKSGLVELTLQVGVGQLTEQRKDTLVRQLAVLLNVLDSDIKVQKIRAHSDLSTVIVFYVQSRPPFKVLKAAEVARNLHMRLSKEKADFLLFKVLRVDTAGCLLKCSGHGHCDPLTKRCICSHLWMENLIQRYIWDGESNCEWSIFYVTVLAFTLIVLTGGFTWLCICCCKRQKRTKIRKKTKYTILDNMDEQERMELRPKYGIKHRSTEHNSSLMVSESEFDSDQDTIFSREKMERGNPKVSMNGSIRNGASFSYCSKDR

SEQ ID NO: 43328 - protein, 1072 aa, Homo sapiens; identical to SEQ ID NO: 43326
  Payload ID: 8910
  Gene Symbol: KIAA0319
  Gene Name: KIAA0319
  Uniprot ID: Q5VV43
  ENSP ID: ENSP00000437656

SEQ ID NO: 43329 - protein, 1011 aa, Homo sapiens
  Payload ID: 8910
  Gene Symbol: KIAA0319
  Gene Name: KIAA0319
  Uniprot ID: Q5VV43
  ENSP ID: ENSP00000439700
MAPPTGVLSSLLLLVTIAGCARKQCSEGRTYSNAVISPNLETTRIMRVSHTFPVVDCTAACCDLSSCDLAWWFEGRCYLVSCPHKENCEPKKMGPIRSYLTFVLRPVQRPAQLLDYGDMMLNRGSPSGIWGDSPEDIRKDLTFLGKDWGLEEMSEYSDDYRELEKDLLQPSGKQEPRGSAEYTDWGLLPGSEGAFNSSVGDSPAVPAETQQDPELHYLNESASTPAPKLPERSVLLPLPTTPSSGEVLEKEKASQLQEQSSNSSGKEVLMPSHSLPPASLELSSVTVEKSPVLTVTPGSTEHSIPTPPTSAAPSESTPSELPISPTTAPRTVKELTVSAGDNLIITLPDNEVELKAFVAPAPPVETTYNYEWNLISHPTDYQGEIKQGHKQTLNLSQLSVGLYVFKVTVSSENAFGEGFVNVTVKPARRVNLPPVAVVSPQLQELTLPLTSALIDGSQSTDDTEIVSYHWEEINGPFIEEKTSVDSPVLRLSNLDPGNYSFRLTVTDSDGATNSTTAALIVNNAVDYPPVANAGPNHTITLPQNSITLNGNQSSDDHQIVLYEWSLGPGSEGKHVVMQGVQTPYLHLSAMQEGDYTFQLKVTDSSRQQSTAVVTVIVQPENNRPPVAVAGPDKELIFPVESATLDGSSSSDDHGIVFYHWEHVRGPSAVEMENIDKAIATVTGLQVGTYHFRLTVKDQQGLSSTSTLTVAVKKENNSPPRARAGGRHVLVLPNNSITLDGSRSTDDQRIVSYLWIRDGQSPAAGDVIDGSDHSVALQLTNLVEGVYTFHLRVTDSQGASDTDTATVEVQPDPRKSGLVELTLQVGVGQLTEQRKDTLVRQLAVLLNVLDSDIKVQKIRAHSDLSTVIVFYVQSRPPFKVLKAAEVARNLHMRLSKEKADFLLFKVLRVDTAGCLLKCSGHGHCDPLTKRCICSHLWMENLIQRYIWDGESNCGIKHRSTEHNSSLMVSESEFDSDQDTIFSREKMERGNPKVSMNGSIRNGASFSYCSKDR

SEQ ID NO: 43330 - protein, 1063 aa, Homo sapiens
  Payload ID: 8910
  Gene Symbol: KIAA0319
  Gene Name: KIAA0319
  Uniprot ID: Q5VV43
  ENSP ID: ENSP00000442403
MTRLGWPSPCCARKQCSEGRTYSNAVISPNLETTRIMRVSHTFPVVDCTAACCDLSSCDLAWWFEGRCYLVSCPHKENCEPKKMGPIRSYLTFVLRPVQRPAQLLDYGDMMLNRGSPSGIWGDSPEDIRKDLTFLGKDWGLEEMSEYSDDYRELEKDLLQPSGKQEPRGSAEYTDWGLLPGSEGAFNSSVGDSPAVPAETQQDPELHYLNESASTPAPKLPERSVLLPLPTTPSSGEVLEKEKASQLQEQSSNSSGKEVLMPSHSLPPASLELSSVTVEKSPVLTVTPGSTEHSIPTPPTSAAPSESTPSELPISPTTAPRTVKELTVSAGDNLIITLPDNEVELKAFVAPAPPVETTYNYEWNLISHPTDYQGEIKQGHKQTLNLSQLSVGLYVFKVTVSSENAFGEGFVNVTVKPARRVNLPPVAVVSPQLQELTLPLTSALIDGSQSTDDTEIVSYHWEEINGPFIEEKTSVDSPVLRLSNLDPGNYSFRLTVTDSDGATNSTTAALIVNNAVDYPPVANAGPNHTITLPQNSITLNGNQSSDDHQIVLYEWSLGPGSEGKHVVMQGVQTPYLHLSAMQEGDYTFQLKVTDSSRQQSTAVVTVIVQPENNRPPVAVAGPDKELIFPVESATLDGSSSSDDHGIVFYHWEHVRGPSAVEMENIDKAIATVTGLQVGTYHFRLTVKDQQGLSSTSTLTVAVKKENNSPPRARAGGRHVLVLPNNSITLDGSRSTDDQRIVSYLWIRDGQSPAAGDVIDGSDHSVALQLTNLVEGVYTFHLRVTDSQGASDTDTATVEVQPDPRKSGLVELTLQVGVGQLTEQRKDTLVRQLAVLLNVLDSDIKVQKIRAHSDLSTVIVFYVQSRPPFKVLKAAEVARNLHMRLSKEKADFLLFKVLRVDTAGCLLKCSGHGHCDPLTKRCICSHLWMENLIQRYIWDGESNCEWSIFYVTVLAFTLIVLTGGFTWLCICCCKRQKRTKIRKKTKYTILDNMDEQERMELRPKYGIKHRSTEHNSSLMVSESEFDSDQDTIFSREKMERGNPKVSMNGSIRNGASFSYCSKDR

SEQ ID NO: 43331 - protein, 483 aa, Homo sapiens
  Payload ID: 8910
  Gene Symbol: KIAA0319
  Gene Name: KIAA0319
  ENSP ID: ENSP00000483665
MQEGDYTFQLKVTDSSRQQSTAVVTVIVQPENNRPPVAVAGPDKELIFPVESATLDGSSSSDDHGIVFYHWEHVRGPSAVEMENIDKAIATVTGLQVGTYHFRLTVKDQQGLSSTSTLTVAVKKENNSPPRARAGGRHVLVLPNNSITLDGSRSTDDQRIVSYLWIRDGQSPAAGDVIDGSDHSVALQLTNLVEGVYTFHLRVTDSQGASDTDTATVEVQPDPRKSGLVELTLQVGVGQLTEQRKDTLVRQLAVLLNVLDSDIKVQKIRAHSDLSTVIVFYVQSRPPFKVLKAAEVARNLHMRLSKEKADFLLFKVLRVDTAGCLLKCSGHGHCDPLTKRCICSHLWMENLIQRYIWDGESNCEWSIFYVTVLAFTLIVLTGGFTWLCICCCKRQKRTKIRKKTKYTILDNMDEQERMELRPKYGIKHRSTEHNSSLMVSESEFDSDQDTIFSREKMERGNPKVSMNGSIRNGASFSYCSKDR

SEQ ID NO: 43332 - protein, 1049 aa, Homo sapiens
  Payload ID: 8911
  Gene Symbol: KIAA0319L
  Gene Name: KIAA0319-like
  Uniprot ID: Q8IZA0
  ENSP ID: ENSP00000318406
MEKRLGVKPNPASWILSGYYWQTSAKWLRSLYLFYTCFCFSVLWLSTDASESRCQQGKTQFGVGLRSGGENHLWLLEGTPSLQSCWAACCQDSACHVFWWLEGMCIQADCSRPQSCRAFRTHSSNSMLVFLKKFQTADDLGFLPEDDVPHLLGLGWNWASWRQSPPRAALRPAVSSSDQQSLIRKLQKRGSPSDVVTPIVTQHSKVNDSNELGGLTTSGSAEVHKAITISSPLTTDLTAELSGGPKNVSVQPEISEGLATTPSTQQVKSSEKTQIAVPQPVAPSYSYATPTPQASFQSTSAPYPVIKELVVSAGESVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPPVANAGPNQVITLPQNSITLFGNQSTDDHGITSYEWSLSPSSKGKVVEMQGVRTPTLQLSAMQEGDYTYQLTVTDTIGQQATAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPRKNNLVEIILDINVSQLTERLKGMFIRQIGVLLGVLDSDIIVQKIQPYTEQSTKMVFFVQNEPPHQIFKGHEVAAMLKSELRKQKADFLIFRALEVNTVTCQLNCSDHGHCDSFTKRCICDPFWMENFIKVQLRDGDSNCEWSVLYVIIATFVIVVALGILSWTVICCCKRQKGKPKRKSKYKILDATDQESLELKPTSRAGIKQKGLLLSSSLMHSESELDSDDAIFTWPDREKGKLLHGQNGSVPNGQTPLKARSPREEIL

SEQ ID NO: 43333 - protein, 486 aa, Homo sapiens
  Payload ID: 8911
  Gene Symbol: KIAA0319L
  Gene Name: KIAA0319-like
  ENSP ID: ENSP00000362363
MQEGDYTYQLTVTDTIGQQATAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPRKNNLVEIILDINVSQLTERLKGMFIRQIGVLLGVLDSDIIVQKIQPYTEQSTKMVFFVQNEPPHQIFKGHEVAAMLKSELRKQKADFLIFRALEVNTVTCQLNCSDHGHCDSFTKRCICDPFWMENFIKVQLRDGDSNCEWSVLYVIIATFVIVVALGILSWTVICCCKRQKGKPKRKSKYKILDATDQESLELKPTSRAGIKQKGLLLSSSLMHSESELDSDDAIFTWPDREKGKLLHGQNGSVPNGQTPLKARSPREEIL

SEQ ID NO: 43334 - protein, 304 aa, Homo sapiens
  Payload ID: 8911
  Gene Symbol: KIAA0319L
  Gene Name: KIAA0319-like
  ENSP ID: ENSP00000393862
  MOD_RES (1)..(1): Any amino acid
XDDLGFLPEDDVPHLLGLGWNWASWRQSPPRAALRPAVSSSDQQSLIRKLQKRGSPSDVVTPIVTQHSKVNDSNELGGLTTSGSAEVHKAITISSPLTTDLTAELSGGPKNVSVQPEISEGLATTPSTQQVKSSEKTQIAVPQPVAPSYSYATPTPQASFQSTSAPYPGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYT

SEQ ID NO: 43335 - protein, 1026 aa, Homo sapiens
  Payload ID: 8911
  Gene Symbol: KIAA0319L
  Gene Name: KIAA0319-like
  ENSP ID: ENSP00000395883
MEKRLGVKPNPASWILSGYYWQTSAKWLRSLYLFYTCFCFSVLWLSTDASESRCQQGKTQFGVGLRSGGENHLWLLEGTPSLQSCWAACCQDSACHVFWWLEGMCIQADCSRPQSCRAFRTHSSNSMLVFLKKFQTADDLGFLPEDDVPHLLGLGWNWASWRQSPPRAALRPAVSSSDQQSLIRKLQKRGSPSDVVTPIVTQHSKVNDSNELGGLTTSGSAEVHKAITISSPLTTDLTAELSGGPKNVSVQPEISEGLATTPSTQQVKSSEKTQIAVPQPVAPSYSYATPTPQASFQSTSAPYPVIKELVVSAGESVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPPVANAGPNQVITLPQNSITLFGNQSTDDHGITSYEWSLSPSSKGKVVEMQGVRTPTLQLSAMQEGDYTYQLTVTDTIGQQATAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPRKNNLVEIILDINVSQLTERLKGMFIRQIGVLLGVLDSDIIVQKIQPYTEQSTKMVFFVQNEPPHQIFKGHEVAAMLKSELRKQKADFLIFRALEVNTVTCQLNCSDHGHCDSFTKRCICDPFWMENFIKVQLRDGDSNCEWSVLYVIIATFVIVVALGILSWTVICCCKRQKGKPKRKSKYKILDATDQESLELKPTSRAGIKQKGLLLSSSLMHSESELDSDDAIFTWPDREKGKLLH

SEQ ID NO: 43336 - protein, 685 aa, Homo sapiens
  Payload ID: 8911
  Gene Symbol: KIAA0319L
  Gene Name: KIAA0319-like
  ENSP ID: ENSP00000407576
MEKRLGVKPNPASWILSGYYWQTSAKWLRSLYLFYTCFCFSVLWLSTDASESRCQQGKTQFGVGLRSGGENHLWLLEGTPSLQSCWAACCQDSACHVFWWLEGMCIQADCSRPQSCRAFRTHSSNSMLVFLKKFQTADDLGFLPEDDVPHLLGLGWNWASWRQSPPRAALRPAVSSSDQQSLIRKLQKRGSPSDVVTPIVTQHSKVNDSNELGGLTTSGSAEVHKAITISSPLTTDLTAELSGGPKNVSVQPEISEGLATTPSTQQVKSSEKTQIAVPQPVAPSYSYATPTPQASFQSTSAPYPVIKELVVSAGESVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPPVANAGPNQVITLPQNSITLFGNQSTDDHGITSYEWSLSPSSKGKVVEMQGVRTPTLQLSAMQEGDYTYQLTVTDTIGQQATAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIV

SEQ ID NO: 43337 - protein, 77 aa, Homo sapiens
  Payload ID: 8911
  Gene Symbol: KIAA0319L
  Gene Name: KIAA0319-like
  ENSP ID: ENSP00000417411
MEKRLGVKPNPASWILSGYYWQTSAKWLRSLYLFYTCFCFSVLWLSTGPQGDYNFQSPNHRPDCRAVWWAKECISAT

SEQ ID NO: 43338 - protein, 273 aa, Homo sapiens
  Payload ID: 8911
  Gene Symbol: KIAA0319L
  Gene Name: KIAA0319-like
  ENSP ID: ENSP00000419396
MEKRLGVKPNPASWILSGYYWQTSAKWLRSLYLFYTCFCFSVLWLSTDASESRCQQGKTQFGVGLRSGGENHLWLLEGTPSLQSCWAACCQDSACHVFWWLEGMCIQADCSRPQSCRAFRTHSSNSMLVFLKKFQTADDLGFLPEDDVPHLLGLGWNWASWRQSPPRAALRPAVSSSDQQSLIRKLQKRGSPSDVVTPIVTQHSKVNDSNELGGLTTSGSAEVHKAITISSPLTTDLTAELSGGPKNVSVQPEISEGLATTPSTQQVKSSEKT

SEQ ID NO: 43339 - protein, 179 aa, Homo sapiens
  Payload ID: 8911
  Gene Symbol: KIAA0319L
  Gene Name: KIAA0319-like
  ENSP ID: ENSP00000420226
MEKRLGVKPNPASWILSGYYWQTSAKWLRSLYLFYTCFCFSVLWLSTDASESRCQQGKTQFGVGLRSGGENHLWLLEGTPSLQSCWAACCQDSACHVFWWLEGMCIQADCSRPQSCRAFRTHSSNSMLVFLKKFQTADDLGFLPEDDVPHLLGLGWNWASWRQSPPRAALRPAVSSSDQ

SEQ ID NO: 43340 - protein, 344 aa, Homo sapiens
  Payload ID: 8911
  Gene Symbol: KIAA0319L
  Gene Name: KIAA0319-like
  ENSP ID: ENSP00000420369
MEKRLGVKPNPASWILSGYYWQTSAKWLRSLYLFYTCFCFSVLWLSTDASESRCQQGKTQFGVGLRSGGENHLWLLEGTPSLQSCWAACCQDSACHVFWWLEGMCIQADCSRPQSCRAFRTHSSNSMLVFLKKFQTADDLGFLPEDDVPHLLGLGWNWASWRQSPPRAALRPAVSSSDQQSLIRKLQKRGSPSDVVTPIVTQHSKVNDSNELGGLTTSGSAEVHKAITISSPLTTDLTAELSGGPKNVSVQPEISEGLATTPSTQQVKSSEKTQIAVPQPVAPSYSYATPTPQASFQSTSAPYPVIKELVVSAGESVQITLPKNEVQLNAYVLQEPPKAHSRPV

SEQ ID NO: 43341 - protein, 344 aa, Homo sapiens; identical to SEQ ID NO: 43340
  Payload ID: 8911
  Gene Symbol: KIAA0319L
  Gene Name: KIAA0319-like
  ENSP ID: ENSP00000420742

SEQ ID NO: 43342 - protein, 1070 aa, Homo sapiens
  Payload ID: 8912
  Gene Symbol: KIAA0355
  Gene Name: KIAA0355
  Uniprot ID: O15063
  ENSP ID: ENSP00000299505
MYCCSAQDSKMDYKRRFLLGGSKQKVQQHQQYPMPELGRALSAPLASTATTAPLGSLTAAGSCHHAMPHTTPIADIQQGISKYLDALNVFCRASTFLTDLFSTVFRNSHYSKAATQLKDVQEHVMEAASRLTSAIKPEIAKMLMELSAGAANFTDQKEFSLQDIEVLGRCFLTVVQVHFQFLTHALQKVQPVAHSCFAEVIVPEKKNSGSGGGLSGMGHTPEVEEAVRSWRGAAEATSRLRERGCDGCLAGIEVQQLFCSQSAAIPEHQLKELNIKIDSALQAYKIALESLGHCEYAMKAGFHLNPKAIEASLQGCCSEAEAQQTGRRQTPPQPMQCELPTVPVQIGSHFLKGVSFNESAADNLKLKTHTMLQLMKEAGCYNGITSRDDFPVTEVLNQVCPSTWRGACKTAVQLLFGQAGLVVVDTAQIENKEAYAPQISLEGSRIVVQVPSTWCLKEDPATMSLLQRSLDPEKTLGLVDVLYTAVLDLNRWRAGREQALPCIQIQLQREICDFGNQADLPSGNGNKSSGGLQKTFSKLTSRFTKKASCTSSSSSTNYSIQNTPSKNIFIAGCSEEKAKMPGNIDTRLQSILNIGNFPRTTDPSQSAQNSSNTVANGFLMERRENFLHGDDGKDEKGMNLPTDQEMQEVIDFLSGFNMGQSHQGSPLVTRHNSAATAMVTEQKAGAMQPQQPSLPVPPPPRAPQAGAHTPLTPQPGLAPQQQSPKQQQPQVQYYQHLLQPIGPQQPPPQPRAPGKWVHGSSQQPAQAVGAGLSPLGQWPGISDLSSDLYSLGLVSSYMDNVMSEVLGQKPQGPRNNTWPNRDQSDGVFGMLGEILPFDPAVGSDPEFARYVAGVSQAMQQKRQAQHGRRPGNPRGNWPPMDDAHRTWPFPEFFTEGDGLHGGWSGAQGDSASSSDETSSANGDSLFSMFSGPDLVAAVKQRRKHSSGEQDTSTLPSPPLLTTVEDVNQDNKTKTWPPKAPWQHPSPLPSTLPSPSAPLYAVTSPGSQWNDTMQMLQSPVWAATNDCSAAAFSYVQTPPQPPPPPAHKAAPKGFKAFPGKGERRPAYLPQY

SEQ ID NO: 43343 - protein, 31 aa, Homo sapiens
  Payload ID: 8912
  Gene Symbol: KIAA0355
  Gene Name: KIAA0355
  ENSP ID: ENSP00000465362
MYCCSAQDSKMDYKRRFLLGGSKQKVQQHQQ

SEQ ID NO: 43344 - protein, 77 aa, Homo sapiens
  Payload ID: 8912
  Gene Symbol: KIAA0355
  Gene Name: KIAA0355
  ENSP ID: ENSP00000475249
MEAASRLTSAIKPEIAKMLMELSAGAANFTDQKEFSLQDIEVLGRCFLTVVQVHFQFLTHALQKVQPVAHSCFAEVI

SEQ ID NO: 43345 - protein, 159 aa, Homo sapiens
  Payload ID: 8912
  Gene Symbol: KIAA0355
  Gene Name: KIAA0355
  ENSP ID: ENSP00000485195
MYCCSAQDSKMDYKRRFLLGGSKQKVQQHQQYPMPELGRALSAPLASTATTAPLGSLTAAGSCHHAMPHTTPIADIQQGISKYLDALNVFCRASTFLTDLFSTVFRNSHYSKAATQLKDVQEHVMEAASRLTSAIKPEIAKMLMELSAGAANFTDQKEF

SEQ ID NO: 43346 - protein, 31 aa, Homo sapiens; identical to SEQ ID NO: 43343
  Payload ID: 8912
  Gene Symbol: KIAA0355
  Gene Name: KIAA0355
  ENSP ID: ENSP00000485320

SEQ ID NO: 43347 - protein, 35 aa, Homo sapiens
  Payload ID: 8912
  Gene Symbol: KIAA0355
  Gene Name: KIAA0355
  ENSP ID: ENSP00000485344
MEAASRLTSAIKPEIAKMLMELSAGAANFTDQKEF

SEQ ID NO: 43348 - protein, 129 aa, Homo sapiens
  Payload ID: 8912
  Gene Symbol: KIAA0355
  Gene Name: KIAA0355
  ENSP ID: ENSP00000488450
  MOD_RES (1)..(1): Any amino acid
XKHSSGEQDTSTLPSPPLLTTVEDVNQDNKTKTWPPKAPWQHPSPLPSTLPSPSAPLYAVTSPGSQWNDTMQMLQSPVWAATNDCSAAAFSYVQTPPQPPPPPAHKAAPKGFKAFPGKGERRPAYLPQY

SEQ ID NO: 43349 - protein, 2017 aa, Homo sapiens
  Payload ID: 8913
  Gene Symbol: KIAA0368
  Gene Name: KIAA0368
  ENSP ID: ENSP00000259335
MTSRTKRRQKVKISISKINHSSYRKEHRPFWEHQPPPHQNWAVGGRCGAGARPGLSQRRGREVRREAQGGASSRRLRARLYFSESTSLPLDRRGSPGPLGPAPHGLRRAAPRGPARRTPRSTALTSRRRAQRPRHGDRLRLRSEARPRAAGDWPCARGGAVRPGRPHRPPRVESARGAHAGRAATDQLERVFLRLGHAETDEQLQNIISKFLPPVLLKLSSTQEGVRKKVMELLVHLNKRIKSRPKIQLPVETLLVQYQDPAAVSFVTNFTIIYVKMGYPRLPVEKQCELAPTLLTAMEGKPQPQQDSLMHLLIPTLFHMKYPVESSKSASPFNLAEKPKTVQLLLDFMLDVLLMPYGYVLNESQSRQNSSSAQGSSSNSGGGSGIPQPPPGMSFYAAKRVIGDNPWTPEQLEQCKLGIVKFIEAEQVPELEAVLHLVIASSDTRHSVATAADLELKSKQSLIDWNNPAIINKMYKVYLGDIPLKTKEGAVLKPELKRDPVSTRVKLKIVPHLLRSRQAAETFPANIQVVYDGLFGTNTNSKLRTLSLQFVHHICITCPEIKIKPLGPMLLNGLTKLINEYKEDPKLLSMAYSAVGKLSSRMPHLFTKDIALVQQLFEALCKEEPETRLAIQEALSMMVGAYSTLEGAQRTLMEALVASYLIKPEVQVRQVAVKFASTVFPSDHIPSRYLLLLAAGDPREEVHGEAQRVLRCLPGRNRKESTSEQMPSFPEMVYYIQEKASHRMKTPVKYMTGTTVLPFNPAAFGEIVLYLRMCLAHSAGVVPTSQSLADMQDHAPAIGRYIRTLMSSGQMAPSSSNKSGETNPVQIYIGLLQQLLAGVGGLPVMYCLLEAVSVYPEKLATKFVDKTEWIKSLMNNSKEEMRELAALFYSVVVSTVSGNELKSMIEQLIKTTKDNHSPEIQHGSLLALGFTVGRYLAKKKMRMSEQQDLERNADTLPDQEELIQSATETIGSFLDSTSPLLAIAACTALGEIGRNGPLPIPSEGSGFTKLHLVESLLSRIPSSKETNKMKERAIQTLGYFPVGDGDFPHQKLLLQGLMDSVEAKQIELQFTIGEAITSAAIGTSSVAARDAWQMTEEEYTPPAGAKVNDVVPWVLDVILNKHIISPNPHVRQAACIWLLSLVRKLSTHKEVKSHLKEIQSAFVSVLSENDELSQDVASKGLGLVYELGNEQDQQELVSTLVETLMTGKRVKHEVSGETVVFQGGALGKTPDGQGLSTYKELCSLASDLSQPDLVYKFMNLANHHAMWNSRKGAAFGFNVIATRAGEQLAPFLPQLVPRLYRYQFDPNLGIRQAMTSIWNALVTDKSMVDKYLKEILQDLVKNLTSNMWRVRESSCLALNDLLRGRPLDDIIDKLPEIWETLFRVQDDIKESVRKAAELALKTLSKVCVKMCDPAKGAAGQRTIAALLPCLLDKGMMSTVTEVRALSINTLVKISKSAGAMLKPHAPKLIPALLESLSVLEPQVLNYLSLRATEQEKAAMDSARLSAAKSSPMMETINMCLQYLDVSVLGELVPRLCELIRSGVGLGTKGGCASVIVSLTTQCPQDLTPYSGKLMSALLSGLTDRNSVIQKSCAFAMGHLVRTSRDSSTEKLLQKLNGWYMEKEEPIYKTSCALTIHAIGRYSPDVLKNHAKEVLPLAFLGMHEIADEEKSEKEECNLWTEVWQENVPGSFGGIRLYLQELITITQKALQSQSWKMKAQGAIAMASIAKQTSSLVPPYLGMILTALLQGLAGRTWAGKEELLKAIACVVTACSAELEKSVPNQPSTNEILQAVLKECSKENVKYKIVAISCAADILKATKEDRFQEFSNIVIPLIKKNSLESSGVRTTKNEEENEKEKELQLEYLLGAFESLGKAWPRNAETQRCYRQELCKLMCERLKLSTWKVQLGVLQSMNAFFQGLMLLEEEHADPEALAEILLETCKSITYSLENKTYSSVRTEALSVIELLLKKLEESKQWECLTSECRVLLIESLATMEPDSRPELQEKAALLKKTLENLE

SEQ ID NO: 43350 - protein, 1839 aa, Homo sapiens
  Payload ID: 8913
  Gene Symbol: KIAA0368
  Gene Name: KIAA0368
  Uniprot ID: Q5VYK3
  ENSP ID: ENSP00000339889
METGSDSDQLERVFLRLGHAETDEQLQNIISKFLPPVLLKLSSTQEGVRKKVMELLVHLNKRIKSRPKIQLPVETLLVQYQDPAAVSFVTNFTIIYVKMGYPRLPVEKQCELAPTLLTAMEGKPQPQQDSLMHLLIPTLFHMKYPVESSKSASPFNLAEKPKTVQLLLDFMLDVLLMPYGYVLNESQSRQNSSSAQGSSSNSGGGSGIPQPPPGMSFYAAKRVIGDNPWTPEQLEQCKLGIVKFIEAEQVPELEAVLHLVIASSDTRHSVATAADLELKSKQSLIDWNNPAIINKMYKVYLGDIPLKTKEGAVLKPELKRDPVSTRVKLKIVPHLLRSRQAAETFPANIQVVYDGLFGTNTNSKLRTLSLQFVHHICITCPEIKIKPLGPMLLNGLTKLINEYKEDPKLLSMAYSAVGKLSSRMPHLFTKDIALVQQLFEALCKEEPETRLAIQEALSMMVGAYSTLEGAQRTLMEALVASYLIKPEVQVRQVAVKFASTVFPSDHIPSRYLLLLAAGDPREEVHGEAQRVLRCLPGRNRKESTSEQMPSFPEMVYYIQEKASHRMKTPVKYMTGTTVLPFNPAAFGEIVLYLRMCLAHSAGVVPTSQSLADMQDHAPAIGRYIRTLMSSGQMAPSSSNKSGETNPVQIYIGLLQQLLAGVGGLPVMYCLLEAVSVYPEKLATKFVDKTEWIKSLMNNSKEEMRELAALFYSVVVSTVSGNELKSMIEQLIKTTKDNHSPEIQHGSLLALGFTVGRYLAKKKMRMSEQQDLERNADTLPDQEELIQSATETIGSFLDSTSPLLAIAACTALGEIGRNGPLPIPSEGSGFTKLHLVESLLSRIPSSKETNKMKERAIQTLGYFPVGDGDFPHQKLLLQGLMDSVEAKQIELQFTIGEAITSAAIGTSSVAARDAWQMTEEEYTPPAGAKVNDVVPWVLDVILNKHIISPNPHVRQAACIWLLSLVRKLSTHKEVKSHLKEIQSAFVSVLSENDELSQDVASKGLGLVYELGNEQDQQELVSTLVETLMTGKRVKHEVSGETVVFQGGALGKTPDGQGLSTYKELCSLASDLSQPDLVYKFMNLANHHAMWNSRKGAAFGFNVIATRAGEQLAPFLPQLVPRLYRYQFDPNLGIRQAMTSIWNALVTDKSMVDKYLKEILQDLVKNLTSNMWRVRESSCLALNDLLRGRPLDDIIDKLPEIWETLFRVQDDIKESVRKAAELALKTLSKVCVKMCDPAKGAAGQRTIAALLPCLLDKGMMSTVTEVRALSINTLVKISKSAGAMLKPHAPKLIPALLESLSVLEPQVLNYLSLRATEQEKAAMDSARLSAAKSSPMMETINMCLQYLDVSVLGELVPRLCELIRSGVGLGTKGGCASVIVSLTTQCPQDLTPYSGKLMSALLSGLTDRNSVIQKSCAFAMGHLVRTSRDSSTEKLLQKLNGWYMEKEEPIYKTSCALTIHAIGRYSPDVLKNHAKEVLPLAFLGMHEIADEEKSEKEECNLWTEVWQENVPGSFGGIRLYLQELITITQKALQSQSWKMKAQGAIAMASIAKQTSSLVPPYLGMILTALLQGLAGRTWAGKEELLKAIACVVTACSAELEKSVPNQPSTNEILQAVLKECSKENVKYKIVAISCAADILKATKEDRFQEFSNIVIPLIKKNSLESSGVRTTKNEEENEKEKELQLEYLLGAFESLGKAWPRNAETQRCYRQELCKLMCERLKLSTWKVQLGVLQSMNAFFQGLMLLEEEHADPEALAEILLETCKSITYSLENKTYSSVRTEALSVIELLLKKLEESKQWECLTSECRVLLIESLATMEPDSRPELQEKAALLKKTLENLE

SEQ ID NO: 43351 - protein, 142 aa, Homo sapiens
  Payload ID: 8913
  Gene Symbol: KIAA0368
  Gene Name: KIAA0368
  ENSP ID: ENSP00000363504
TITQKALQSQSWKMKAQGAIAMASIAKQTSSLVPPYLGMILTALLQGLAGRTWAGKEELLKAIACVVTACSAELEKSVPNQPSTNEILQAVLKECSKENVKYKIVAISCAADILKATKEDRFQEFSNIVIPLIKKKTLENLE

SEQ ID NO: 43352 - protein, 890 aa, Homo sapiens
  Payload ID: 8913
  Gene Symbol: KIAA0368
  Gene Name: KIAA0368
  ENSP ID: ENSP00000473399
MAAAAASASQDELNQLERVFLRLGHAETDEQLQNIISKFLPPVLLKLSSTQEGVRKKVMELLVHLNKRIKSRPKIQLPVETLLVQYQDPAAVSFVTNFTIIYVKMGYPRLPVEKQCELAPTLLTAMEGKPQPQQDSLMHLLIPTLFHMKYPVESSKSASPFNLAEKPKTVQLLLDFMLDVLLMPYGYVLNESQSRQNSSSAQGSSSNSGGGSGIPQPPPGMSFYAAKRVIGDNPWTPEQLEQCKLGIVKFIEAEQVPELEAVLHLVIASSDTRHSVATAADLELKSKQSLIDWNNPAIINKMYKVYLGDIPLKTKEGAVLKPELKRDPVSTRVKLKIVPHLLRSRQAAETFPANIQVVYDGLFGTNTNSKLRTLSLQFVHHICITCPEIKIKPLGPMLLNGLTKLINEYKEDPKLLSMAYSAVGKLSSRMPHLFTKDIALVQQLFEALCKEEPETRLAIQEALSMMVGAYSTLEGAQRTLMEALVASYLIKPEVQVRQVAVKFASTVFPSDHIPSRYLLLLAAGDPREEVHGEAQRVLRCLPGRNRKESTSEQMPSFPEMVYYIQEKASHRMKTPVKYMTGTTVLPFNPAAFGEIVLYLRMCLAHSAGVVPTSQSLADMQDHAPAIGRYIRTLMSSGQMAPSSSNKSGETNPVQIYIGLLQQLLAGVGGLPVMYCLLEAVSVYPEKLATKFVDKTEWIKSLMNNSKEEMRELAALFYSVVVSTVSGNELKSMIEQLIKTTKDNHSPEIQHGSLLALGFTVGRYLAKKKMRMSEQQDLERNADTLPDQEELIQSATETIGSFLDSTSPLLAIAACTALGEIGRNGPLPIPSEGSGFTKLHLVESLLSRIPSSKETNKMKERAIQTLGYFPVGDGDFPHQKLLLQGLMDSVE

SEQ ID NO: 43353 - protein, 128 aa, Homo sapiens
  Payload ID: 8913
  Gene Symbol: KIAA0368
  Gene Name: KIAA0368
  ENSP ID: ENSP00000473402
MYHIDCRDQLERVFLRLGHAETDEQLQNIISKFLPPVLLKLSSTQEGVRKKVMELLVHLNKRIKSRPKIQLPVETLLVQYQDPAAVSFVTNFTIIYVKMGYPRLPVEKQCELAPTLLTAMEGKPQPQQ

SEQ ID NO: 43354 - protein, 567 aa, Homo sapiens
  Payload ID: 8914
  Gene Symbol: KIAA0391
  Gene Name: KIAA0391
  Uniprot ID: O15091
  ENSP ID: ENSP00000250377
MTFYLFGIRSFPKLWKSPYLGLGPGHSYVSLFLADRCGIRNQQRLFSLKTMSPQNTKATNLIAKARYLRKDEGSNKQVYSVPHFFLAGAAKERSQMNSQTEDHALAPVRNTIQLPTQPLNSEEWDKLKEDLKENTGKTSFESWIISQMAGCHSSIDVAKSLLAWVAAKNNGIVSYDLLVKYLYLCVFHMQTSEVIDVFEIMKARYKTLEPRGYSLLIRGLIHSDRWREALLLLEDIKKVITPSKKNYNDCIQGALLHQDVNTAWNLYQELLGHDIVPMLETLKAFFDFGKDIKDDNYSNKLLDILSYLRNNQLYPGESFAHSIKTWFESGQCSGCGKTIESIQLSPEEYECLKGKIMRDVIDGGDQYRKTTPQELKRFENFIKSRPPFDVVIDGLNVAKMFPKVRESQLLLNVVSQLAKRNLRLLVLGRKHMLRRSSQWSRDEMEEVQKQASCFFADDISEDDPFLLYATLHSGNHCRFITRDLMRDHKACLPDAKTQRLFFKWQQGHQLAIVNRFPGSKLTFQRILSYDTVVQTTGDSWHIPYDEDLVERCSCEVPTKWLCLHQKT

SEQ ID NO: 43355 - protein, 211 aa, Homo sapiens
  Payload ID: 8914
  Gene Symbol: KIAA0391
  Gene Name: KIAA0391
  Uniprot ID: O15091
  ENSP ID: ENSP00000324697
MRDVIDGGDQYRKTTPQELKRFENFIKSRPPFDVVIDGLNVAKMFPKVRESQLLLNVVSQLAKRNLRLLVLGRKHMLRRSSQWSRDEMEEVQKQASCFFADDISEDDPFLLYATLHSGNHCRFITRDLMRDHKACLPDAKTQRLFFKWQQGHQLAIVNRFPGSKLTFQRILSYDTVVQTTGDSWHIPYDEDLVERCSCEVPTKWLCLHQKT

SEQ ID NO: 43356 - protein, 583 aa, Homo sapiens
  Payload ID: 8914
  Gene Symbol: KIAA0391
  Gene Name: KIAA0391
  Uniprot ID: O15091
  ENSP ID: ENSP00000440915
MTFYLFGIRSFPKLWKSPYLGLGPGHSYVSLFLADRCGIRNQQRLFSLKTMSPQNTKATNLIAKARYLRKDEGSNKQVYSVPHFFLAGAAKERSQMNSQTEDHALAPVRNTIQLPTQPLNSEEWDKLKEDLKENTGKTSFESWIISQMAGCHSSIDVAKSLLAWVAAKNNGIVSYDLLVKYLYLCVFHMQTSEVIDVFEIMKARYKTLEPRGYSLLIRGLIHSDRWREALLLLEDIKKVITPSKKNYNDCIQGALLHQDVNTAWNLYQELLGHDIVPMLETLKAFFDFGKDIKDDNYSNKLLDILSYLRNNQLYPGESFAHSIKTWFESVPGKQWKGQFTTVRKSGQCSGCGKTIESIQLSPEEYECLKGKIMRDVIDGGDQYRKTTPQELKRFENFIKSRPPFDVVIDGLNVAKMFPKVRESQLLLNVVSQLAKRNLRLLVLGRKHMLRRSSQWSRDEMEEVQKQASCFFADDISEDDPFLLYATLHSGNHCRFITRDLMRDHKACLPDAKTQRLFFKWQQGHQLAIVNRFPGSKLTFQRILSYDTVVQTTGDSWHIPYDEDLVERCSCEVPTKWLCLHQKT

SEQ ID NO: 43357 - protein, 185 aa, Homo sapiens
  Payload ID: 8914
  Gene Symbol: KIAA0391
  Gene Name: KIAA0391
  ENSP ID: ENSP00000450898
MRDVIDGGDQYRKTTPQELKRFENFIKSRPPFDVVIDGLNVAKMFPKVRESQLLLNVVSQLAKRNLRLLVLGRKHMLRRSSQWSRDEMEEVQKQASCFFADDISEDDPFLLYATLHSGNHCRFITRDLMRDHKACLPDAKTQRLFFKWQQGHQLAIVNRFPGSKLTFQRILSYDTVVQTTGDSWH

SEQ ID NO: 43358 - protein, 567 aa, Homo sapiens; identical to SEQ ID NO: 43354
  Payload ID: 8914
  Gene Symbol: KIAA0391
  Gene Name: KIAA0391
  Uniprot ID: O15091
  ENSP ID: ENSP00000473856

SEQ ID NO: 43359 - protein, 211 aa, Homo sapiens; identical to SEQ ID NO: 43355
  Payload ID: 8914
  Gene Symbol: KIAA0391
  Gene Name: KIAA0391
  Uniprot ID: O15091
  ENSP ID: ENSP00000474299

SEQ ID NO: 43360 - protein, 488 aa, Homo sapiens
  Payload ID: 8914
  Gene Symbol: KIAA0391
  Gene Name: KIAA0391
  Uniprot ID: O15091
  ENSP ID: ENSP00000474620
MNSQTEDHALAPVRNTIQLPTQPLNSEEWDKLKEDLKENTGKTSFESWIISQMAGCHSSIDVAKSLLAWVAAKNNGIVSYDLLVKYLYLCVFHMQTSEVIDVFEIMKARYKTLEPRGYSLLIRGLIHSDRWREALLLLEDIKKVITPSKKNYNDCIQGALLHQDVNTAWNLYQELLGHDIVPMLETLKAFFDFGKDIKDDNYSNKLLDILSYLRNNQLYPGESFAHSIKTWFESVPGKQWKGQFTTVRKSGQCSGCGKTIESIQLSPEEYECLKGKIMRDVIDGGDQYRKTTPQELKRFENFIKSRPPFDVVIDGLNVAKMFPKVRESQLLLNVVSQLAKRNLRLLVLGRKHMLRRSSQWSRDEMEEVQKQASCFFADDISEDDPFLLYATLHSGNHCRFITRDLMRDHKACLPDAKTQRLFFKWQQGHQLAIVNRFPGSKLTFQRILSYDTVVQTTGDSWHIPYDEDLVERCSCEVPTKWLCLHQKT

SEQ ID NO: 43361 - protein, 19 aa, Homo sapiens
  Payload ID: 8914
  Gene Symbol: KIAA0391
  Gene Name: KIAA0391
  ENSP ID: ENSP00000474656
MTFYLFGIRSFPKLWKSPY

SEQ ID NO: 43362 - protein, 23 aa, Homo sapiens
  Payload ID: 8914
  Gene Symbol: KIAA0391
  Gene Name: KIAA0391
  ENSP ID: ENSP00000474700
MTFYLFGIRSFPKLWKSPYLGLG

SEQ ID NO: 43363 - protein, 34 aa, Homo sapiens
  Payload ID: 8914
  Gene Symbol: KIAA0391
  Gene Name: KIAA0391
  ENSP ID: ENSP00000474967
MTFYLFGIRSFPKLWKSPYLGLGPGHSYVSLFLA

SEQ ID NO: 43364 - protein, 252 aa, Homo sapiens
  Payload ID: 8915
  Gene Symbol: KIAA0408
  Gene Name: KIAA0408
  ENSP ID: ENSP00000434384
MDLHKQWENTETNWHKEKMELLDQFDNERKEWESQWKIMQKKIEEASTLVLLSTELSLCREVKLWRKININESAKIIDLYHEKTIPEKVIESSPNYPDLGQSEFIRTNHKDGLRKENKREQSLVSGGNQMCKEQKATKKSKVGFLDPLATDNQKECEAWPDLRTSEEDSKSCSGALSTALEELAKVSEELCSFQEEIRKRSNHRRMKSDSFLQEMPNVTNIPHGDPMINNDQCILPISLEKEKQKNRKNLSC

SEQ ID NO: 43365 - protein, 694 aa, Homo sapiens
  Payload ID: 8915
  Gene Symbol: KIAA0408
  Gene Name: KIAA0408
  Uniprot ID: Q6ZU52
  ENSP ID: ENSP00000435150
MDLHKQWENTETNWHKEKMELLDQFDNERKEWESQWKIMQKKIEELCREVKLWRKININESAKIIDLYHEKTIPEKVIESSPNYPDLGQSEFIRTNHKDGLRKENKREQSLVSGGNQMCKEQKATKKSKVGFLDPLATDNQKECEAWPDLRTSEEDSKSCSGALSTALEELAKVSEELCSFQEEIRKRSNHRRMKSDSFLQEMPNVTNIPHGDPMINNDQCILPISLEKEKQKNRKNLSCTNVLQSNSTKKCGIDTIDLKRNETPPVPPPRSTSRNFPSSDSEQAYERWKERLDHNSWVPHEGRSKRNYNPHFPLRQQEMSMLYPNEGKTSKDGIIFSSLVPEVKIDSKPPSNEDVGLSMWSCDIGIGAKRSPSTSWFQKTCSTPSNPKYEMVIPDHPAKSHPDLHVSNDCSSSVAESSSPLRNFSCGFERTTRNEKLAAKTDEFNRTVFRTDRNCQAIQQNHSCSKSSEDLKPCDTSSTHTGSISQSNDVSGIWKTNAHMPVPMENVPDNPTKKSTTGLVRQMQGHLSPRSYRNMLHEHDWRPSNLSGRPRSADPRSNYGVVEKLLKTYETATESALQNSKCFQDNWTKCNSDVSGGATLSQHLEMLQMEQQFQQKTAVWGGQEVKQGIDPKKITEESMSVNASHGKGFSRPARPANRRLPSRWASRSPSAPPALRRTTHNYTISLRSEALMV

SEQ ID NO: 43366 - protein, 88 aa, Homo sapiens
  Payload ID: 8915
  Gene Symbol: KIAA0408
  Gene Name: KIAA0408
  ENSP ID: ENSP00000436178
SSSVAESSSPLRNFSCGFERTTRNEKLAAKTDEFNRTVFRTDRNCQAIQQNHSCSKSSEDLKPCDTSSTHTGIHVSERLTWKRIFPTC

SEQ ID NO: 43367 - protein, 1742 aa, Homo sapiens
  Payload ID: 8916
  Gene Symbol: KIAA0430
  Gene Name: KIAA0430
  Uniprot ID: Q9Y4F3
  ENSP ID: ENSP00000379654
MMEGNGTENSCSRTRGWLQQDNDAKPWLWKFSNCFSRPEQTLPHSPQTKEYMENKKVAVELKDVPSPLHAGSKLFPAVPLPDIRSLQQPKIQLSSVPKVSCCAHCPNEPSTSPMRFGGGGGGSGGTSSLIHPGALLDSQSTRTITCQVGSGFAFQSASSLQNASARNNLAGIASDFPSMCLESNLSSCKHLPCCGKLHFQSCHGNVHKLHQFPSLQGCTSAGYFPCSDFTSGAPGHLEEHISQSELTPHLCTNSLHLNVVPPVCLKGSLYCEDCLNKPARNSIIDAAKVWPNIPPPNTQPAPLAVPLCNGCGTKGTGKETTLLLATSLGKAASKFGSPEVAVAGQVLENLPPIGVFWDIENCSVPSGRSATAVVQRIREKFFKGHREAEFICVCDISKENKEVIQELNNCQVTVAHINATAKNAADDKLRQSLRRFANTHTAPATVVLVSTDVNFALELSDLRHRHGFHIILVHKNQASEALLHHANELIRFEEFISDLPPRLPLKMPQCHTLLYVYNLPANKDGKSVSNRLRRLSDNCGGKVLSITGCSAILRFINQDSAERAQKRMENEDVFGNRIIVSFTPKNRELCETKSSNAIADKVKSPKKLKNPKLCLIKDASEQSSSAKATPGKGSQANSGSATKNTNVKSLQELCRMESKTGHRNSEHQQGHLRLVVPTHGNSSAAVSTPKNSGVAEPVYKTSQKKENLSARSVTSSPVEKKDKEETVFQVSYPSAFSKLVASRQVSPLLASQSWSSRSMSPNLLNRASPLAFNIANSSSEADCPDPFANGADVQVSNIDYRLSRKELQQLLQEAFARHGKVKSVELSPHTDYQLKAVVQMENLQDAIGAVNSLHRYKIGSKKILVSLATGAASKSLSLLSAETMSVLQDAPACCLPLFKFTDIYEKKFGHKLNVSDLYKLTDTVAIREQGNGRLVCLLPSSQARQSPLGSSQSHDGSSTNCSPIIFEELEYHEPVCRQHCSNKDFSEHEFDPDSYKIPFVILSLKTFAPQVHSLLQTHEGTVPLLSFPDCYIAEFGDLEVVQENQGGVPLEHFITCVPGVNIATAQNGIKVVKWIHNKPPPPNTDPWLLRSKSPVGNPQLIQFSREVIDLLKSQPSCVIPISHFIPSYHHHFAKQCRVSDYGYSKLIELLEAVPHVLQILGMGSKRLLTLTHRAQVKRFTQDLLKLLKSQASKQVIVREFSQAYHWCFSKDWDVTEYGVCELIDIVSEIPDTTICLSQQDNEMVICIPKRERTQDEIERTKQFSKDVVDLLRHQPHFRMPFNKFIPSYHHHFGRQCKLAYYGFTKLLELFEAIPDTLQVLECGEEKILTLTEVERFKALAAQFVKLLRSQKDNCLMMTDLLTEYAKTFGYTFRLQDYDVSSISALTQKLCHVVKVADIESGRQIQLINRKSLRSLTAQLLVLLMSWEGTTHLSVEELKRHYESTHNTPLNPCEYGFMTLTELLKSLPYLVEVFTNDKMEECVKLTSLYLFAKNVRSLLHTYHYQQIFLHEFSMAYTKYVGETLQPKTYGHSSVEELLGAIPQVVWIKGHGHKRIVVLKNDMKSRLSSLSLSPANHENQPSEGERILEVPESHTASELKLGADGSGPSHTEQELLRLTDDSPVDLLCAPVPSCLPSPQLRPDPVILQSADLIQFEERPQEPSEIMILNQEEKMEIPIPGKSKTLTSDSSSSCISAAVPVPPCPSSETSESLLSKDPVESPAKKQPKNRVKLAANFSLAPITKL

SEQ ID NO: 43368 - protein, 1577 aa, Homo sapiens
  Payload ID: 8916
  Gene Symbol: KIAA0430
  Gene Name: KIAA0430
  ENSP ID: ENSP00000439819
MMEGNGTENSCSRTRGWLQQDNDAKPWLWKFSNCFSRPEQTLPHSPQTKEYMENKKVAVELKDVPSPLHAGSKLFPAVPLPDIRSLQQPKIQLSSVPKVSCCAHCPNEPSTSPMRFGGGGGGSGGTSSLIHPGALLDSQSTRTITCQVGSGFAFQSASSLQNASARNNLAGIASDFPSMCLESNLSSCKHLPCCGKLHFQSCHGNVHKLHQFPSLQGCTSAGYFPCSDFTSGAPGHLEEHISQSELTPHLCTNSLHLNVVPPVCLKGSLYCEDCLNKPARNSIIDAAKVWPNIPPPNTQPAPLAVPLCNGCGTKGTGKETTLLLATSLGKAASKFGSPEVAVAGQVLENLPPIGVFWDIENCSVPSGRSATAVVQRIREKFFKGHREAEFICVCDISKENKEVIQELNNCQVTVAHINATAKNAADDKLRQSLRRFANTHTAPATVVLVSTDVNFALELSDLRHRHGFHIILVHKNQASEALLHHANELIRFEEFISDLPPRLPLKMPELCRMESKTGHRNSEHQQGHLRLVVPTHGNSSAAVSTPKNSGVAEPVYKTSQKKENLSARSVTSSPVEKKDKEETVFQVSYPSAFSKLVASRQVSPLLASQSWSSSEADCPDPFANGADVQVSNIDYRLSRKELQQLLQEAFARHGKVKSVELSPHTDYQLKAVVQMENLQDAIGAVNSLHRYKIGSKKILVSLATGAASKSLSLLSAETMSVLQDAPACCLPLFKFTDIYEKKFGHKLNVSDLYKLTDTVAIREQGNGRLVCLLPSSQARQSPLGSSQSHDGSSTNCSPIIFEELEYHEPVCRQHCSNKDFSEHEFDPDSYKIPFVILSLKTFAPQVHSLLQTHEGTVPLLSFPDCYIAEFGDLEVVQENQGGVPLEHFITCVPGVNIATAQNGIKVVKWIHNKPPPPNTDPWLLRSKSPVGNPQLIQFSREVIDLLKSQPSCVIPISHFIPSYHHHFAKQCRVSDYGYSKLIELLEAVPHVLQILGMGSKRLLTLTHRAQVKRFTQDLLKLLKSQASKQVIVREFSQAYHWCFSKDWDVTEYGVCELIDIVSEIPDTTICLSQQDNEMVICIPKRERTQDEIERTKQFSKDVVDLLRHQPHFRMPFNKFIPSYHHHFGRQCKLAYYGFTKLLELFEAIPDTLQVLECGEEKILTLTEVERFKALAAQFVKLLRSQKDNCLMMTDLLTEYAKTFGYTFRLQDYDVSSISALTQKLCHVVKVADIESGRQIQLINRKSLRSLTAQLLVLLMSWEGTTHLSVEELKRHYESTHNTPLNPCEYGFMTLTELLKSLPYLVEVFTNDKMEECVKLTSLYLFAKNVRSLLHTYHYQQIFLHEFSMAYTKYVGETLQPKTYGHSSVEELLGAIPQVVWIKGHGHKRIVVLKNDMKSRLSSLSLSPANHENQPSEGERILEVPESHTASELKLGADGSGPSHTEQELLRLTDDSPVDLLCAPVPSCLPSPQLRPDPVILQSADLIQFEERPQEPSEIMILNQEEKMEIPIPGKSKTLTSDSSSSCISAAVPVPPCPSSETSESLLSKDPVESPAKKQPKNRVKLAANFSLAPITKL

SEQ ID NO: 43369 - protein, 164 aa, Homo sapiens
  Payload ID: 8916
  Gene Symbol: KIAA0430
  Gene Name: KIAA0430
  ENSP ID: ENSP00000448495
MMEGNGTENSCSRTRGWLQQDNDAKPWLWKFSNCFSRPEQTLPHSPQTKEYMENKKVAVELKDVPSPLHAGSKLFPAVPLPDIRSLQQPKIQLSSVPKVSCCAHCPNEPSTSPMRFGGGGGGSGGTSSLIHPGALLDSQSTRTITCQVGSGFAFQSASSLQNAS

SEQ ID NO: 43370 - protein, 19 aa, Homo sapiens
  Payload ID: 8916
  Gene Symbol: KIAA0430
  Gene Name: KIAA0430
  ENSP ID: ENSP00000449050
  MOD_RES (1)..(1): Any amino acid
XSELKLGADGSGLEGKLQV

SEQ ID NO: 43371 - protein, 1037 aa, Homo sapiens
  Payload ID: 8916
  Gene Symbol: KIAA0430
  Gene Name: KIAA0430
  ENSP ID: ENSP00000449329
MMEGNGTENSCSRTRGWLQQDNDAKPWLWKFSNCFSRPEQTLPHSPQTKEYMENKKVAVELKDVPSPLHAGSKLFPAVPLPDIRSLQQPKIQLSSVPKVSCCAHCPNEPSTSPMRFGGGGGGSGGTSSLIHPGALLDSQSTRTITCQVGSGFAFQSASSLQNASARNNLAGIASDFPSMCLESNLSSCKHLPCCGKLHFQSCHGNVHKLHQFPSLQGCTSAGYFPCSDFTSGAPGHLEEHISQSELTPHLCTNSLHLNVVPPVCLKGSLYCEDCLNKPARNSIIDAAKVWPNIPPPNTQPAPLAVPLCNGCGTKGTGKETTLLLATSLGKAASKFGSPEVAVAGQVLENLPPIGVFWDIENCSVPSGRSATAVVQRIREKFFKGHREAEFICVCDISKENKEVIQELNNCQVTVAHINATAKNAADDKLRQSLRRFANTHTAPATVVLVSTDVNFALELSDLRHRHGFHIILVHKNQASEALLHHANELIRFEEFISDLPPRLPLKMPQCHTLLYVYNLPANKDGKSVSNRLRRLSDNCGGKVLSITGCSAILRFINQDSAERAQKRMENEDVFGNRIIVSFTPKNRELCETKSSNAIADKVKSPKKLKNPKLCLIKDASEQSSSAKATPGKGSQANSGSATKNTNVKSLQELCRMESKTGHRNSEHQQGHLRLVVPTHGNSSAAVSTPKNSGVAEPVYKTSQKKENLSARSVTSSPVEKKDKEETVFQVSYPSAFSKLVASRQVSPLLASQSWSSRSMSPNLLNRASPLAFNIANSSSEADCPDPFANGADVQVSNIDYRLSRKELQQLLQEAFARHGKVKSVELSPHTDYQLKAVVQMENLQDAIGAVNSLHRYKIGSKKILVSLATGAASKSLSLLSAETMSVLQDAPACCLPLFKFTDIYEKKFGHKLNVSDLYKLTDTVAIREQGNGRLVCLLPSSQARQSPLGSSQSHDGSSTNCSPIIFEELEYHEPVCRQHCSNKDFSEHEFDPDSYKIPFVILSLKTFAPQVHSLLQTHEGTVPLLRPLASAFEESCR

SEQ ID NO: 43372 - protein, 1739 aa, Homo sapiens
  Payload ID: 8916
  Gene Symbol: KIAA0430
  Gene Name: KIAA0430
  Uniprot ID: Q9Y4F3
  ENSP ID: ENSP00000449376
MMEGNGTENSCSRTRGWLQQDNDAKPWLWKFSNCFSRPEQTLPHSPQTKEYMENKKVAVELKDVPSPLHAGSKLFPAVPLPDIRSLQQPKIQLSSVPKVSCCAHCPNEPSTSPMRFGGGGGGSGGTSSLIHPGALLDSQSTRTITCQVGSGFAFQSASSLQNASARNNLAGIASDFPSMCLESNLSSCKHLPCCGKLHFQSCHGNVHKLHQFPSLQGCTSAGYFPCSDFTSGAPGHLEEHISQSELTPHLCTNSLHLNVVPPVCLKGSLYCEDCLNKPARNSIIDAAKVWPNIPPPNTQPAPLAVPLCNGCGTKGTGKETTLLLATSLGKAASKFEVAVAGQVLENLPPIGVFWDIENCSVPSGRSATAVVQRIREKFFKGHREAEFICVCDISKENKEVIQELNNCQVTVAHINATAKNAADDKLRQSLRRFANTHTAPATVVLVSTDVNFALELSDLRHRHGFHIILVHKNQASEALLHHANELIRFEEFISDLPPRLPLKMPQCHTLLYVYNLPANKDGKSVSNRLRRLSDNCGGKVLSITGCSAILRFINQDSAERAQKRMENEDVFGNRIIVSFTPKNRELCETKSSNAIADKVKSPKKLKNPKLCLIKDASEQSSSAKATPGKGSQANSGSATKNTNVKSLQELCRMESKTGHRNSEHQQGHLRLVVPTHGNSSAAVSTPKNSGVAEPVYKTSQKKENLSARSVTSSPVEKKDKEETVFQVSYPSAFSKLVASRQVSPLLASQSWSSRSMSPNLLNRASPLAFNIANSSSEADCPDPFANGADVQVSNIDYRLSRKELQQLLQEAFARHGKVKSVELSPHTDYQLKAVVQMENLQDAIGAVNSLHRYKIGSKKILVSLATGAASKSLSLLSAETMSVLQDAPACCLPLFKFTDIYEKKFGHKLNVSDLYKLTDTVAIREQGNGRLVCLLPSSQARQSPLGSSQSHDGSSTNCSPIIFEELEYHEPVCRQHCSNKDFSEHEFDPDSYKIPFVILSLKTFAPQVHSLLQTHEGTVPLLSFPDCYIAEFGDLEVVQENQGGVPLEHFITCVPGVNIATAQNGIKVVKWIHNKPPPPNTDPWLLRSKSPVGNPQLIQFSREVIDLLKSQPSCVIPISHFIPSYHHHFAKQCRVSDYGYSKLIELLEAVPHVLQILGMGSKRLLTLTHRAQVKRFTQDLLKLLKSQASKQVIVREFSQAYHWCFSKDWDVTEYGVCELIDIVSEIPDTTICLSQQDNEMVICIPKRERTQDEIERTKQFSKDVVDLLRHQPHFRMPFNKFIPSYHHHFGRQCKLAYYGFTKLLELFEAIPDTLQVLECGEEKILTLTEVERFKALAAQFVKLLRSQKDNCLMMTDLLTEYAKTFGYTFRLQDYDVSSISALTQKLCHVVKVADIESGRQIQLINRKSLRSLTAQLLVLLMSWEGTTHLSVEELKRHYESTHNTPLNPCEYGFMTLTELLKSLPYLVEVFTNDKMEECVKLTSLYLFAKNVRSLLHTYHYQQIFLHEFSMAYTKYVGETLQPKTYGHSSVEELLGAIPQVVWIKGHGHKRIVVLKNDMKSRLSSLSLSPANHENQPSEGERILEVPESHTASELKLGADGSGPSHTEQELLRLTDDSPVDLLCAPVPSCLPSPQLRPDPVILQSADLIQFEERPQEPSEIMILNQEEKMEIPIPGKSKTLTSDSSSSCISAAVPVPPCPSSETSESLLSKDPVESPAKKQPKNRVKLAANFSLAPITKL

SEQ ID NO: 43373 - protein, 1742 aa, Homo sapiens
  Payload ID: 8916
  Gene Symbol: KIAA0430
  Gene Name: KIAA0430
  Uniprot ID: Q9Y4F3
  ENSP ID: ENSP00000450309
MMEGNGTENSCSRTRGWLQQDNDAKPWLWKFSNCFSRPEQTLPHSPQTKEYMENKKVAVELKDVPSPLHAGSKLFPAVPLPDIRSLQQPKIQLSSVPKVSCCAHCPNEPSTSPMRFGGGGGGSGGTSSLIHPGALLDSQSTRTITCQVGSGFAFQSASSLQNASARNNLAGIASDFPSMCLESNLSSCKHLPCCGKLHFQSCHGNVHKLHQFPSLQGCTSAGYFPCSDFTSGAPGHLEEHISQSELTPHLCTNSLHLNVVPPVCLKGSLYCEDCLNKPARNSIIDAAKVWPNIPPPNTQPAPLAVPLCNGCGTKGTGKETTLLLATSLGKAASKFGSPEVAVAGQVLENLPPIGVFWDIENCSVPSGRSATAVVQRIREKFFKGHREAEFICVCDISKENKEVIQELNNCQVTVAHINATAKNAADDKLRQSLRRFANTHTAPATVVLVSTDVNFALELSDLRHRHGFHIILVHKNQASEALLHHANELIRFEEFISDLPPRLPLKMPCHTLLYVYNLPANKDGKSVSNRLRRLSDNCGGKVLSITGCSAILRFINQDSAERAQKRMENEDVFGNRIIVSFTPKNRELCETKSSNAIADKVKSPKKLKNPKLCLIKDASEQSSSAKATPGKGSQANSGSATKNTNVKSLQELCRMESKTGHRNSEHQQGHLRLVVPTHGNSSAAVSTPKNSGVAEPVYKTSQKKENLSARSVTSSPVEKKDKEETVFQVSYPSAFSKLVASRQVSPLLASQSWSSSRSMSPNLLNRASPLAFNIANSSSEADCPDPFANGADVQVSNIDYRLSRKELQQLLQEAFARHGKVKSVELSPHTDYQLKAVVQMENLQDAIGAVNSLHRYKIGSKKILVSLATGAASKSLSLLSAETMSVLQDAPACCLPLFKFTDIYEKKFGHKLNVSDLYKLTDTVAIREQGNGRLVCLLPSSQARQSPLGSSQSHDGSSTNCSPIIFEELEYHEPVCRQHCSNKDFSEHEFDPDSYKIPFVILSLKTFAPQVHSLLQTHEGTVPLLSFPDCYIAEFGDLEVVQENQGGVPLEHFITCVPGVNIATAQNGIKVVKWIHNKPPPPNTDPWLLRSKSPVGNPQLIQFSREVIDLLKSQPSCVIPISHFIPSYHHHFAKQCRVSDYGYSKLIELLEAVPHVLQILGMGSKRLLTLTHRAQVKRFTQDLLKLLKSQASKQVIVREFSQAYHWCFSKDWDVTEYGVCELIDIVSEIPDTTICLSQQDNEMVICIPKRERTQDEIERTKQFSKDVVDLLRHQPHFRMPFNKFIPSYHHHFGRQCKLAYYGFTKLLELFEAIPDTLQVLECGEEKILTLTEVERFKALAAQFVKLLRSQKDNCLMMTDLLTEYAKTFGYTFRLQDYDVSSISALTQKLCHVVKVADIESGRQIQLINRKSLRSLTAQLLVLLMSWEGTTHLSVEELKRHYESTHNTPLNPCEYGFMTLTELLKSLPYLVEVFTNDKMEECVKLTSLYLFAKNVRSLLHTYHYQQIFLHEFSMAYTKYVGETLQPKTYGHSSVEELLGAIPQVVWIKGHGHKRIVVLKNDMKSRLSSLSLSPANHENQPSEGERILEVPESHTASELKLGADGSGPSHTEQELLRLTDDSPVDLLCAPVPSCLPSPQLRPDPVILQSADLIQFEERPQEPSEIMILNQEEKMEIPIPGKSKTLTSDSSSSCISAAVPVPPCPSSETSESLLSKDPVESPAKKQPKNRVKLAANFSLAPITKL

SEQ ID NO: 43374 - protein, 1742 aa, Homo sapiens; identical to SEQ ID NO: 43367
  Payload ID: 8916
  Gene Symbol: KIAA0430
  Gene Name: KIAA0430
  Uniprot ID: Q9Y4F3
  ENSP ID: ENSP00000479383

SEQ ID NO: 43375 - protein, 1037 aa, Homo sapiens; identical to SEQ ID NO: 43371
  Payload ID: 8916
  Gene Symbol: KIAA0430
  Gene Name: KIAA0430
  ENSP ID: ENSP00000487600

SEQ ID NO: 43376 - protein, 1739 aa, Homo sapiens; identical to SEQ ID NO: 43372
  Payload ID: 8916
  Gene Symbol: KIAA0430
  Gene Name: KIAA0430
  Uniprot ID: Q9Y4F3
  ENSP ID: ENSP00000487685

SEQ ID NO: 43377 - protein, 1742 aa, Homo sapiens; identical to SEQ ID NO: 43373
  Payload ID: 8916
  Gene Symbol: KIAA0430
  Gene Name: KIAA0430
  Uniprot ID: Q9Y4F3
  ENSP ID: ENSP00000488025

SEQ ID NO: 43378 - protein, 164 aa, Homo sapiens; identical to SEQ ID NO: 43369
  Payload ID: 8916
  Gene Symbol: KIAA0430
  Gene Name: KIAA0430
  ENSP ID: ENSP00000488482

SEQ ID NO: 43379 - protein, 19 aa, Homo sapiens
  Payload ID: 8916
  Gene Symbol: KIAA0430
  Gene Name: KIAA0430
  ENSP ID: ENSP00000488523
  MOD_RES (1)..(1): Any amino acid
XSELKLGADGSGLEGKLQV

SEQ ID NO: 43380 - protein, 1577 aa, Homo sapiens; identical to SEQ ID NO: 43368
  Payload ID: 8916
  Gene Symbol: KIAA0430
  Gene Name: KIAA0430
  ENSP ID: ENSP00000488857

SEQ ID NO: 43381 - protein, 411 aa, Homo sapiens
  Payload ID: 8917
  Gene Symbol: KIAA0513
  Gene Name: KIAA0513
  Uniprot ID: O60268
  ENSP ID: ENSP00000258180
METPEVPVGSLIDFGPEAPTSSPLEAPPPVLQDGDGSLGDGASESETTESADSENDMGESPSHPSWDQDRRSSSNESFSSNQSTESTQDEETLALRDFMRGYVEKIFSGGEDLDQEEKAKFGEYCSSENGKGREWFARYVSAQRCNSKCVSEATFYRLVQSFAVVLFECHQMDDFGPAKNLMTMCFTYYHIGKPQLLPPESREKPAGSIDSYLKSANSWLAEKKDIAERLLKNTSARTENVKGFFGGLETKLKGPLARRNEEDENKPQEKRPRAVTAYSPEDEKKGEKIYLYTHLKQQPIWHTLRFWNAAFFDAVHCERTKRSPTTRGDAGEEEEKREKWCHMTQEERDDSLRFNENITFGQLGTFTHNMLAFGLNKKLCNDFLKKQAVIGNLDEEQYKLLSDHIEQMATE

SEQ ID NO: 43382 - protein, 401 aa, Homo sapiens
  Payload ID: 8917
  Gene Symbol: KIAA0513
  Gene Name: KIAA0513
  Uniprot ID: O60268
  ENSP ID: ENSP00000446439
METPEVPVGSLIDFGPEAPTSSPLEAPPPVLQDGDGSLGDGASESETTESADSENDMGESPSHPSWDQDRRSSSNESFSSNQSTESTQDEETLALRDFMRGYVEKIFSGGEDLDQEEKAKFGEYCSSENGKGREWFARYVSAQRCNSKCVSEATFYRLVQSFAVVLFECHQMDDFGPAKNLMTMCFTYYHIGKPQLLPPESREKPAGSIDSYLKSANSWLAEKKDIAERLLKNTSARTENVKGFFGGLETKLKGPLARRNEEDENKPQEKRPRAVTAYSPEDEKKGEKIYLYTHLKQQPIWHTLRFWNAAFFDAVHCERTKRSPTTREKWCHMTQEERDDSLRFNENITFGQLGTFTHNMLAFGLNKKLCNDFLKKQAVIGNLDEEQYKLLSDHIEQMATE

SEQ ID NO: 43383 - protein, 198 aa, Homo sapiens
  Payload ID: 8917
  Gene Symbol: KIAA0513
  Gene Name: KIAA0513
  ENSP ID: ENSP00000454547
KPAGSIDSYLKSANSWLAEKKDIAERLLKNTSARTENVKGFFGGLETKLKGPLARRNEEDENKPQEKRPRAVTAYSPEDEKKGEKIYLYTHLKQQPIWHTLRFWNAAFFDAVHCERTKRSPTTREKWCHMTQEERDDSLRFNENITFGQLGTFTHNMLAFGLNKKLCNDFLKKQAVIGNLDEEQYKLLSDHIEQMATE

SEQ ID NO: 43384 - protein, 113 aa, Homo sapiens
  Payload ID: 8917
  Gene Symbol: KIAA0513
  Gene Name: KIAA0513
  ENSP ID: ENSP00000454758
DENKPQEKRPRAVTAYSPEDEKKGEKIYLYTHLKQQPIWEKWCHMTQEERDDSLRFNENITFGQLGTFTHNMLAFGLNKKLCNDFLKKQAVIGNLDEEQYKLLSDHIEQMATE

SEQ ID NO: 43385 - protein, 301 aa, Homo sapiens
  Payload ID: 8917
  Gene Symbol: KIAA0513
  Gene Name: KIAA0513
  Uniprot ID: O60268
  ENSP ID: ENSP00000455544
METPEVPVGSLIDFGPEAPTSSPLEAPPPVLQDGDGSLGDGASESETTESADSENDMGESPSHPSWDQDRRSSSNESFSSNQSTESTQDEETLALRDFMRGYVEKIFSGGEDLDQEEKAKFGEYCSSENGKGREWFARYVSAQRCNSKCVSEATFYRLVQSFAVVLFECHQMDDFGPAKNLMTMCFTYYHIGKPQLLPPESREKPAGSIDSYLKSANSWLAEKKDIAERLLKNTSARTENVKGFFGGLETKLKGPLARRNEEDENKPQEKRPRAVTAYSPEDEKKGEKIYLYTHLKQQPIW

SEQ ID NO: 43386 - protein, 411 aa, Homo sapiens; identical to SEQ ID NO: 43381
  Payload ID: 8917
  Gene Symbol: KIAA0513
  Gene Name: KIAA0513
  Uniprot ID: O60268
  ENSP ID: ENSP00000457408

SEQ ID NO: 43387 - protein, 1618 aa, Homo sapiens
  Payload ID: 8918
  Gene Symbol: KIAA0556
  Gene Name: KIAA0556
  Uniprot ID: O60303
  ENSP ID: ENSP00000261588
MDGQTLRKAERSWSCSREKKEGYAKDMVTDFDEKHDEYLILLQQRNRILKHLKSKDPVQLRLEHLEQGFSVYVNGANSELKSSPRKAIHSDFSRSASHTEGTHDYGRRTLFREAEEALRRSSRTAPSKVQRRGWHQKSVQIRTEAGPRLHIEPPVDYSDDFELCGDVTLQANNTSEDRPQELRRSLELSVNLQRKQKDCSSDEYDSIEEDILSEPEPEDPALVGHPRHDRPPSSGDWTQKDVHGEQETEGRSSPGPDTLVVLEFNPASKSHKRERNLSAKRKDNAEVFVPTKPEPNLTPQAPAVFPDQERMCSRPGSRRERPLSATRKTLCEAEYPEEDASAVLQAIQVENAALQRALLSRKAEQPASPLQDAEGPPAKPWTSLLEEKEETLELLPITTATTTQEPAGAAGGARAINQAMDRIGLLGSRQQQKLLKVLQAVESDSAHLGRVVSPTKEQVSDTEDKQRMRADEIKDAIYVTMEILSNWGNSWWVGLTEVEFFDLNDTKLYVSPHDVDIRNTATPGELGRLVNRNLAGKKDSSPWTCPFHPPLQLFFVIRNTRQLGDFHLAKIKVRNYWTADGDLDIGAKNVKLYVNRNLIFNGKLDKGDREAPADHSILVDQKNEKSEQLEEAMNAHSEESKGTHEMAGASGDKELGLGCSPPAETLADAKLSSQGNVSGKRKNSTNCRKDSLSQLEEYLRLSAVPTSMGDMPSAPATSPPVKCPPVHEEPSLIQQLENLMGRKICEPPGKTPSWLQPSPTGKDRKQGGRKPKPLWLSPEKPLAWKGRLPSDDVIGEGPGETEARDKGLRHEPGWGTSRSVNTKERPQRATTKVHSDDSDIFNQPPNRERPASGRRGSRKDAGSSSHGDDQPASREDTWSSRTPSRSRWRSEQEHTLHESWSSLSAFDRSHRGRISNTELPGDILDELLQQKSSRHSDLPPSKKGEQPGLSRGQDGYSGETDAGGDFKIPVLPYGQRLVIDIKSTWGDRHYVGLNGIEIFSSKGEPVQISNIKADPPDINILPAYGKDPRVVTNLIDGVNRTQDDMHVWLAPFTRGRSHSITIDFTHPCHVALIRIWNYNKSRIHSFRGVKDITMLLDTQCIFEGEIAKASGTLAGAPEHFGDTILFTTDDDILEAIFYSDEMFDLDVGSLDSLQDEEAMRRPSTADGEGDERPFTQAGLGADERIPELELPSSSPVPQVTTPEPGIYHGICLQLNFTASWGDLHYLGLTGLEVVGKEGQALPIHLHQISASPRDLNELPEYSDDSRALDKLIDGTNITMEDEHMWLIPFSPGLDHVVTIRLDRAESIAGLRFWNYNKSPEDTYRGAKIVHVSLDGLCVSPPEGFLIRKGPGNCHFDFAQEILFVDYLRAQLLPQPARRLDMRSLECASMDYEAPLMPCGFIFQFQLLTSWGDPYYIGLTGLELYDERGEKIPLSENNIAAFPDSVNSLEGVGGDVRTPDKLIDQVNDTSDGRHMWLAPILPGLVNRVYVIFDLPTTVSMIKLWNYAKTPHRGVKEFGLLVDDLLVYNGILAMVSHLVGGILPTCEPTVPYHTILFTEDRDIRHQEKHTTISNQAEDQDVQMMNENQIITNAKRKQSVVDPALRPKTCISEKETRRRRC

SEQ ID NO: 43388 - protein, 249 aa, Homo sapiens
  Payload ID: 8918
  Gene Symbol: KIAA0556
  Gene Name: KIAA0556
  ENSP ID: ENSP00000454884
  MOD_RES (1)..(1): Any amino acid
XLRKAERSWSCSREKKEGYAKDMVTDFDEKHDEYLILLQQRNRILKHLKSKDPVQLRLEHLEQGFSVYVNGANSELKSSPRKAIHSDFSRSASHTEGTHDYGRRTLFREAEEALRRSSRTAPSKVQRRGWHQKSVQIRTEAGPRLHIEPPVDYSDDFELCGDVTLQANNTSEDRPQDTKSPTSTKPCGFNFSLLNACGHSDPSSSVDKERILLTIQDVMELRRSLELSVNLQRKQKDCSSDEYDSIEED

SEQ ID NO: 43389 - protein, 55 aa, Homo sapiens
  Payload ID: 8918
  Gene Symbol: KIAA0556
  Gene Name: KIAA0556
  ENSP ID: ENSP00000455380
  MOD_RES (1)..(1): Any amino acid
XRSWSCSREKKEDIKAFEKQGPRAIEAGALGARFLCLCQRCQFGAEIITAESYSL

SEQ ID NO: 43390 - protein, 110 aa, Homo sapiens
  Payload ID: 8918
  Gene Symbol: KIAA0556
  Gene Name: KIAA0556
  ENSP ID: ENSP00000483214
EYLILLQQRNRILKHLKSKDPVQLRLEHLEQGFSVYVNGANSELKSSPRKAIHSDFSRSASHTEGTHDYGRRTLFREAEEALRRSSRTAPSKVQRRGWHQVWRLWPQPTL

SEQ ID NO: 43391 - protein, 1472 aa, Homo sapiens
  Payload ID: 8919
  Gene Symbol: KIAA0586
  Gene Name: KIAA0586
  Uniprot ID: Q9BVV6
  ENSP ID: ENSP00000261244
MKGSEVSLEKKKKIKMPVKRLREVVSQNHGDHLVLLKDELPCVPPALSANKRLPVGTGTSLNGTSRGSSDLTSARNCYQPLLENPMVSESDFSKDVAVQVLPLDKIEENNKQKANDIFISQYTMGQKDALRTVLKQKAQSMPVFKEVKVHLLEDAGIEKDAVTQETRISPSGIDSATTVAAATAAAIATAAPLIKVQSDLEAKVNSVTELLSKLQETDKHLQRVTEQQTSIQRKQEKLHCHDHEKQMNVFMEQHIRHLEKLQQQQIDIQTHFISAALKTSSFQPVSMPSSRAVEKYSVKPEHPNLGSCNPSLYNTFASKQAPLKEVEDTSFDKQKSPLETPAPRRFAPVPVSRDDELSKRENLLEEKENMEVSCHRGNVRLLEQILNNNDSLTRKSESSNTTSLTRSKIGWTPEKTNRFPSCEELETTKVTMQKSDDVLHDLGQKEKETNSMVQPKESLSMLKLPDLPQNSVKLQTTNTTRSVLKDAEKILRGVQNNKKVLEENLEAIIRAKDGAAMYSLINALSTNREMSEKIRIRKTVDEWIKTISAEIQGLLKATTVIQDEDYMLQVYGKPVYQGHRSTLKKGPYLRFNSPSPKSRPQRPKVIERVKGTKVKSIRTQTDFYATKPKKMDSKMKHSVPVLPHGDQQYLFSPSREMPTFSGTLEGHLIPMAILLGQTQSNSDTMPPAGVIVSKPHPVTVTTSIPPSSRKVETGVKKPNIAIVEMKSEKKDPPQLTVQVLPSVDIDSISNSSADVLSPLSSPKEASLPPVQTWIKTPEIMKVDEEEVKFPGTNFDEIIDVIQEEEKCDEIPDSEPILEFNRSVKADSTKYNGPPFPPVASTFQPTADILDKVIERKETLENSLIQWVEQEIMSRIISGLFPVQQQIAPSISVSVSETSEPLTSDIVEGTSSGALQLFVDAGVPVNSNVIKHFVNEALAETIAVMLGDREAKKQGPVATGVSGDASTNETYLPARVCTPLPTPQPTPPCSPSSPAKECVLVKTPDSSPCDSDHDMAFPVKEICAEKGDDMPAIMLVNTPTVTPTTTPPPAAAVFTPTLSDISIDKLKVSSPELPKPWGDGDLPLEEENPNSPQEELHPRAIVMSVAKDEEPESMDFPAQPPPPEPVPFMPFPAGTKAPSPSQMPGSDSSTLESTLSVTVTETETLDKPISEGEILFSCGQKLAPKILEDIGLYLTNLNDSLSSTLHDAVEMEDDPPSEGQVIRMSHKKFHADAILSFAKQNQESAVSQQAVYHSEDLENSVGELSEGQRPQLTAAAENILMGHSLYMQPPVTNTQSLDQQCDPKPLSRQFDTVSGSIYEDSCASHGPMSLGELELEPNSKLVLPTTLLTAQENDVNLPVAAEDFSQYQLKQNQDVKQVEHKPSQSYLRVRNKSDIAPSQQQVSPGDMDRTQIELNPYLTCVFSGGKAVPLSASQMPPAKMSVMLPSVNLEDCSQSLSLSTMQEDMESSGADTF

SEQ ID NO: 43392 - protein, 1644 aa, Homo sapiens
  Payload ID: 8919
  Gene Symbol: KIAA0586
  Gene Name: KIAA0586
  Uniprot ID: Q9BVV6
  ENSP ID: ENSP00000346359
MFWCGTCFVTNNMKGSEVSLEKKKKIKMPVKRLREVVSQNHGDHLVLLKDELPCVPPALSANKRLPVGTGTSLNGTSRGSSDLTSARNCYQPLLENPMVSESDFSKDVAVQVLPLDKIEENNKQKANDIFISQYTMGQKDALRTVLKQNVSLCLTGWSDHSGVITTHCSLYLLRLMRSSHLSLPSSWDYRAQSMPVFKEVKVHLLEDAGIEKDAVTQETRISPSGIDSATTVAAATAAAIATAAPLIKVQSDLEAKVNSVTELLSKLQETDKHLQRVTEQQTSIQRKQEKLHCHDHEKQMNVFMEQHIRHLEKLQQQQIDIQTHFISAALKTSSFQPVSMPSSRAVEKYSVKPEHPNLGSCNPSLYNTFASKQAPLKEVEDTSFDKQKSPLETPAPRRFAPVPVSRDDELSKRENLLEEKENMEVSCHRGNVRLLEQILNNNDSLTRKSESSNTTSLTRSKIGWTPEKTNRFPSCEELETTKVTMQKSDDVLHDLGQKEKETNSMVQPKESLSMLKLPDLPQNSVKLQTTNTTRSVLKDAEKILRGVQNNKKVLEENLEAIIRAKDGAAMYSLINALSTNREMSEKIRIRKTVDEWIKTISAEIQDELSRTDYEQKRFDQKNQRTKKGQNMTKDIRTNTQDKTVNKSVIPRKHSQKQIEEHFRNLPMRGMPASSLQKERKEGLLKATTVIQDEDYMLQVYGKPVYQGHRSTLKKGPYLRFNSPSPKSRPQRPKVIERVKGTKVKSIRTQTDFYATKPKKMDSKMKHSVPVLPHGDQQYLFSPSREMPTFSGTLEGHLIPMAILLGQTQSNSDTMPPAGVIVSKPHPVTVTTSIPPSSRKVETGVKKPNIAIVEMKSEKKDPPQLTVQVLPSVDIDSISNSSADVLSPLSSPKEASLPPVQTWIKTPEIMKVDEEEVKFPGTNFDEIIDVIQEEEKCDEIPDSEPILEFNRSVKADSTKYNGPPFPPVASTFQPTADILDKVIERKETLENSLIQWVEQEIMSRIISGLFPVQQQIAPSISVSVSETSEPLTSDIVEGTSSGALQLFVDAGVPVNSNVIKHFVNEALAETIAVMLGDREAKKQGPVATGVSGDASTNETYLPARVCTPLPTPQPTPPCSPSSPAKECVLVKTPDSSPCDSDHDMAFPVKEICAEKGDDMPAIMLVNTPTVTPTTTPPPAAAVFTPTLSDISIDKLKVSSPELPKPWGDGDLPLEEENPNSPQEELHPRAIVMSVAKDEEPESMDFPAQPPPPEPVPFMPFPAGTKAPSPSQMPGSDSSTLESTLSVTVTETETLDKPISEGEILFSCGQKLAPKILEDIGLYLTNLNDSLSSTLHDAVEMEDDPPSEGQVIRMSHKKFHADAILSFAKQNQESAVSQQAVYHSEDLENSVGELSEGQRPQLTAAAENILMGHSLYMQPPVTNTQSLDQQCDPKPLSRQFDTVSGSIYEDSCASHGPMSLGELELEPNSKLVLPTTLLTAQENDVNLPVAAEDFSQYQLKQNQDVKQVEHKPSQSYLRVRNKSDIAPSQQQVSPGDMDRTQIELNPYLTCVFSGLGVHVKKVSCIGKLGLWRFVIQIISSPRWESSATLRFTDAPCQDVSDAAVSEPRGLLSVSESQHNAGGHGVFGGRYLLNGKRQPAQCLCHWF

SEQ ID NO: 43393 - protein, 1504 aa, Homo sapiens
  Payload ID: 8919
  Gene Symbol: KIAA0586
  Gene Name: KIAA0586
  Uniprot ID: Q9BVV6
  ENSP ID: ENSP00000399427
MVSESDFSKDVAVQVLPLDKIEENNKQKANDIFISQYTMGQKDALRTVLKQNVSLCLTGWSDHSGVITTHCSLYLLRLMRSSHLSLPSSWDYRAQSMPVFKEVKVHLLEDAGIEKDAVTQETRISPSGIDSATTVAAATAAAIATAAPLIKVQSDLEAKVNSVTELLSKLQETDKHLQRVTEQQTSIQRKQEKLHCHDHEKQMNVFMEQHIRHLEKLQQQQIDIQTHFISAALKTSSFQPVSMPSSRAVEKYSVKPEHPNLGSCNPSLYNTFASKQAPLKEVEDTSFDKQKSPLETPAPRRFAPVPVSRDDELSKRENLLEEKENMEVSCHRGNVRLLEQILNNNDSLTRKSESSNTTSLTRSKIGWTPEKTNRFPSCEELETTKVTMQKSDDVLHDLGQKEKETNSMVQPKESLSMLKLPDLPQNSVKLQTTNTTRSVLKDAEKILRGVQNNKKVLEENLEAIIRAKDGAAMYSLINALSTNREMSEKIRIRKTVDEWIKTISAEIQDELSRTDYEQKRFDQKNQRTKKGQNMTKDIRTNTQDKTVNKSVIPRKHSQKQIEEHFRNLPMRGMPASSLQKERKEGLLKATTVIQDEDYMLQVYGKPVYQGHRSTLKKGPYLRFNSPSPKSRPQRPKVIERVKGTKVKSIRTQTDFYATKPKKMDSKMKHSVPVLPHGDQQYLFSPSREMPTFSGTLEGHLIPMAILLGQTQSNSDTMPPAGVIVSKPHPVTVTTSIPPSSRKVETGVKKPNIAIVEMKSEKKDPPQLTVQVLPSVDIDSISNSSADVLSPLSSPKEASLPPVQTWIKTPEIMKVDEEEVKFPGTNFDEIIDVIQEEEKCDEIPDSEPILEFNRSVKADSTKYNGPPFPPVASTFQPTADILDKVIERKETLENSLIQWVEQEIMSRIISGLFPVQQQIAPSISVSVSETSEPLTSDIVEGTSSGALQLFVDAGVPVNSNVIKHFVNEALAETIAVMLGDREAKKQGPVATGVSGDASTNETYLPARVCTPLPTPQPTPPCSPSSPAKECVLVKTPDSSPCDSDHDMAFPVKEICAEKGDDMPAIMLVNTPTVTPTTTPPPAAAVFTPTLSDISIDKLKVSSPELPKPWGDGDLPLEEENPNSPQEELHPRAIVMSVAKDEEPESMDFPAQPPPPEPVPFMPFPAGTKAPSPSQMPGSDSSTLESTLSVTVTETETLDKPISEGEILFSCGQKLAPKILEDIGLYLTNLNDSLSSTLHDAVEMEDDPPSEGQVIRMSHKKFHADAILSFAKQNQESAVSQQAVYHSEDLENSVGELSEGQRPQLTAAAENILMGHSLYMQPPVTNTQSLDQQCDPKPLSRQFDTVSGSIYEDSCASHGPMSLGELELEPNSKLVLPTTLLTAQENDVNLPVAAEDFSQYQLKQNQDVKQVEHKPSQSYLRVRNKSDIAPSQQQVSPGDMDRTQIELNPYLTCVFSGGKAVPLSASQMPPAKMSVMLPSVNLEDCSQSLSLSTMQEDMESSGADTF

SEQ ID NO: 43394 - protein, 234 aa, Homo sapiens
  Payload ID: 8919
  Gene Symbol: KIAA0586
  Gene Name: KIAA0586
  ENSP ID: ENSP00000450855
MVSESDFSKDVAVQVLPLDKIEENNKQKANDIFISQYTMGQKDALRTVLKQKAQSMPVFKEVKVHLLEDAGIEKDAVTQETRISPSGIDSATTVAAATAAAIATAAPLIKVQSDLEAKVNSVTELLSKLQETDKHLQRVTEQQTSIQRKQEKLHCHDHEKQMNVFMEQHIRHLEKLQQQQIDIQTHFISAALKTSSFQPVSMPSSRAVEKYSVKPEHPNLGSCNPSLYNTFASK

SEQ ID NO: 43395 - protein, 208 aa, Homo sapiens
  Payload ID: 8919
  Gene Symbol: KIAA0586
  Gene Name: KIAA0586
  ENSP ID: ENSP00000451356
SLSSTLHDAVEMDLENSVGELSEGQRPQLTAAAENILMGHSLYMQPPVTNTQSLDQQCDPKPLSRQFDTVSGSIYEDSCASHGPMSLGELELEPNSKLVLPTTLLTAQENDVNLPVAAEDFSQYQLKQNQDVKQVEHKPSQSYLRVRNKSDIAPSQQQGGKAVPLSASQMPPAKMSVMLPSVNLEDCSQSLSLSTMQEDMESSGADTF

SEQ ID NO: 43396 - protein, 132 aa, Homo sapiens
  Payload ID: 8919
  Gene Symbol: KIAA0586
  Gene Name: KIAA0586
  ENSP ID: ENSP00000451831
MVSESDFSKDVAVQVLPLDKIEENNKQKANDIFISQYTMGQKDALRTVLKQKAQSMPVFKEVKVHLLEDAGIEKDAVTQETRISPSGIDSATTVAAATAAAIATAAPLIKVQSDLEAKVNSVTELLSKLQET

SEQ ID NO: 43397 - protein, 1504 aa, Homo sapiens; identical to SEQ ID NO: 43393
  Payload ID: 8919
  Gene Symbol: KIAA0586
  Gene Name: KIAA0586
  Uniprot ID: Q9BVV6
  ENSP ID: ENSP00000452351

SEQ ID NO: 43398 - protein, 89 aa, Homo sapiens
  Payload ID: 8919
  Gene Symbol: KIAA0586
  Gene Name: KIAA0586
  ENSP ID: ENSP00000452536
MVSESDFSKDVAVQVLPLDKIEENNKQKANDIFISQYTMGQKDALRTVLKQKDRVCHVAQLVLNSWAQAVFLPQPPTVLGLQSSKHACF

SEQ ID NO: 43399 - protein, 1533 aa, Homo sapiens
  Payload ID: 8919
  Gene Symbol: KIAA0586
  Gene Name: KIAA0586
  Uniprot ID: Q9BVV6
  ENSP ID: ENSP00000478083
MPVKRLREVVSQNHGDHLVLLKDELPCVPPALSANKRLPVGTGTSLNGTSRGSSDLTSARNCYQPLLENPMVSESDFSKDVAVQVLPLDKIEENNKQKANDIFISQYTMGQKDALRTVLKQKAQSMPVFKEVKVHLLEDAGIEKDAVTQETRISPSGIDSATTVAAATAAAIATAAPLIKVQSDLEAKVNSVTELLSKLQETDKHLQRVTEQQTSIQRKQEKLHCHDHEKQMNVFMEQHIRHLEKLQQQQIDIQTHFISAALKTSSFQPVSMPSSRAVEKYSVKPEHPNLGSCNPSLYNTFASKQAPLKEVEDTSFDKQKSPLETPAPRRFAPVPVSRDDELSKRENLLEEKENMEVSCHRGNVRLLEQILNNNDSLTRKSESSNTTSLTRSKIGWTPEKTNRFPSCEELETTKVTMQKSDDVLHDLGQKEKETNSMVQPKESLSMLKLPDLPQNSVKLQTTNTTRSVLKDAEKILRGVQNNKKVLEENLEAIIRAKDGAAMYSLINALSTNREMSEKIRIRKTVDEWIKTISAEIQDELSRTDYEQKRFDQKNQRTKKGQNMTKDIRTNTQDKTVNKSVIPRKHSQKQIEEHFRNLPMRGMPASSLQKERKEGLLKATTVIQDEDYMLQVYGKPVYQGHRSTLKKGPYLRFNSPSPKSRPQRPKVIERVKGTKVKSIRTQTDFYATKPKKMDSKMKHSVPVLPHGDQQYLFSPSREMPTFSGTLEGHLIPMAILLGQTQSNSDTMPPAGVIVSKPHPVTVTTSIPPSSRKVETGVKKPNIAIVEMKSEKKDPPQLTVQVLPSVDIDSISNSSADVLSPLSSPKEASLPPVQTWIKTPEIMKVDEEEVKFPGTNFDEIIDVIQEEEKCDEIPDSEPILEFNRSVKADSTKYNGPPFPPVASTFQPTADILDKVIERKETLENSLIQWVEQEIMSRIISGLFPVQQQIAPSISVSVSETSEPLTSDIVEGTSSGALQLFVDAGVPVNSNVIKHFVNEALAETIAVMLGDREAKKQGPVATGVSGDASTNETYLPARVCTPLPTPQPTPPCSPSSPAKECVLVKTPDSSPCDSDHDMAFPVKEICAEKGDDMPAIMLVNTPTVTPTTTPPPAAAVFTPTLSDISIDKLKVSSPELPKPWGDGDLPLEEENPNSPQEELHPRAIVMSVAKDEEPESMDFPAQPPPPEPVPFMPFPAGTKAPSPSQMPGSDSSTLESTLSVTVTETETLDKPISEGEILFSCGQKLAPKILEDIGLYLTNLNDSLSSTLHDAVEMEDDPPSEGQVIRMSHKKFHADAILSFAKQNQESAVSQQAVYHSEDLENSVGELSEGQRPQLTAAAENILMGHSLYMQPPVTNTQSLDQQCDPKPLSRQFDTVSGSIYEDSCASHGPMSLGELELEPNSKLVLPTTLLTAQENDVNLPVAAEDFSQYQLKQNQDVKQVEHKPSQSYLRVRNKSDIAPSQQQVSPGDMDRTQIELNPYLTCVFSGGKAVPLSASQMPPAKMSVMLPSVNLEDCSQSLSLSTMQEDMESSGADTF

SEQ ID NO: 43400 - protein, 1463 aa, Homo sapiens
  Payload ID: 8919
  Gene Symbol: KIAA0586
  Gene Name: KIAA0586
  ENSP ID: ENSP00000481936
MVSESDFSKDVAVQVLPLDKIEENNKQKANDIFISQYTMGQKDALRTVLKQKAQSMPVFKEVKVHLLEDAGIEKDAVTQETRISPSGIDSATTVAAATAAAIATAAPLIKVQSDLEAKVNSVTELLSKLQETDKHLQRVTEQQTSIQRKQEKLHCHDHEKQMNVFMEQHIRHLEKLQQQQIDIQTHFISAALKTSSFQPVSMPSSRAVEKYSVKPEHPNLGSCNPSLYNTFASKQAPLKEVEDTSFDKQKSPLETPAPRRFAPVPVSRDDELSKRENLLEEKENMEVSCHRGNVRLLEQILNNNDSLTRKSESSNTTSLTRSKIGWTPEKTNRFPSCEELETTKVTMQKSDDVLHDLGQKEKETNSMVQPKESLSMLKLPDLPQNSVKLQTTNTTRSVLKDAEKILRGVQNNKKVLEENLEAIIRAKDGAAMYSLINALSTNREMSEKIRIRKTVDEWIKTISAEIQDELSRTDYEQKRFDQKNQRTKKGQNMTKDIRTNTQDKTVNKSVIPRKHSQKQIEEHFRNLPMRGMPASSLQKERKEGLLKATTVIQDEDYMLQVYGKPVYQGHRSTLKKGPYLRFNSPSPKSRPQRPKVIERVKGTKVKSIRTQTDFYATKPKKMDSKMKHSVPVLPHGDQQYLFSPSREMPTFSGTLEGHLIPMAILLGQTQSNSDTMPPAGVIVSKPHPVTVTTSIPPSSRKVETGVKKPNIAIVEMKSEKKDPPQLTVQVLPSVDIDSISNSSADVLSPLSSPKEASLPPVQTWIKTPEIMKVDEEEVKFPGTNFDEIIDVIQEEEKCDEIPDSEPILEFNRSVKADSTKYNGPPFPPVASTFQPTADILDKVIERKETLENSLIQWVEQEIMSRIISGLFPVQQQIAPSISVSVSETSEPLTSDIVEGTSSGALQLFVDAGVPVNSNVIKHFVNEALAETIAVMLGDREAKKQGPVATGVSGDASTNETYLPARVCTPLPTPQPTPPCSPSSPAKECVLVKTPDSSPCDSDHDMAFPVKEICAEKGDDMPAIMLVNTPTVTPTTTPPPAAAVFTPTLSDISIDKLKVSSPELPKPWGDGDLPLEEENPNSPQEELHPRAIVMSVAKDEEPESMDFPAQPPPPEPVPFMPFPAGTKAPSPSQMPGSDSSTLESTLSVTVTETETLDKPISEGEILFSCGQKLAPKILEDIGLYLTNLNDSLSSTLHDAVEMEDDPPSEGQVIRMSHKKFHADAILSFAKQNQESAVSQQAVYHSEDLENSVGELSEGQRPQLTAAAENILMGHSLYMQPPVTNTQSLDQQCDPKPLSRQFDTVSGSIYEDSCASHGPMSLGELELEPNSKLVLPTTLLTAQENDVNLPVAAEDFSQYQLKQNQDVKQVEHKPSQSYLRVRNKSDIAPSQQQVSPGDMDRTQIELNPYLTCVFSGGKAVPLSASQMPPAKMSVMLPSVNLEDCSQSLSLSTMQEDMESSGADTF

SEQ ID NO: 43401 - protein, 967 aa, Homo sapiens
  Payload ID: 8920
  Gene Symbol: KIAA0753
  Gene Name: KIAA0753
  Uniprot ID: Q2KHM9
  ENSP ID: ENSP00000355250
MGPGQPASTCVHLAPRTQLDGRSDPKVLQTQNQLQFNRNVPTHSSNLAIRYSCPHAIRIEKLKHSYNESYHCKDADCRVGPDLGSSVSFSVISQERLSYAVHLARRDVKRRQFEKHIKEHHLRSQPQSSQKCGHTKYKIPDHRVERKESKSQAACQCSHQPSKVEISSSGAKVYLYSSHPGQSDLTVPNSPPTHDPGLQPHPRIGDHKNISEQKSLLEVQRLQKELSSCIHKIEEVTKKDRLEEALDPDEERRIRIRRQEQAARSARMLYVLQQQVKEIQEELDKLSPHKIKHTKKSWAMSKLAAAHRGAIRALQMFVTQFTDRGEHPLPARCKELGSLIRQLSLCSVKLDADPSVPDVVIDILQQIEALESLLEKKLSPKKVKKCFSEIRSRFPIGSQKALERWPSTSPKGERRPLTAKDTFPQETSRPSVAKQLLADKYQPDTELPETQRLQSELDVLDADIVLEEGPFILDQSASFKDEVLAVAKTKAGKKKPVTENVPFRKKDTLAPARQQGLRKAERGRQSQPHSKSRVQQTTVSSRLKMNRQPVKDRKAPWIPPNPTSPPASPKCAAWLKVKTSPRDATKEPLQQEDPQEESHLTGAVEHEAARLAWLDAETSKRLKELEELKAKEIDSMQKQRLDWLDAETSRRTKELNELKAEEMYRLQQLSVSATHLADKVEEAVLDRLKPLLVKAQRVNSTTEANIHLKDGSSVNTAKAQPAQEVAAVDFESNNIRQLDDFLEDCASELWAVTHAKILGSETLATVEDSKDSPDLEIMMRRMEEMEKYQESVRQRYNKIAYADPRLWMQEENNDQKISAISEKPLSPHPIRITKTVDRKDPAVNIMLERPCNGNSLDESVGTEEGSEKREAPLLSLAEDSQQKEGRAPLFVPPGMQHSIGDYCSRFEQYLRIISHEAVGSFNPWLIAESFSEELVDEALGAVAAELQDMCEDYAEAVFTSEFLEAAT

SEQ ID NO: 43402 - protein, 45 aa, Homo sapiens
  Payload ID: 8920
  Gene Symbol: KIAA0753
  Gene Name: KIAA0753
  ENSP ID: ENSP00000444946
  MOD_RES (1)..(1): Any amino acid
XKALERWPSTSPKGERRPLTAKDTFPQETSRPSVAKQLLAGTPQS

SEQ ID NO: 43403 - protein, 72 aa, Homo sapiens
  Payload ID: 8920
  Gene Symbol: KIAA0753
  Gene Name: KIAA0753
  ENSP ID: ENSP00000458247
MGPGQPASTCVHLAPRTQLDGRSDPKVLQTQNQLQFNRNVPTHSSNLAIRYSCPHAIRIEKLKHSYNESYHC

SEQ ID NO: 43404 - protein, 87 aa, Homo sapiens
  Payload ID: 8920
  Gene Symbol: KIAA0753
  Gene Name: KIAA0753
  ENSP ID: ENSP00000458983
MGPGQPASTCVHLAPRTQLDGRSDPKVLQTQNQLQFNRNVPTHSSNLAIRYSCPHAIRIEKLKHSYNESYHCKDADCRVGPDLGSSV

SEQ ID NO: 43405 - protein, 69 aa, Homo sapiens
  Payload ID: 8920
  Gene Symbol: KIAA0753
  Gene Name: KIAA0753
  ENSP ID: ENSP00000459530
LTVPNSPPTHDPGLQPHPRIGDHKNISEQKSLLEVQRLQKELSSCIHKIEEVTKKVLILHCCRRDCSKT

SEQ ID NO: 43406 - protein, 668 aa, Homo sapiens
  Payload ID: 8920
  Gene Symbol: KIAA0753
  Gene Name: KIAA0753
  Uniprot ID: Q2KHM9
  ENSP ID: ENSP00000460050
MSKLAAAHRGAIRALQMFVTQFTDRGEHPLPARCKELGSLIRQLSLCSVKLDADPSVPDVVIDILQQIEALESLLEKKLSPKKVKKCFSEIRSRFPIGSQKALERWPSTSPKGERRPLTAKDTFPQETSRPSVAKQLLADKYQPDTELPETQRLQSELDVLDADIVLEEGPFILDQSASFKDEVLAVAKTKAGKKKPVTENVPFRKKDTLAPARQQGLRKAERGRQSQPHSKSRVQQTTVSSRLKMNRQPVKDRKAPWIPPNPTSPPASPKCAAWLKVKTSPRDATKEPLQQEDPQEESHLTGAVEHEAARLAWLDAETSKRLKELEELKAKEIDSMQKQRLDWLDAETSRRTKELNELKAEEMYRLQQLSVSATHLADKVEEAVLDRLKPLLVKAQRVNSTTEANIHLKDGSSVNTAKAQPAQEVAAVDFESNNIRQLDDFLEDCASELWAVTHAKILGSETLATVEDSKDSPDLEIMMRRMEEMEKYQESVRQRYNKIAYADPRLWMQEENNDQKISAISEKPLSPHPIRITKTVDRKDPAVNIMLERPCNGNSLDESVGTEEGSEKREAPLLSLAEDSQQKEGRAPLFVPPGMQHSIGDYCSRFEQYLRIISHEAVGSFNPWLIAESFSEELVDEALGAVAAELQDMCEDYAEAVFTSEFLEAAT

SEQ ID NO: 43407 - protein, 129 aa, Homo sapiens
  Payload ID: 8920
  Gene Symbol: KIAA0753
  Gene Name: KIAA0753
  ENSP ID: ENSP00000460156
RLWMQEENNDQKISAISEKPLSPHPIRITKTVDRKDPAVNIMLERPCNGNSLDESVGTEEGSEKREAPLLSLAEDSQQKEGRAPLFVPPGMQHSIGDYCSRFEQYLRIISHEAVGSFNPWLIAERQSEM

SEQ ID NO: 43408 - protein, 248 aa, Homo sapiens
  Payload ID: 8920
  Gene Symbol: KIAA0753
  Gene Name: KIAA0753
  ENSP ID: ENSP00000460816
MGPGQPASTCVHLAPRTQLDGRSDPKVLQTQNQLQFNRNVPTHSSNLAIRYSCPHAIRIEKLKHSYNESYHCKDADCRVGPDLGSSVSFSVISQERLSYAVHLARRDVKRRQFEKHIKEHHLRSQPQSSQKCGHTKYKIPDHRVERKESKSQAACQCSHQPSKVEISSSGAKVYLYSSHPGQSDLTVPNSPPTHDPGLQPHPRIGDHKNISEQKSLLEVQRLQKELSSCIHKIEEVTKKGKRNPGRIG

SEQ ID NO: 43409 - protein, 324 aa, Homo sapiens
  Payload ID: 8921
  Gene Symbol: KIAA0825
  Gene Name: KIAA0825
  Uniprot ID: Q8IV33
  ENSP ID: ENSP00000331385
MDWDDEYSHNSFDLHCLLNSFPGDLEFEQIFSDIDEKIEQNAASIKHCIKEIQSEINKQCPGVQLQTTTDCFEWLTNYNYSTSESSFISHGDLIKFFKTLQDLLKNEQNQEEMTLDLLWDLSCHSSVSFPSTLSGTSFHFLSRTSLHSVEDNSSMDVKSMWDDIRLHLRRFLVSKLQSHNEINNSQQKILLKKQCLQQLLFLYPESEVIIKYQNIQNKLLANLLWNCFPSYNRDSNLDVIAHGYQSTMLKLYSVIKEDFNTLCEILAPSSMVKFIKETYLDTVTEEMAKFLENFCELQFRENAVRVVKTSKSSSKHRGAVHALG

SEQ ID NO: 43410 - protein, 1237 aa, Homo sapiens
  Payload ID: 8921
  Gene Symbol: KIAA0825
  Gene Name: KIAA0825
  ENSP ID: ENSP00000400288
MDWDDEYSHNSFDLHCLLNSFPGDLEFEQIFSDIDEKIEQNAASIKHCIKEIQSEINKQCPGVQLQTTTDCFEWLTNYNYSTSESSFISHGDLIKFFKTLQDLLKNEQNQEEMTLDLLWDLSCHSSVSFPSTLSGTSFHFLSRTSLHSVEDNSSMDVKSMWDDIRLHLRRFLVSKLQSHNEINNSQQKILLKKQCLQQLLFLYPESEVIIKYQNIQNKLLANLLWNCFPSYNRDSNLDVIAHGYQSTMLKLYSVIKEDFNTLCEILAPSSMVKFIKETYLDTVTEEMAKFLENFCELQFRENAVRVVKTSKSSSKHRGAVHALVTTECPQKGRNFSLPLDKVEFLSQLIKSFMKLEKGVQELFDEILLSLKITRDTSGILEKSDREVVMEKPRANETNIPSEQSLPGKEATLLDFGWRSAFKEVSLPMAHCVVTAIEGFSTKILQQEQNERSSAVSYAMNLVNVQQVWQDSHMFPEEEQPKKIGKFCSDIMEKLDTMLPLALACRDDSFQEIRANLVEACCKVATAVLQRLQERAKEVPSKAPLKNLHTYLSTAVYVFQHFKRYDNLMKEMTKKPIFLVLVQRYQEFINTLQFQVTNYCVRVCATSILQDAESHHWDDYKAFYEGERCSFSIQMWHYFCWSLHYDLWTILPPKLAQEILVEVLEKSLSLLASRYARAHPSRKRTPQLRLDVTTILICTENMLWSVCTSVQKLLNPHQHTDDKIFKIHTHCNNLFTTLVILTSPLTELYKTFQHGLDESASDSLKSFFKQPLYWVSCISHFYPSLLRTPSAGGLKAEGQLKLLLSQPRCNWNLLLETLLHHDGLLLRILLKSSKQVSDTENNLNQGPSLMEAIFKILYHCSFSPQTFANVFVSYMEEEQLWDFLYNIPVSTCVEYELEVIRCLRLALTDAIKDTVQQIVSVMSSRRNCETNLNKHIVPDCLLESMPKEWNYSPKETNRKESCKSFTRLTAQAVSIVISKLPTVIACLPPPVKYFFFLSERKMSKKFVELKKAGLLVWNLIVIICRIFEDGNTVELLTGASLDRWSKEKLGLICMCLKSIMGDQTSIHNQMIQKVIQSIEQQKPNWIERQLLKARKLSTECAFMTIEKSTALQEGDVALELTEQKINTMVLDLCHKPGGREYLRQIYHIMQLNEEYLKEQLFSMNSSEEKPLPIRPLKTTLRSIEDQPSAFNPFHVYKAFSENMLDQVSITKWNWNWAKLLPNYLRLDKMTFSVLLKNR

SEQ ID NO: 43411 - protein, 1275 aa, Homo sapiens
  Payload ID: 8921
  Gene Symbol: KIAA0825
  Gene Name: KIAA0825
  ENSP ID: ENSP00000424618
MDWDDEYSHNSFDLHCLLNSFPGDLEFEQIFSDIDEKIEQNAASIKHCIKEIQSEINKQCPGVQLQTTTDCFEWLTNYNYSTSESSFISHGDLIKFFKTLQDLLKNEQNQEEMTLDLLWDLSCHSSVSFPSTLSGTSFHFLSRTSLHSVEDNSSMDVKSMWDDIRLHLRRFLVSKLQSHNEINNSQQKILLKKQCLQQLLFLYPESEVIIKYQNIQNKLLANLLWNCFPSYNRDSNLDVIAHGYQSTMLKLYSVIKEDFNTLCEILAPSSMVKFIKETYLDTVTEEMAKFLENFCELQFRENAVRVVKTSKSSSKHRGAVHALVTTECPQKGRNFSLPLDKVEFLSQLIKSFMKLEKGVQELFDEILLSLKITRDTSGILEKSDREVVMEKPRANETNIPSEQSLPGKEATLLDFGWRSAFKEVSLPMAHCVVTAIEGFSTKILQQEQNERSSAVSYAMNLVNVQQVWQDSHMFPEEEQPKKIGKFCSDIMEKLDTMLPLALACRDDSFQEIRANLVEACCKVATAVLQRLQERAKEVPSKAPLKNLHTYLSTAVYVFQHFKRYDNLMKEMTKKPIFLVLVQRYQEFINTLQFQVTNYCVRVCATSILQDAESHHWDDYKAFYEGERCSFSIQMWHYFCWSLHYDLWTILPPKLAQEILVEVLEKSLSLLASRYARAHPSRKRTPQLRLDVTTILICTENMLWSVCTSVQKLLNPHQHTDDKIFKIHTHCNNLFTTLVILTSPLTELYKTFQHGLDESASDSLKSFFKQPLYWVSCISHFYPSLLRTPSAGGLKAEGQLKLLLSQPRCNWNLLLETLLHHDGLLLRILLKSSKQVSDTENNLNQGPSLMEAIFKILYHCSFSPQTFANVFVSYMEEEQLWDFLYNIPVSTCVEYELEVIRCLRLALTDAIKDTVQQIVSVMSSRRNCETNLNKHIVPDCLLESMPKEWNYSPKETNRKESCKSFTRLTAQAVSIVISKLPTVIACLPPPVKYFFFLSERKMSKKFVELKKAGLLVWNLIVIICRIFEDGNTVELLTGASLDRWSKEKLGLICMCLKSIMGDQTSIHNQMIQKVIQSIEQQKPNWIERQLLKARKLSTECAFMTIEKSTALQEGDVALELTEQKINTMVLDLCHKPGGREYLRQIYHIMQLNEEYLKEQLFSMNSSEEKPLPIRPLKTTLRSIEDQPSAFNPFHVYKAFSENMLDQSAITKWNWNWAKLLPNYLRLDKMTFSVLLKNRWEMKKDETLEEEEKAILEHLKQICTPQNSSASDNIEEQ

SEQ ID NO: 43412 - protein, 520 aa, Homo sapiens
  Payload ID: 8922
  Gene Symbol: KIAA0895
  Gene Name: KIAA0895
  Uniprot ID: Q8NCT3
  ENSP ID: ENSP00000297063
MAGCTRKLTHLRKRIHRPRRRTTRRWKRWFKFRKRKGEKRPRPNHKAVARRAKLKFSTSEKLHWPEQELAKKSILNAEDSLIIDNKRSISHLSSGVLKDIFTTGTSSYNVLLQSKEEKKYHSQKQSSSTYSKRCRKPSKSPNTSRSKDPRRMKALVPVTSSGTWYCLERRPAVFVTSSVSSPVKFTHDISVTGNGIVLPPKPKSKVKWCHFSTLPKPKPQLSRSFEKGDDFSGKKFCILTAIKPTNLEKEKLRFFKSDYTYNPQFEYANPALPSVLAKHSHASDRFLKQIVVHLTEDLLSRASMTVVNGCPTLTINVSTAREHWLEGMLRHEIGTHYFRGINNLQQPWNSWTGRKKHELKPNNPTEEGLASIHSVLFRKDPFLWRAALLYYTVYQASQMSFCELFKDIGRFVKDPNTRWDYCVRAKRGWTDTSQPGCFSKDQVYLDGILQILRYRDTIDFHLLTALGKVSYEDVDRLKGLAVTENMRVPHFLQDHGRYMEHLEKIMEVNELTDRELKDLI

SEQ ID NO: 43413 - protein, 469 aa, Homo sapiens
  Payload ID: 8922
  Gene Symbol: KIAA0895
  Gene Name: KIAA0895
  Uniprot ID: Q8NCT3
  ENSP ID: ENSP00000319251
MLESIRVTEKLHWPEQELAKKSILNAEDSLIIDNKRSISHLSSGVLKDIFTTGTSSYNVLLQSKEEKKYHSQKQSSSTYSKRCRKPSKSPNTSRSKDPRRMKALVPVTSSGTWYCLERRPAVFVTSSVSSPVKFTHDISVTGNGIVLPPKPKSKVKWCHFSTLPKPKPQLSRSFEKGDDFSGKKFCILTAIKPTNLEKEKLRFFKSDYTYNPQFEYANPALPSVLAKHSHASDRFLKQIVVHLTEDLLSRASMTVVNGCPTLTINVSTAREHWLEGMLRHEIGTHYFRGINNLQQPWNSWTGRKKHELKPNNPTEEGLASIHSVLFRKDPFLWRAALLYYTVYQASQMSFCELFKDIGRFVKDPNTRWDYCVRAKRGWTDTSQPGCFSKDQVYLDGILQILRYRDTIDFHLLTALGKVSYEDVDRLKGLAVTENMRVPHFLQDHGRYMEHLEKIMEVNELTDRELKDLI

SEQ ID NO: 43414 - protein, 507 aa, Homo sapiens
  Payload ID: 8922
  Gene Symbol: KIAA0895
  Gene Name: KIAA0895
  Uniprot ID: Q8NCT3
  ENSP ID: ENSP00000344805
MVATGWARRSGLHPAPRPLRGAQEALAKNLWREERNRPLILSSLIIKKLHWPEQELAKKSILNAEDSLIIDNKRSISHLSSGVLKDIFTTGTSSYNVLLQSKEEKKYHSQKQSSSTYSKRCRKPSKSPNTSRSKDPRRMKALVPVTSSGTWYCLERRPAVFVTSSVSSPVKFTHDISVTGNGIVLPPKPKSKVKWCHFSTLPKPKPQLSRSFEKGDDFSGKKFCILTAIKPTNLEKEKLRFFKSDYTYNPQFEYANPALPSVLAKHSHASDRFLKQIVVHLTEDLLSRASMTVVNGCPTLTINVSTAREHWLEGMLRHEIGTHYFRGINNLQQPWNSWTGRKKHELKPNNPTEEGLASIHSVLFRKDPFLWRAALLYYTVYQASQMSFCELFKDIGRFVKDPNTRWDYCVRAKRGWTDTSQPGCFSKDQVYLDGILQILRYRDTIDFHLLTALGKVSYEDVDRLKGLAVTENMRVPHFLQDHGRYMEHLEKIMEVNELTDRELKDLI

SEQ ID NO: 43415 - protein, 417 aa, Homo sapiens
  Payload ID: 8922
  Gene Symbol: KIAA0895
  Gene Name: KIAA0895
  Uniprot ID: Q8NCT3
  ENSP ID: ENSP00000389985
MKALVPVTSSGTWYCLERRPAVFVTSSVSSPVKFTHDISVTGNGIVLPPKPKSKVKWCHFSTLPKPKPQLSRSFEKGDDFSGKKFCILTAIKPTNLEKEKLRFFKSDYTYNPQFEYANPALPSVLAKHSHASDRFLKQSINIMELTLQKYGSYEKFEQATGGSLLSKTRIWSHVRKYMMKEGCLGEIVVHLTEDLLSRASMTVVNGCPTLTINVSTAREHWLEGMLRHEIGTHYFRGINNLQQPWNSWTGRKKHELKPNNPTEEGLASIHSVLFRKDPFLWRAALLYYTVYQASQMSFCELFKDIGRFVKDPNTRWDYCVRAKRGWTDTSQPGCFSKDQVYLDGILQILRYRDTIDFHLLTALGKVSYEDVDRLKGLAVTENMRVPHFLQDHGRYMEHLEKIMEVNELTDRELKDLI

SEQ ID NO: 43416 - protein, 275 aa, Homo sapiens
  Payload ID: 8922
  Gene Symbol: KIAA0895
  Gene Name: KIAA0895
  ENSP ID: ENSP00000390183
MELTLQKYGSYEKFEQATGGSLLSKTRIWSHVRKYMMKEGCLGEIVVHLTEDLLSRASMTVVNGCPTLTINVSTAREHWLEGMLRHEIGTHYFRGINNLQQPWNSWTGRKKHELKPNNPTEEGLASIHSVLFRKDPFLWRAALLYYTVYQASQMSFCELFKDIGRFVKDPNTRWDYCVRAKRGWTDTSQPGCFSKDQVYLDGILQILRYRDTIDFHLLTALGKVSYEDVDRLKGLAVTENMRVPHFLQDHGRYMEHLEKIMEVNELTDRELKDLI

SEQ ID NO: 43417 - protein, 141 aa, Homo sapiens
  Payload ID: 8922
  Gene Symbol: KIAA0895
  Gene Name: KIAA0895
  ENSP ID: ENSP00000390527
MAGCTRKLTHLRKRIHRPRRRTTRRWKRWFKFRKRKGEKRPRPNHKAVARRAKLKFSTSGNGIVLPPKPKSKVKWCHFSTLPKPKPQLSRSFEKGDDFSGKKFCILTAIKPTNLEKEKLRFFKSDYTYNPQFEYANPALPS

SEQ ID NO: 43418 - protein, 517 aa, Homo sapiens
  Payload ID: 8922
  Gene Symbol: KIAA0895
  Gene Name: KIAA0895
  Uniprot ID: Q8NCT3
  ENSP ID: ENSP00000390837
MLESIRVTEKLHWPEQELAKKSILNAEDSLIIDNKRSISHLSSGVLKDIFTTGTSSYNVLLQSKEEKKYHSQKQSSSTYSKRCRKPSKSPNTSRSKDPRRMKALVPVTSSGTWYCLERRPAVFVTSSVSSPVKFTHDISVTGNGIVLPPKPKSKVKWCHFSTLPKPKPQLSRSFEKGDDFSGKKFCILTAIKPTNLEKEKLRFFKSDYTYNPQFEYANPALPSVLAKHSHASDRFLKQSINIMELTLQKYGSYEKFEQATGGSLLSKTRIWSHVRKYMMKEGCLGEIVVHLTEDLLSRASMTVVNGCPTLTINVSTAREHWLEGMLRHEIGTHYFRGINNLQQPWNSWTGRKKHELKPNNPTEEGLASIHSVLFRKDPFLWRAALLYYTVYQASQMSFCELFKDIGRFVKDPNTRWDYCVRAKRGWTDTSQPGCFSKDQVYLDGILQILRYRDTIDFHLLTALGKVSYEDVDRLKGLAVTENMRVPHFLQDHGRYMEHLEKIMEVNELTDRELKDLI

SEQ ID NO: 43419 - protein, 97 aa, Homo sapiens
  Payload ID: 8922
  Gene Symbol: KIAA0895
  Gene Name: KIAA0895
  ENSP ID: ENSP00000399935
MELTLQKYGSYEKFEQATGGSLLSKTRIWSHVRKYMMKEGCLGEIVVHLTEDLLSRASMTVVNGCPTLTINVSTAREHWLEGMLRHEIGTHYFRGIN

SEQ ID NO: 43420 - protein, 304 aa, Homo sapiens
  Payload ID: 8922
  Gene Symbol: KIAA0895
  Gene Name: KIAA0895
  Uniprot ID: Q8NCT3
  ENSP ID: ENSP00000400749
MVATGWARRSGLHPAPRPLRGAQEALAKNLWREERNRPLILSSLIIKKLHWPEQELAKKSILNAEDSLIIDNKRSISHLSSGVLKDIFTTGTSSYNVLLQSKEEKKYHSQKQSSSTYSKRCRKPSKSPNTSRSKDPRRMKALVPVTSSGTWYCLERRPAVFVTSSVSSPVKFTHDISVTGNGIVLPPKPKSKVKWCHFSTLPKPKPQLSRSFEKGDDFSGKKFCILTAIKPTNLEKEKLRFFKSDYTYNPQFEYANPALPSVLAKHSHASDRFLKQVKCHFNSGSSFLCTKTIICDLISKNKDI

SEQ ID NO: 43421 - protein, 471 aa, Homo sapiens
  Payload ID: 8923
  Gene Symbol: KIAA0895L
  Gene Name: KIAA0895-like
  Uniprot ID: Q68EN5
  ENSP ID: ENSP00000290881
MVLDSGAQAYDQAPPSPPTSPPSLRHRLKPSDRDGPPLYPWSQSLALPLALAVPPALQPQPEQQPFSQMLLGHRGHMRRSESTYSVNSTGRRGRGTLGRPPPGRGRNPGGGTLRPAASLPHIAKTQRDAGHIASKSPCMLVALRPTNMDRERDKFFQSHYTYNPQFEYQEPMPTAVLEKYCEASGQFIHQAVGIIEAVLEKFGTYEHFEAATGGQLLTKCQIWSIVRKYMQKEGCAGEVVVQLSEDLLSQAVMMVENSRPTLAINLTGARQYWLEGMLRHEIGTHYLRGVNNARQPWHNAEGRLRYGLRPANPTEEGLASLHSVLFRKQPFLWRAALLYYTIHRAARMSFRQLFQDLERYVQDADVRWEYCVRAKRGQTDTSLPGCFSKDQVYLDGIVRILRHRQTIDFPLLTSLGKVSYEDVDHLRPHGVLDNTRVPHFMQDLARYRQQLEHIMATNRLDEAELGRLLPD

SEQ ID NO: 43422 - protein, 471 aa, Homo sapiens; identical to SEQ ID NO: 43421
  Payload ID: 8923
  Gene Symbol: KIAA0895L
  Gene Name: KIAA0895-like
  Uniprot ID: Q68EN5
  ENSP ID: ENSP00000456838

SEQ ID NO: 43423 - protein, 408 aa, Homo sapiens
  Payload ID: 8923
  Gene Symbol: KIAA0895L
  Gene Name: KIAA0895-like
  Uniprot ID: Q68EN5
  ENSP ID: ENSP00000457099
MVLDSGAQAYDQAPPSPPTSPPSLRHRLKPSDRDGPPLYPWSQSLALPLALAVPPALQPQPEQQPFSQMLLGHRGHMRRSESTYSVNSTGRRGRGTLGRPPPGRGRNPGGGTLRPAASLPHIAKTQRDAGHIASKSPCMLVALRPTNMDRERDKFFQSHYTYNPQFEYQEPMPTAVLEKYCEASGQFIHQAVGIIEAVLEKFGTYEHFEAATGGQLLTKCQIWSIVRKYMQKEGCAGEVVVQLSEDLLSQAVMMVENSRPTLAINLTGARQYWLEGMLRHEIGTHYLRGVNNARQPWHNAEGRLRYGLRPANPTEEGLASLHSVLFRKQPFLWRAALLYYTIHRAARMSFRQLFQDLERYVQDADVRWEYCVRAKRGQTDTSLPARTRCTWTASCAFCDIARPSISRC

SEQ ID NO: 43424 - protein, 205 aa, Homo sapiens
  Payload ID: 8923
  Gene Symbol: KIAA0895L
  Gene Name: KIAA0895-like
  ENSP ID: ENSP00000459322
  MOD_RES (1)..(1): Any amino acid
XSGQFIHQAVGIIEAVLEKFGTYEHFEAATGGQLLTKCQIWSIVRKYMQKEGCAGEVVVQLSEDLLSQAVMMVENSRPTLAINLTGARQYWLEGMLRHEIGTHYLRGVNNARQPWHNAEGRLRYGLRPANPTEEGLASLHSVLFRKQPFLWRAALLYYTIHRAARMSFRQLFQDLERYVQDADVRWEYCVRAKRGQTDTSLPGVL

SEQ ID NO: 43425 - protein, 384 aa, Homo sapiens
  Payload ID: 8924
  Gene Symbol: KIAA0907
  Gene Name: KIAA0907
  Uniprot ID: Q7Z7F0
  ENSP ID: ENSP00000357302
MSAGSATHPGAGGRRSKWDQPAPAPLLFLPPAAPGGEVTSSGGSPGGTTAAPSGALDAAAAVAAKINAMLMAKGKLKPTQNASEKLQAPGKGLTSNKSKDDLVVAEVEINDVPLTCRNLLTRGQTQDEISRLSGAAVSTRGRFMTTEEKAKVGPGDRPLYLHVQGQTRELVDRAVNRIKEIITNGVVKAATGTSPTFNGATVTVYHQPAPIAQLSPAVSQKPPFQSGMHYVQDKLFVGLEHAVPTFNVKEKVEGPGCSYLQHIQIETGAKVFLRGKGSGCIEPASGREAFEPMYIYISHPKPEGLAAAKKLCENLLQTVHAEYSRFVNQINTAVPLPAASSTSLRSTKHSATSCFISTWSLAGITYWSPTCANTIPDNTSAASS

SEQ ID NO: 43426 - protein, 564 aa, Homo sapiens
  Payload ID: 8924
  Gene Symbol: KIAA0907
  Gene Name: KIAA0907
  Uniprot ID: Q7Z7F0
  ENSP ID: ENSP00000357303
MSAGSATHPGAGGRRSKWDQPAPAPLLFLPPAAPGGEVTSSGGSPGGTTAAPSGALDAAAAVAAKINAMLMAKGKLKPTQNASEKLQAPGKGLTSNKSKDDLVVAEVEINDVPLTCRNLLTRGQTQDEISRLSGAAVSTRGRFMTTEEKAKVGPGDRPLYLHVQGQTRELVDRAVNRIKEIITNGVVKAATGTSPTFNGATVTVYHQPAPIAQLSPAVSQKPPFQSGMHYVQDKLFVGLEHAVPTFNVKEKVEGPGCSYLQHIQIETGAKVFLRGKGSGCIEPASGREAFEPMYIYISHPKPEGLAAAKKLCENLLQTVHAEYSRFVNQINTAVPLPGYTQPSAISSVPPQPPYYPSNGYQSGYPVVPPPQQPVQPPYGVPSIVPPAVSLAPGVLPALPTGVPPVPTQYPITQVQPPASTGQSPMGGPFIPAAPVKTALPAGPQPQPQPQPPLPSQPQAQKRRFTEELPDERESGLLGYQHGPIHMTNLGTGFSSQNEIEGAGSKPASSSGKERERDRQLMPPPAFPVTGIKTESDERNGSGTLTGSHGECDIAGGTGEWLRLV

SEQ ID NO: 43427 - protein, 614 aa, Homo sapiens [sequence omitted]

SEQ ID NO: 43428 - protein, 1387 aa, Homo sapiens
  Payload ID: 8925
  Gene Symbol: KIAA0922
  Gene Name: KIAA0922
  ENSP ID: ENSP00000240487
PVPCRVIPAMGKTSFRIIFLPTEEGSIESSLFINTSSYGVLSYHVSGIGTRRISTEGSAKQLPNAYFLLPKVQSIQLSQMQAETTNTSLLQVQLECSLHNKVCQQLKGCYLESDDVLRLQMSIMVTMENFSKEFEENTQHLLDHLSIVYVATDESETSDDSAVNMYILHSGNSLIWIQDIRHFSQRDALSLQFEPVLLPTSTTNFTKIASFTCKAATSCDSGIIEDVKKTTHTPTLKACLFSSVAQGYFRMDSSATQFHIETHENTSGLWSIWYRNHFDRSVVLNDVFLSKETKHMLKILNFTGPLFLPPGCWNIFSLKLAVKDIAINLFTNVFLTTNIGAIFAIPLQIYSAPTKEGSLGFEVIAHCGMHYFMGKSKAGNPNWNGSLSLDQSTWNVDSELANKLYERWKKYKNGDVCKFGTDMQMINFTTGEFQLTEACPYLGTHSEESRFGILHLHLQPLEMKRVGVVFTPADYGKVTSLILIRNNLTVIDMIGVEGFGARELLKVGGRLPGAGGSLRFKVPESTLMDCRRQLKDSKQILSITKNFKVENIGPLPITVSSLKINGYNCQGYGFEVLDCHQFSLDPNTSRDISIVFTPDFTSSWVIRDLSLVTAADLEFRFTLNVTLPHHLLPLCADVVPGPSWEESFWRLTVFFVSLSLLGVILIAFQQAQYILMEFMKTRQRQNASSSSQQNNGPMDVISPHSYKSNCKNFLDTYGPSDKGRGKNCLPVNTPQSRIQNAAKRSPATYGHSQKKHKCSVYYSKHKTSTAAASSTSTTTEEKQTSPLGSSLPAAKEDICTDAMRENWISLRYASGINVNLQKNLTLPKNLLNKEENTLKNTIVFSNPSSECSMKEGIQTCMFPKETDIKTSENTAEFKERELCPLKTSKKLPENHLPRNSPQYHQPDLPEISRKNNGNNQQVPVKNEVDHCENLKKVDTKPSSEKKIHKTSREDMFSEKQDIPFVEQEDPYRKKKLQEKREGNLQNLNWSKSRTCRKNKKRGVAPVSRPPEQSDLKLVCSDFERSELSSDINVRSWCIQESTREVCKADAEIASSLPAAQREAEGYYQKPEKKCVDKFCSDSSSDCGSSSGSVRASRGSWGSWSSTSSSDGDKKPMVDAQHFLPAGDSVSQNDFPSEAPISLNLSHNICNPMTVNSLPQYAEPSCPSLPAGPTGVEEDKGLYSPGDLWPTPPVCVTSSLNCTLENGVPCVIQESAPVHNSFIDWSATCEGQFSSAYCPLELNDYNAFPEENMNYANGFPCPADVQTDFIDHNSQSTWNTPPNMPAAWGHASFISSPPYLTSTRSLSPMSGLFGSIWAPQSDVYENCCPINPTTEHSTHMENQAVVCKEYYPGFNPFRAYMNLDIWTTTANRNANFPLSRDSSYCGNV

SEQ ID NO: 43429 - protein, 1609 aa, Homo sapiens
  Payload ID: 8925
  Gene Symbol: KIAA0922
  Gene Name: KIAA0922
  Uniprot ID: A2VDJ0
  ENSP ID: ENSP00000386574
MAGLRRPQPGCYCRTAAAVNLLLGVFQVLLPCCRPGGAQGQAIEPLPNVVELWQAEEGELLLPTQGDSEEGLEEPSQEQSFSDKLFSGKGLHFQPSVLDFGIQFLGHPVAKILHAYNPSRDSEVVVNSVFAAAGHFHVPPVPCRVIPAMGKTSFRIIFLPTEEGSIESSLFINTSSYGVLSYHVSGIGTRRISTEGSAKQLPNAYFLLPKVQSIQLSQMQAETTNTSLLQVQLECSLHNKVCQQLKGCYLESDDVLRLQMSIMVTMENFSKEFEENTQHLLDHLSIVYVATDESETSDDSAVNMYILHSGNSLIWIQDIRHFSQRDALSLQFEPVLLPTSTTNFTKIASFTCKATSCDSGIIEDVKKTTHTPTLKACLFSSVAQGYFRMDSSATQFHIETHENTSGLWSIWYRNHFDRSVVLNDVFLSKETKHMLKILNFTGPLFLPPGCWNIFSLKLAVKDIAINLFTNVFLTTNIGAIFAIPLQIYSAPTKEGSLGFEVIAHCGMHYFMGKSKAGNPNWNGSLSLDQSTWNVDSELANKLYERWKKYKNGDVCKRNVLGTTRFAHLKKSKESESFVFFLPRLIAEPGLMLNFSATALRSRMIKYFVVQNPSSWPVSLQLLPLSLYPKPEALVHLLHRWFGTDMQMINFTTGEFQLTEACPYLGTHSEESRFGILHLHLQPLEMKRVGVVFTPADYGKVTSLILIRNNLTVIDMIGVEGFGARELLKVGGRLPGAGGSLRFKVPESTLMDCRRQLKDSKQILSITKNFKVENIGPLPITVSSLKINGYNCQGYGFEVLDCHQFSLDPNTSRDISIVFTPDFTSSWVIRDLSLVTAADLEFRFTLNVTLPHHLLPLCADVVPGPSWEESFWRLTVFFVSLSLLGVILIAFQQAQYILMEFMKTRQRQNASSSSQQNNGPMDVISPHSYKSNCKNFLDTYGPSDKGRGKNCLPVNTPQSRIQNAAKRSPATYGHSQKKHKCSVYYSKHKTSTAAASSTSTTTEEKQTSPLGSSLPAAKEDICTDAMRENWISLRYASGINVNLQKNLTLPKNLLNKEENTLKNTIVFSNPSSECSMKEGIQTCMFPKETDIKTSENTAEFKERELCPLKTSKKLPENHLPRNSPQYHQPDLPEISRKNNGNNQQVPVKNEVDHCENLKKVDTKPSSEKKIHKTSREDMFSEKQDIPFVEQEDPYRKKKLQEKREGNLQNLNWSKSRTCRKNKKRGVAPVSRPPEQSDLKLVCSDFERSELSSDINVRSWCIQESTREVCKADAEIASSLPAAQREAEGYYQKPEKKCVDKFCSDSSSDCGSSSGSVRASRGSWGSWSSTSSSDGDKKPMVDAQHFLPAGDSVSQNDFPSEAPISLNLSHNICNPMTVNSLPQYAEPSCPSLPAGPTGVEEDKGLYSPGDLWPTPPVCVTSSLNCTLENGVPCVIQESAPVHNSFIDWSATCEGQFSSAYCPLELNDYNAFPEENMNYANGFPCPADVQTDFIDHNSQSTWNTPPNMPAAWGHASFISSPPYLTSTRSLSPMSGLFGSIWAPQSDVYENCCPINPTTEHSTHMENQAVVCKEYYPGFNPFRAYMNLDIWTTTANRNANFPLSRDSSYCGNV

SEQ ID NO: 43430 - protein, 1610 aa, Homo sapiens
  Payload ID: 8925
  Gene Symbol: KIAA0922
  Gene Name: KIAA0922
  Uniprot ID: A2VDJ0
  ENSP ID: ENSP00000386787
MAGLRRPQPGCYCRTAAAVNLLLGVFQVLLPCCRPGGAQGQAIEPLPNVVELWQAEEGELLLPTQGDSEEGLEEPSQEQSFSDKLFSGKGLHFQPSVLDFGIQFLGHPVAKILHAYNPSRDSEVVVNSVFAAAGHFHVPPVPCRVIPAMGKTSFRIIFLPTEEGSIESSLFINTSSYGVLSYHVSGIGTRRISTEGSAKQLPNAYFLLPKVQSIQLSQMQAETTNTSLLQVQLECSLHNKVCQQLKGCYLESDDVLRLQMSIMVTMENFSKEFEENTQHLLDHLSIVYVATDESETSDDSAVNMYILHSGNSLIWIQDIRHFSQRDALSLQFEPVLLPTSTTNFTKIASFTCKAATSCDSGIIEDVKKTTHTPTLKACLFSSVAQGYFRMDSSATQFHIETHENTSGLWSIWYRNHFDRSVVLNDVFLSKETKHMLKILNFTGPLFLPPGCWNIFSLKLAVKDIAINLFTNVFLTTNIGAIFAIPLQIYSAPTKEGSLGFEVIAHCGMHYFMGKSKAGNPNWNGSLSLDQSTWNVDSELANKLYERWKKYKNGDVCKRNVLGTTRFAHLKKSKESESFVFFLPRLIAEPGLMLNFSATALRSRMIKYFVVQNPSSWPVSLQLLPLSLYPKPEALVHLLHRWFGTDMQMINFTTGEFQLTEACPYLGTHSEESRFGILHLHLQPLEMKRVGVVFTPADYGKVTSLILIRNNLTVIDMIGVEGFGARELLKVGGRLPGAGGSLRFKVPESTLMDCRRQLKDSKQILSITKNFKVENIGPLPITVSSLKINGYNCQGYGFEVLDCHQFSLDPNTSRDISIVFTPDFTSSWVIRDLSLVTAADLEFRFTLNVTLPHHLLPLCADVVPGPSWEESFWRLTVFFVSLSLLGVILIAFQQAQYILMEFMKTRQRQNASSSSQQNNGPMDVISPHSYKSNCKNFLDTYGPSDKGRGKNCLPVNTPQSRIQNAAKRSPATYGHSQKKHKCSVYYSKHKTSTAAASSTSTTTEEKQTSPLGSSLPAAKEDICTDAMRENWISLRYASGINVNLQKNLTLPKNLLNKEENTLKNTIVFSNPSSECSMKEGIQTCMFPKETDIKTSENTAEFKERELCPLKTSKKLPENHLPRNSPQYHQPDLPEISRKNNGNNQQVPVKNEVDHCENLKKVDTKPSSEKKIHKTSREDMFSEKQDIPFVEQEDPYRKKKLQEKREGNLQNLNWSKSRTCRKNKKRGVAPVSRPPEQSDLKLVCSDFERSELSSDINVRSWCIQESTREVCKADAEIASSLPAAQREAEGYYQKPEKKCVDKFCSDSSSDCGSSSGSVRASRGSWGSWSSTSSSDGDKKPMVDAQHFLPAGDSVSQNDFPSEAPISLNLSHNICNPMTVNSLPQYAEPSCPSLPAGPTGVEEDKGLYSPGDLWPTPPVCVTSSLNCTLENGVPCVIQESAPVHNSFIDWSATCEGQFSSAYCPLELNDYNAFPEENMNYANGFPCPADVQTDFIDHNSQSTWNTPPNMPAAWGHASFISSPPYLTSTRSLSPMSGLFGSIWAPQSDVYENCCPINPTTEHSTHMENQAVVCKEYYPGFNPFRAYMNLDIWTTTANRNANFPLSRDSSYCGNV

SEQ ID NO: 43431 - protein, 71 aa, Homo sapiens
  Payload ID: 8925
  Gene Symbol: KIAA0922
  Gene Name: KIAA0922
  ENSP ID: ENSP00000413054
MAGLRRPQPGCYCRTAAAVNLLLGVFQVLLPCCRPGGAQGQAIEPLPNVVELWQAEEGELLLPTQLLGQTI

SEQ ID NO: 43432 - protein, 409 aa, Homo sapiens
  Payload ID: 8926
  Gene Symbol: KIAA0930
  Gene Name: KIAA0930
  Uniprot ID: Q6ICG6
  ENSP ID: ENSP00000251993
MGSQAAAEWRNWASWEVSSSLSGCSMGCFKDDRIVFWTWMFSTYFMEKWAPRQDDMLFYVRRKLAYSGSESGADGRKAAEPEVEVEVYRRDSKKLPGLGDPDIDWEESVCLNLILQKLDYMVTCAVCTRADGGDIHIHKKKSQQVFASPSKHPMDSKGEESKISYPNIFFMIDSFEEVFSDMTVGEGEMVCVELVASDKTNTFQGVIFQGSIRYEALKKVYDNRVSVAARMAQKMSFGFYKYSNMEFVRMKGPQGKGHAEMAVSRVSTGDTSPCGTEEDSSPASPMHERVTSFSTPPTPERNNRPAFFSPSLKRKVPRNRIAEMKKSHSANDSEEFFREDDGGADLHNATNLRSRSLSGTGRSLVGSWLKLNRADGNFLLYAHLTYVTLPLHRILTDILEVRQKPILMT

SEQ ID NO: 43433 - protein, 404 aa, Homo sapiens
  Payload ID: 8926
  Gene Symbol: KIAA0930
  Gene Name: KIAA0930
  Uniprot ID: Q6ICG6
  ENSP ID: ENSP00000336720
MLRAIAEERGRLSLRREVCGLGCFKDDRIVFWTWMFSTYFMEKWAPRQDDMLFYVRRKLAYSGSESGADGRKAAEPEVEVEVYRRDSKKLPGLGDPDIDWEESVCLNLILQKLDYMVTCAVCTRADGGDIHIHKKKSQQVFASPSKHPMDSKGEESKISYPNIFFMIDSFEEVFSDMTVGEGEMVCVELVASDKTNTFQGVIFQGSIRYEALKKVYDNRVSVAARMAQKMSFGFYKYSNMEFVRMKGPQGKGHAEMAVSRVSTGDTSPCGTEEDSSPASPMHERVTSFSTPPTPERNNRPAFFSPSLKRKVPRNRIAEMKKSHSANDSEEFFREDDGGADLHNATNLRSRSLSGTGRSLVGSWLKLNRADGNFLLYAHLTYVTLPLHRILTDILEVRQKPILMT

SEQ ID NO: 43434 - protein, 370 aa, Homo sapiens
  Payload ID: 8926
  Gene Symbol: KIAA0930
  Gene Name: KIAA0930
  Uniprot ID: Q6ICG6
  ENSP ID: ENSP00000375485
MFSTYFMEKWAPRQDDMLFYVRRKLAYSGSESGADGRKAAEPEVEVEVYRRDSKKLPGLGDPDIDWEESVCLNLILQKLDYMVTCAVCTRADGGDIHIHKKKSQQVFASPSKHPMDSKGEESKISYPNIFFMIDSFEEVFSDMTVGEGEMVCVELVASDKTNTFQGVIFQGSIRYEALKKVYDNRVSVAARMAQKMSFGFYKYSNMEFVRMKGPQGKGHAEMAVSRVSTGDTSPCGTEEDSSPASPMHERVTSFSTPPTPERNNRPAFFSPSLKRKVPRNRIAEMKKSHSANDSEEFFREDDGGADLHNATNLRSRSLSGTGRSLVGSWLKLNRADGNFLLYAHLTYVTLPLHRILTDILEVRQKPILMT

SEQ ID NO: 43435 - protein, 152 aa, Homo sapiens
  Payload ID: 8926
  Gene Symbol: KIAA0930
  Gene Name: KIAA0930
  ENSP ID: ENSP00000392752
MGVGCFKDDRIVFWTWMFSTYFMEKWAPRQDDMLFYVRRKLAYSGSESGADGRKAAEPEVEVEVYRRDSKKLPGLGDPDIDWEESVCLNLILQKLDYMVTCAVCTRADGGDIHIHKKKSQQVFASPSKHPMDSKGEESKISYPNIFFMIDSF

SEQ ID NO: 43436 - protein, 84 aa, Homo sapiens
  Payload ID: 8926
  Gene Symbol: KIAA0930
  Gene Name: KIAA0930
  ENSP ID: ENSP00000395994
MLRAIAEERGRLSLRREVCGLGPHAAPGAEQAHRTGYEAQPHELARCPDLKVSVSLTVKWLLGGHTCGLGIVKALRGFHSVVQV

SEQ ID NO: 43437 - protein, 289 aa, Homo sapiens
  Payload ID: 8926
  Gene Symbol: KIAA0930
  Gene Name: KIAA0930
  ENSP ID: ENSP00000399125
GDPDIDWEESVCLNLILQKKKSQQVFASPSKHPMDSKGEESKISYPNIFFMIDSFEEVFSDMTVGEGEMVCVELVASDKTNTFQGVIFQGSIRYEALKKVYDNRVSVAARMAQKMSFGFYKYSNMEFVRMKGPQGKGHAEMAVSRVSTGDTSPCGTEEDSSPASPMHERVTSFSTPPTPERNNRPAFFSPSLKRKVPRNRIAEMKKSHSANDSEEFFREDDGGADLHNATNLRSRSLSGTGRSLVGSWLKLNRADGNFLLYAHLTYVTLPLHRILTDILEVRQKPILMT

SEQ ID NO: 43438 - protein, 70 aa, Homo sapiens
  Payload ID: 8926
  Gene Symbol: KIAA0930
  Gene Name: KIAA0930
  ENSP ID: ENSP00000402514
FWTWMFSTYFMEKWAPRQDDMLFYVRRKLAYSGSESGADGRKIPALPLGGAGLCTCKRAQQCPAPRSPSQ

SEQ ID NO: 43439 - protein, 136 aa, Homo sapiens
  Payload ID: 8926
  Gene Symbol: KIAA0930
  Gene Name: KIAA0930
  ENSP ID: ENSP00000403030
MFSTYFMEKWAPRQDDMLFYVRRKLAYSGSESGADGRKAAEPEVEVEVYRRDSKKLPGLGDPDIDWEESVCLNLILQKLDYMVTCAVCTRADGGDIHIHKKKSQQVFASPSKHPMDSKGEESKISYPNIFFMIDSF

SEQ ID NO: 43440 - protein, 85 aa, Homo sapiens
  Payload ID: 8926
  Gene Symbol: KIAA0930
  Gene Name: KIAA0930
  ENSP ID: ENSP00000477148
MGSQAAAEWRNWASWEVSSSLSGCSMGCFKDDRIVFWTWMFSTYFMEKWAPRQDDMLFYVRRKLAYSGSESGADGRKMRKRRARR

SEQ ID NO: 43441 - protein, 89 aa, Homo sapiens
  Payload ID: 8926
  Gene Symbol: KIAA0930
  Gene Name: KIAA0930
  ENSP ID: ENSP00000477454
MWGYGRSLAKAMLQGPGWPSFLTPVWPPSAGCFKDDRIVFWTWMFSTYFMEKWAPRQDDMLFYVRRKLAYSGSESGADGRKMRKRRARR

SEQ ID NO: 43442 - protein, 916 aa, Homo sapiens
  Payload ID: 8927
  Gene Symbol: KIAA1024
  Gene Name: KIAA1024
  Uniprot ID: Q9UPX6
  ENSP ID: ENSP00000307461
METSQETSLFLVKILEELDSKQNTVSYQDLCKSLCARFDLSQLAKLRSVLFYTACLDPNFPATLFKDKMKCTVNNQQSKKIMVAADIVTIFNLIQMNGGAAKEKLPTGRQKVRKKEASFESCRSDTEICNAAECEPLNCELSERSFSRGYPIRQSSKCRKMDCKDCPQFVPASEPNFLLGVSKEVKNRAASLDRLQALAPYSVTSPQPCEMQRTYFPMNIENESISDQDSLPINQSIKETFISNEEPFVVQSCVQKRNIFKEDFHNLMAVSPSLVGPISKAENEHREPQSRKEPHKPPFFNHSFEMPYNSQYLNPVYSPVPDKRRAKHESLDDLQASTYFGPTPVMGTQEARRCLGKPNKQTPWPAKSWSLNTEEVPDFERSFFNRNPSEEKLHYPNASSQTPNFPAPERRPTYLVPKDQQPILPIAYAAKQNGLKSKEISSPVDLEKHEPVKKFKDKSINCTSGQLSSDTSSVGTQTEHVLEPKKCRDLCTSGQGKYSDRHTMKHSDDDSEIVSDDISDIFRFLDDMSISGSTGVIQSSCYNSTGSLSQLHKSDCDSSPEHNLTKIANGVPNSKGDKGNRPENTHHSEEELKTSVCKLVLRIGEIERKLESLSGVRDEISQVLGKLNKLDQKMQQPEKVSVQIDLNSLTSEGPSDDSASPRMFHAHSGSHGPKLENNPDWCCSDASGSNSESLRVKALKKSLFTRPSSRSLTEENSATESKIASISNSPRDWRTITYTNRVGLNEEEIKDTGPGDNKDWHRKSKEADRQYDIPPQHRLPKQPKDGFLVEQVFSPHPYPASLKAHMKSNPLYTDMRLTELAEVKRGQPSWTIEEYARNAGDKGKLTALDLQTQESLNPNNLEYWMEDIYTPGYDSLLKRKEAEFRRAKVCKIAALIAAAACTVILVIVVPICTMKS

SEQ ID NO: 43443 - protein, 854 aa, Homo sapiens
  Payload ID: 8927
  Gene Symbol: KIAA1024
  Gene Name: KIAA1024
  ENSP ID: ENSP00000454088
METSQETSLFLVKILEELDSKQNTVSYQDLCKSLCARFDLSQLAKLRSVLFYTACLDPNFPATLFKDKMKCTVNNQQSKKIMVAADIVTIFNLIQMNGGAAKEKLPTGRQKVRKKEASFESCRSDTEICNAAECEPLNCELSERSFSRGYPIRQSSKCRKMDCKDCPQFVPASEPNFLLGVSKEVKNRAASLDRLQALAPYSVTSPQPCEMQRTYFPMNIENESISDQDSLPINQSIKETFISNEEPFVVQSCVQKRNIFKEDFHNLMAVSPSLVGPISKAENEHREPQSRKEPHKPPFFNHSFEMPYNSQYLNPVYSPVPDKRRAKHESLDDLQASTYFGPTPVMGTQEARRCLGKPNKQTPWPAKSWSLNTEEVPDFERSFFNRNPSEEKLHYPNASSQTPNFPAPERRPTYLVPKDQQPILPIAYAAKQNGLKSKEISSPVDLEKHEPVKKFKDKSINCTSGQLSSDTSSVGTQTEHVLEPKKCRDLCTSGQGKYSDRHTMKHSDDDSEIVSDDISDIFRFLDDMSISGSTGVIQSSCYNSTGSLSQLHKSDCDSSPEHNLTKIANGVPNSKGDKGNRPENTHHSEEELKTSVCKLVLRIGEIERKLESLSGVRDEISQVLGKLNKLDQKMQQPEKVSVQIDLNSLTSEGPSDDSASPRMFHAHSGSHGPKLENNPDWCCSDASGSNSESLRVKALKKSLFTRPSSRSLTEENSATESKIASISNSPRDWRTITYTNRVGLNEEEIKDTGPGDNKDWHRKSKEADRQYDIPPQHRLPKQPKDGFLVEQVFSPHPYPASLKAHMKSNPLYTDMRLTELAEVKRGQPSWTIEEYARNAGDKGKLTALDLQHVG

SEQ ID NO: 43444 - protein, 190 aa, Homo sapiens
  Payload ID: 8928
  Gene Symbol: KIAA1024L
  Gene Name: KIAA1024-like
  Uniprot ID: P59773
  ENSP ID: ENSP00000454268
MDLSVLPNNNHPDKFLQLDVKSLTRSSALLQASLVRFPGGNYPAAQHWQNLVYSQREKKNIAAQRIRGSSADSLVTADSPPPSMSSVMKNNPLYGDLSLEEAMEERKKNPSWTIEEYDKHSLHTNLSGHLKENPNDLRFWLGDMYTPGFDTLLKKEEKQEKHSKFCRMGLILLVVISILVTIVTIITFFT

SEQ ID NO: 43445 - protein, 1173 aa, Homo sapiens
  Payload ID: 8929
  Gene Symbol: KIAA1033
  Gene Name: KIAA1033
  Uniprot ID: Q2M389
  ENSP ID: ENSP00000328062
MAVETLSPDWEFDRVDDGSQKIHAEVQLKNYGKFLEEYTSQLRRIEDALDDSIGDVWDFNLDPIALKLLPYEQSSLLELIKTENKVLNKVITVYAALCCEIKKLKYEAETKFYNGLLFYGEGATDASMVEGDCQIQMGRFISFLQELSCFVTRCYEVVMNVVHQLAALYISNKIAPKIIETTGVHFQTMYEHLGELLTVLLTLDEIIDNHITLKDHWTMYKRLLKSVHHNPSKFGIQEEKLKPFEKFLLKLEGQLLDGMIFQACIEQQFDSLNGGVSVSKNSTFAEEFAHSIRSIFANVEAKLGEPSEIDQRDKYVGICGLFVLHFQIFRTIDKKFYKSLLDICKKVPAITLTANIIWFPDNFLIQKIPAAAKLLDRKSLQAIKIHRDTFLQQKAQSLTKDVQSYYVFVSSWMMKMESILSKEQRMDKFAEDLTNRCNVFIQGFLYAYSISTIIKTTMNLYMSMQKPMTKTSVKALCRLVELLKAIEHMFYRRSMVVADSVSHITQHLQHQALHSISVAKKRVISDKKYSEQRLDVLSALVLAENTLNGPSTKQRRLIVSLALSVGTQMKTFKDEELFPLQVVMKKLDLISELRERVQTQCDCCFLYWHRAVFPIYLDDVYENAVDAARLHYMFSALRDCVPAMMHARHLESYEILLDCYDKEIMEILNEHLLDKLCKEIEKDLRLSVHTHLKLDDRNPFKVGMKDLALFFSLNPIRFFNRFIDIRAYVTHYLDKTFYNLTTVALHDWATYSEMRNLATQRYGLVMTEAHLPSQTLEQGLDVLEIMRNIHIFVSRYLYNLNNQIFIERTSNNKHLNTINIRHIANSIRTHGTGIMNTTVNFTYQFLKKKFYIFSQFMYDEHIKSRLIKDIRFFREIKDQNDHKYPFDRAEKFNRGIRKLGVTPEGQSYLDQFRQLISQIGNAMGYVRMIRSGGLHCSSNAIRFVPDLEDIVNFEELVKEEGLAEETLKAARHLDSVLSDHTRNSAEGTEYFKMLVDVFAPEFRRPKNIHLRNFYIIVPPLTLNFVEHSISCKEKLNKKNKIGAAFTDDGFAMGVAYILKLLDQYREFDSLHWFQSVREKYLKEIRAVAKQQNVQSASQDEKLLQTMNLTQKRLDVYLQEFELLYFSLSSARIFFRADKTAAEENQEKKEKEEETKTSNGDLSDSTVSADPVVK

SEQ ID NO: 43446 - protein, 116 aa, Homo sapiens
  Payload ID: 8929
  Gene Symbol: KIAA1033
  Gene Name: KIAA1033
  ENSP ID: ENSP00000447015
MGYVRMIRSGGLHCSSNAIRFVPDLEDIVNFEELVKEEGLAEETLKAARHLDSVLSDHTRNSAEGTEYFKMLVDVFAPEFRRPKNIHLRNFYIIVPPLTLNFVEHSISCKEKLNKK

SEQ ID NO: 43447 - protein, 189 aa, Homo sapiens
  Payload ID: 8929
  Gene Symbol: KIAA1033
  Gene Name: KIAA1033
  ENSP ID: ENSP00000448966
MAVETLSPDWEFDRVDDGSQKIHAEVQLKNYGKFLEEYTSQLRRIEDALDDSIGDVWDFNLDPIALKLLPYEQSSLLELIKTENKVLNKVITVYAALCCEIKKLKYEAETKFYNGLLFYGEGATDASMVEGDCQIQMGRFISFLQELSCFVTRCYEVVMNVVHQLAALYISNKIAPKIIETTGVHFQVF

SEQ ID NO: 43448 - protein, 48 aa, Homo sapiens
  Payload ID: 8929
  Gene Symbol: KIAA1033
  Gene Name: KIAA1033
  ENSP ID: ENSP00000450166
MGYVRMIRSGGLHCSSNAIRFVPDLEDIVNFEELVKEEGLAEETLKAA

SEQ ID NO: 43449 - protein, 41 aa, Homo sapiens
  Payload ID: 8929
  Gene Symbol: KIAA1033
  Gene Name: KIAA1033
  ENSP ID: ENSP00000450243
MVEGDCQIQMGRFISFLQELSCFVTRCYEVVMNVVHQLAAL

SEQ ID NO: 43450 - protein, 62 aa, Homo sapiens
  Payload ID: 8929
  Gene Symbol: KIAA1033
  Gene Name: KIAA1033
  ENSP ID: ENSP00000473263
MVEGDCQIQMGRFISFLQELSCFVTRCYEVVMNVVHQLAALYISNKIAPKIIETTGVHFQVF

SEQ ID NO: 43451 - protein, 1174 aa, Homo sapiens
  Payload ID: 8929
  Gene Symbol: KIAA1033
  Gene Name: KIAA1033
  ENSP ID: ENSP00000484713
MAVETLSPDWEFDRVDDGSQKIHAEVQLKNYGKFLEEYTSQLRRIEDALDDSIGDVWDFNLDPIALKLLPYEQSSLLELIKTENKVLNKVITVYAALCCEIKKLKYEAETKFYNGLLFYGEGATDASMVEGDCQIQMGRFISFLQELSCFVTRCYEVVMNVVHQLAALYISNKIAPKIIETTGVHFQTMYEHLGELLTVLLTLDEIIDNHITLKDHWTMYKRLLKSVHHNPSKFGIQEEKLKPFEKFLLKLEGQLLDGMIFQACIEQQFDSLNGGVSVSKNSTFAEEFAHSIRSIFANVEAKLGEPSEIDQRDKYVGICGLFVLHFQIFRTIDKKFYKSLLDICKKVPAITLTANIIWFPDNFLIQKIPAAAKLLDRKSLQAIKIHRDTFLQQKAQSLTKDVQSYYVFVSSWMMKMESILSKEQRMDKFAEDLTNRCNVFIQVGFLYAYSISTIIKTTMNLYMSMQKPMTKTSVKALCRLVELLKAIEHMFYRRSMVVADSVSHITQHLQHQALHSISVAKKRVISDKKYSEQRLDVLSALVLAENTLNGPSTKQRRLIVSLALSVGTQMKTFKDEELFPLQVVMKKLDLISELRERVQTQCDCCFLYWHRAVFPIYLDDVYENAVDAARLHYMFSALRDCVPAMMHARHLESYEILLDCYDKEIMEILNEHLLDKLCKEIEKDLRLSVHTHLKLDDRNPFKVGMKDLALFFSLNPIRFFNRFIDIRAYVTHYLDKTFYNLTTVALHDWATYSEMRNLATQRYGLVMTEAHLPSQTLEQGLDVLEIMRNIHIFVSRYLYNLNNQIFIERTSNNKHLNTINIRHIANSIRTHGTGIMNTTVNFTYQFLKKKFYIFSQFMYDEHIKSRLIKDIRFFREIKDQNDHKYPFDRAEKFNRGIRKLGVTPEGQSYLDQFRQLISQIGNAMGYVRMIRSGGLHCSSNAIRFVPDLEDIVNFEELVKEEGLAEETLKAARHLDSVLSDHTRNSAEGTEYFKMLVDVFAPEFRRPKNIHLRNFYIIVPPLTLNFVEHSISCKEKLNKKNKIGAAFTDDGFAMGVAYILKLLDQYREFDSLHWFQSVREKYLKEIRAVAKQQNVQSASQDEKLLQTMNLTQKRLDVYLQEFELLYFSLSSARIFFRADKTAAEENQEKKEKEEETKTSNGDLSDSTVSADPVVK

SEQ ID NO: 43452 - protein, 1354 aa, Homo sapiens
  Payload ID: 8930
  Gene Symbol: KIAA1107
  Gene Name: KIAA1107
  ENSP ID: ENSP00000359404
MSSTADLLDTILKAIEENITTENSCSLLMALDTLLNSDSTKEMGFTCKIQALRDKLWIFLVQSFYAVRHTESWKLMSTDDQQKIQAAAFDKGDDRRLGKKPIFSSSQQRKQVSDSGDIKIKSWRGNNKKECWSYLSTNKKMKSDGLGASGHSSSTNRNSINKTLKQDDVKEKDGTKIASKITKELKTGGKNVSGKPKTVTKSKTENGDKARLENMSPRQVVERSATAAAAATGQKNLLNGKGVRNQEGQISGARPKVLTGNLNVQAKAKPLKKATGKDSPCLSIAGPSSRSTDSSMEFSISTECLDEPKENGSTEEEKPSGHKLSFCDSPGQMMKNSVDSVKNSTVAIKSRPVSRVTNGTSNKKSIHEQDTNVNNSVLKKVSGKGCSEPVPQAILKKRGTSNGCTAAQQRTKSTPSNLTKTQGSQGESPNSVKSSVSSRQSDENVAKLDHNTTTEKQAPKRKMVKQVHTALPKVNAKIVAMPKNLNQSKKGETLNNKDSKQKMPPGQVISKTQPSSQRPLKHETSTVQKSMFHDVRDNNNKDSVSEQKPHKPLINLASEISDAEALQSSCRPDPQKPLNDQEKEKLALECQNISKLDKSLKHELESKQICLDKSETKFPNHKETDDCDAANICCHSVGSDNVNSKFYSTTALKYMVSNPNENSLNSNPVCDLDSTSAGQIHLISDRENQVGRKDTNKQSSIKCVEDVSLCNPERTNGTLNSAQEDKKSKVPVEGLTIPSKLSDESAMDEDKHATADSDVSSKCFSGQLSEKNSPKNMETSESPESHETPETPFVGHWNLSTGVLHQRESPESDTGSATTSSDDIKPRSEDYDAGGSQDDDGSNDRGISKCGTMLCHDFLGRSSSDTSTPEELKIYDSNLRIEVKMKKQSNNDLFQVNSTSDDEIPRKRPEIWSRSAIVHSRERENIPRGSVQFAQEIDQVSSSADETEDERSEAENVAENFSISNPAPQQFQGIINLAFEDATENECREFSATKKFKRSVLLSVDECEELGSDEGEVHTPFQASVDSFSPSDVFDGISHEHHGRTCYSRFSRESEDNILECKQNKGNSVCKNESTVLDLSSIDSSRKNKQSVSATEKKNTIDVLSSRSRQLLREDKKVNNGSNVENDIQQRSKFLDSDVKSQERPCHLDLHQREPNSDIPKNSSTKSLDSFRSQVLPQEGPVKESHSTTTEKANIALSAGDIDDCDTLAQTRMYDHRPSKTLSPIYEMDVIEAFEQKVESETHVTDMDFEDDQHFAKQDWTLLKQLLSEQDSNLDVTNSVPEDLSLAQYLINQTLLLARDSSKPQGITHIDTLNRWSELTSPLDSSASITMASFSSEDCSPQGEWTILELETQH

SEQ ID NO: 43453 - protein, 5005 aa, Homo sapiens
  Payload ID: 8931
  Gene Symbol: KIAA1109
  Gene Name: KIAA1109
  Uniprot ID: Q2LD37
  ENSP ID: ENSP00000264501
MDQRKNESIVPSITQLEDFLTEHNSNVVWLLVATILSCGWIIYLTYYNSRNVGLILTLVLNRLYKHGYIHIGSFSFSVLSGKVMVREIYYITEDMSIRIQDGFIIFRWWKMYNPKQKQHDPKAETRLYITVNDFEFHVYNRSDLYGRLQELFGLEPTIIPPKKDDDKTREIGRTRTQSKIERVKVKTESQDPTSSWRSLIPVIKVNVSTGRLAFGNHYQPQTLCINFDDAFLTYTTKPPSSHLDQFMHIVKGKLENVRVMLVPSPRYVGLQNDEPPRLMGEGFVVMQSNDVDIYYYMDEPGLVPEETEENIEGEMSSEDCKLQDLPPCWGLDIVCGKGTDFNYGPWADRQRDCLWKFFFPPDYQVLKVSEIAQPGRPRQILAFELRMNIIADATIDLLFTKNRETNAVHVNVGAGSYLEINIPMTVEENGYTPAIKGQLLHVDATTSMQYRTLLEAEMLAFHINASYPRIWNMPQTWQCELEVYKATYHFIFAQKNFFTDLIQDWSSDSPPDIFSFVPYTWNFKIMFHQFEMIWAANQHNWIDCSTKQQENVYLAACGETLNIDFSLPFTDFVPATCNTKFSLRGEDVDLHLFLPDCHPSKYSLFMLVKNCHPNKMIHDTGIPAECQSGQKTVKPKWRNVTQEKSGWVECWTVPSVMLTIDYTWHPIYPQKADEQLKQSLSEMEETMLSVLRPSQKTSDRVVSSPSTSSRPPIDPSELPPDKLHVEMELSPDSQITLYGPLLNAFLCIKENYFGEDDMYMDFEEVISSPVLSLSTSSSSGWTAVGMENDKKENEGSAKSIHPLALRPWDITVLVNLYKVHGRLPVHGTTDGPECPTAFLERLCFEMKKGFRETMLQLILSPLNVFVSDNYQQRPPVDEVLREGHINLSGLQLRAHAMFSAEGLPLGSDSLEYAWLIDVQAGSLTAKVTAPQLACLLEWGQTFVFHVVCREYELERPKSVIICQHGIDRRFCESKLSCIPGPCPTSDDLKYTMIRLAVDGADIYIVEHGCATNIKMGAIRVANCNLHNQSVGEGISAAIQDFQVRQYIEQLNNCRIGLQPAVLRRAYWLEAGSANLGLITVDIALAADHHSKHEAQRHFLETHDARTKRLWFLWPDDILKNKRCRNKCGCLGGCRFFGGTVTGLDFFKLEELTPSSSSAFSSTSAESDMYYGQSLLQPGEWIITKEIPKIIDGNVNGMKRKEWENKSVGIEVERKTQHLSLQVPLRSHSSSSSSEENSSSSAAQPLLAGEKESPSSVADDHLVQKEFLHGTKRDDGQASIPTEISGNSPVSPNTQDKSVGQSPLRSPLKRQASVCSTRLGSTKSLTAAFYGDKQPVTVGVQFSSDVSRSDENVLDSPKQRRSFGSFPYTPSADSNSFHQYRSMDSSMSMADSEAYFSAAEEFEPISSDEGPGTYPGRKKKKKQTQQIDYSRGSIYHSVEGPLTGHGESIQDSRTLPFKTHPSQASFVSALGGEDDVIEHLYIVEGEKTVESEQITPQQPVMNCYQTYLTQFQVINWSVKHPTNKRTSKSSLHRPLDLDTPTSEESSSSFEQLSVPTFKVIKQGLTANSLLDRGMQLSGSTSNTPYTPLEKKLADNTDDETLTEEWTLDQPVSQTRTTAIVEVKGTVDIVLTPLVAEALDRYIEAMVHCASTRHPAAIVDDLHAKVLREAVQNSKTTFSENLSSKQDIRGTKTEQSTIGTTNQGQAQTNLTMKQDNVTIKGLQTNVSIPKVNLCLLQASVEESPTTAPSRSVTHVSLVALCFDRIATQVRMNRGVVEETSNNAEPGRTSNFDRYVHATKMQPQSSGSLRSNAGAEKGKEIAAKLNIHRVHGQLRGLDTTDIGTCAITAIPFEKSKVLFTLEELDEFTFVDETDQQAVPDVTRIGPSQEKWGWIMFECGLENLTIKGGRQSGAVLYNSFGIMGKASDTERGGVLTSNNSSDSPTGSGYNTDVSDDNLPCDRTSPSSDLNGNSVSDEQDEGVESDDLKKDLPLMPPPPDSCSMKLTIKEIWFSFAAPTNVRSHTHAFSRQLNLLSTATPAVGAWLVPIDQLKSSLNKLETEGTLRICAVMGCIMTEALENKSVHFPLRSKYNRLTKVARFLQENPSCLLCNILHHYLHQANYSIIDDATMSDGLPALVTLKKGLVALARQWMKFIVVTPAFKGVSLHRPAQPLKPQIAMDHEHEDGLGLDNGGGLQSDTSADGAEFEFDAATVSEHTMLLEGTANRPPPGSSGPVTGAEIMRKLSKTHTHSDSALKIKGIHPYHSLSYTSGDTATDSPVHVGRAGMPVKDSPRKESLLSYLTGSFPSLHNLLEGTPQRSSAAVKSSSLTRTGNTVATDMLSEHPLLSEPSSVSFYNWMSNAVGNRGSVLQESPVTKSGHNSLPTGVAPNLPTIPSASDFNTVLSSDQNTLDGTHSQHSTSQDDVAGVEEANQGFPAVQLADAQVVFKPLLSHTGIQSQDTMPFCYRMYFGEHLSFSGTLDCLRADIVDSDTAKERKGKRARRQGHVNLPPLEFKPALMLGTFSISAVVMEKSVCTPQNSTSALSFHDLSKRYYNTFHCNFTISCQSISQHVDMALVRLIHQFSTMIDDIKATQTDIKLSRYTAGSASPTPTFKTRKHRDFRSSDFSRSSRGSLNGGNRVNNAKNKRTNNENNKKESRNKNSLGRSERRTSKVSRKGSKDVVDHMTIHMDDSDSITVSEQSEPSAECWQNMYKLLNFYSLISDPTGILEKSSETFGPAGVRSPTEPTCKVVFENEQDNSSLTKTQRKRSLVTSEPQHVTLIVFGIGMVNRTHLEADIGGLTMESELKRIHGSFTLKEKMKDVLHQKMTETCATAHIGGVNIVLLEGITPNIQLEDFPTSPTSTAKQEFLTVVKCSIAKSQALYSAQRGLKTNNAAVFKVGAISINIPQHPATLHSMMVRSSHQLSKQISDLIRQPSTAPQPVKEDIATPLPSEKTPTSVNQTPVETNEFPQLPEGLEKKPIVLKFSAMLDGIAIGAALLPSLKAEYKMGRMRSHGMTGAQTRFTFELPNHRLRFTSKVSATDMSTIPPSASLNLPPVTMSGKYIMEEHDSYSDQVWSIDELPSKQGYYLQGNYLRCVAEVGSFEHNLTTDLLNHLVFVQKVFMKEVNEVIQKVSGGEQPIPLWNEHDGTADGDKPKILLYSLNLQFKGIQVTATTPSMRAVRFETGLIELELSNRLQTKASPGSSSYLKLFGKCQVDLNLALGQIVKHQVYEEAGSDFHQVAYFKTRIGLRNALREEISGSSDREAVLITLNRPIVYAQPVAFDRAVLFWLNYKAAYDNWNEQRMALHKDIHMATKEVVDMLPGIQQTSAQAFGTLFLQLTVNDLGICLPITNTAQSNHTGDLDTGSALVLTIESTLITACSSESLVSKGHFKNFCIRFADGFETSWDDWKPEIHGDLVMNACVVPDGTYEVCSRTTGQAAAESSSAGTWTLNVLWKMCGIDVHMDPNIGKRLNALGNTLTTLTGEEDIDDIADLNSVNIADLSDEDEVDTMSPTIHTEATDYRRQAASASQPGELRGRKIMKRIVDIRELNEQAKVIDDLKKLGASEGTINQEIQRYQQLESVAVNDIRRDVRKKLRRSSMRAASLKDKWGLSYKPSYSRSKSISASGRPPLKRMERASSRVGETEELPEIRVDAASPGPRVTFNIQDTFPEETELDLLSVTIEGPSHYSSNSEGSCSVFSSPKTPGGFSPGIPFQTEEGRRDDSLSSTSEDSEKDEKDEDHERERFYIYRKPSHTSRKKATGFAAVHQLFTERWPTTPVNRSLSGTATERNIDFELDIRVEIDSGKCVLHPTTLLQEHDDISLRRSYDRSSRSLDQDSPSKKKKFQTNYASTTHLMTGKKVPSSLQTKPSDLETTVFYIPGVDVKLHYNSKTLKTESPNASRGSSLPRTLSKESKLYGMKDSATSPPSPPLPSTVQSKTNTLLPPQPPPIPAAKGKGSGGVKTAKLYAWVALQSLPEEMVISPCLLDFLEKALETIPITPVERNYTAVSSQDEDMGHFEIPDPMEESTTSLVSSSTSAYSSFPVDVVVYVRVQPSQIKFSCLPVSRVECMLKLPSLDLVFSSNRGELETLGTTYPAETLSPGGNATQSGTKTSASKTGIPGSSGLGSPLGRSRHSSSQSDLTSSSSSSSGLSFTACMSDFSLYVFHPYGAGKQKTAVSGLTPGSGGLGNVDEEPTSVTGRKDSLSINLEFVKVSLSRIRRSGGASFFESQSVSKSASKMDTTLINISAVCDIGSASFKYDMRRLSEILAFPRAWYRRSIARRLFLGDQTINLPTSGPGTPDSIEGVSQHLSPESSRKAYCKTWEQPSQSASFTHMPQSPNVFNEHMTNSTMSPGTVGQSLKSPASIRSRSVSDSSVPRRDSLSKTSTPFNKSNKAASQQGTPWETLVVFAINLKQLNVQMNMSNVMGNTTWTTSGLKSQGRLSVGSNRDREISMSVGLGRSQLDSKGGVVGGTIDVNALEMVAHISEHPNQQPSHKIQITMGSTEARVDYMGSSILMGIFSNADLKLQDEWKVNLYNTLDSSITDKSEIFVHGDLKWDIFQVMISRSTTPDLIKIGMKLQEFFTQQFDTSKRALSTWGPVPYLPPKTMTSNLEKSSQEQLLDAAHHRHWPGVLKVVSGCHISLFQIPLPEDGMQFGGSMSLHGNHMTLACFHGPNFRSKSWALFHLEEPNIAFWTEAQKIWEDGSSDHSTYIVQTLDFHLGHNTMVTKPCGALESPMATITKITRRRHENPPHGVASVKEWFNYVTATRNEELNLLRNVDANNTENSTTVKNSSLLSGFRGGSSYNHETETIFALPRMQLDFKSIHVQEPQEPSLQDASLKPKVECSVVTEFTDHICVTMDAELIMFLHDLVSAYLKEKEKAIFPPRILSTRPGQKSPIIIHDDNSSDKDREDSITYTTVDWRDFMCNTWHLEPTLRLISWTGRKIDPVGVDYILQKLGFHHARTTIPKWLQRGVMDPLDKVLSVLIKKLGTALQDEKEKKGKDKEEH

SEQ ID NO: 43454 - protein, 1381 aa, Homo sapiens
  Payload ID: 8931
  Gene Symbol: KIAA1109
  Gene Name: KIAA1109
  ENSP ID: ENSP00000304374
  MOD_RES (1)..(1): Any amino acid
XPSYSRSKSISASGRPPLKRMERASSRVGETEELPEIRVDAASPGPRVTFNIQDTLKNTVWGSTPQSSCPGEGYFQFPEETELDLLSVTIEGPSHYSSNSEGSCSVFSSPKTPGGFSPGIPFQTEEGRRDDSLSSTSEDSEKDEKDEDHERERFYIYRKPSHTSRKKATGFAAVHQLFTERWPTTPVNRSLSGTATERNIDFELDIRVEIDSGKCVLHPTTLLQEHDDISLRRSYDRSSRSLDQDSPSKKKKFQTNYASTTHLMTGKKVPSSLQTKPSDLETTVFYIPGVDVKLHYNSKTLKTESPNASRGSSLPRTLSKESKLYAKGKGSGGVKTAKLYAWVALQSLPEEMVISPCLLDFLEKALETIPITPVERNYTAVSSQDEDMGHFEIPDPMEESTTSLVSSSTSAYSSFPVDVVVYVRVQPSQIKFSCLPVSRVECMLKLPSLDLVFSSNRGELETLGTTYPAETLSPGGNATQSGTKTSASKTGIPGSSGLGSPLGRSRHSSSQSDLTSSSSSSSGLSFTACMSDFSLYVFHPYGAGKQKTAVSGLTPGSGGLGNVDEEPTSVTGRKDSLSINLEFVKVSLSRIRRSGGASFFESQSVSKSASKMDTTLINISAVCDIGSASFKYDMRRLSEILAFPRAWYRRSIARRLFLGDQTINLPTSGPGTPDSIEGVSQHLSPESSRKAYCKTWEQPSQSASFTHMPQSPNVFNEHMTNSTMSPGTVGQSLKSPASIRSRSVSDSSVPRRDSLSKTSTPFNKSNKAASQQGTPWETLVVFAINLKQLNVQMNMSNVMGNTTWTTSGLKSQGRLSVGSNRDREISMSVGLGRSQLDSKGGVVGGTIDVNALEMVAHISEHPNQQPSHKIQITMGSTEARVDYMGSSILMGIFSNADLKLQDEWKVNLYNTLDSSITDKSEIFVHGDLKWDIFQVMISRSTTPDLIKIGMKLQEFFTQQFDTSKRALSTWGPVPYLPPKTMTSNLEKSSQEQLLDAAHHRHWPGVLKVVSGCHISLFQIPLPEDGMQFGGSMSLHGNHMTLACFHGPNFRSKSWALFHLEEPNIAFWTEAQKIWEDGSSDHSTYIVQTLDFHLGHNTMVTKPCGALESPMATITKITRRRHENPPHGVASVKEWFNYVTATRNEELNLLRNVDANNTENSTTVKNSSLLSGFRGGSSYNHETETIFALPRMQLDFKSIHVQEPQEPSLQDASLKPKVECSVVTEFTDHICVTMDAELIMFLHDLVSAYLKEKEKAIFPPRILSTRPGQKSPIIIHDDNSSDKDREDSITYTTVDWRDFMCNTWHLEPTLRLISWTGRKIDPVGVDYILQKLGFHHARTTIPKWLQRGVMDPLDKVLSVLIKKLGTALQDEKEKKGKDKEEH

SEQ ID NO: 43455 - protein, 5005 aa, Homo sapiens; identical to SEQ ID NO: 43453
  Payload ID: 8931
  Gene Symbol: KIAA1109
  Gene Name: KIAA1109
  Uniprot ID: Q2LD37
  ENSP ID: ENSP00000373390

SEQ ID NO: 43456 - protein, 1638 aa, Homo sapiens
  Payload ID: 8931
  Gene Symbol: KIAA1109
  Gene Name: KIAA1109
  ENSP ID: ENSP00000393219
  MOD_RES (1)..(1): Any amino acid
XIDQLKSSLNKLETEGTLRICAVMGCIMTEALENKSVHFPLRSKYNRLTKVARFLQENPSCLLCNILHHYLHQANYSIIDDATMSDGLPALVTLKKGLVALARQWMKFIVVTPAFKGVSLHRPAQPLKPQIAMDHEHEDGLGLDNGGGLQSDTSADGAEFEFDAATVSEHTMLLEGTANRPPPGSSGPVTGAEIMRKLSKTHTHSDSALKIKGIHPYHSLSYTSGDTATDSPVHVGRAGMPVKDSPRKESLLSYLTGSFPSLHNLLEGTPQRSSAAVKSSSLTRTGNTVATDMLSEHPLLSEPSSVSFYNWMSNAVGNRGSVLQESPVTKSGHNSLPTGVAPNLPTIPSASDFNTVLSSDQNTLDGTHSQHSTSQDDVAGVEEANQGFPAVQLADAQVVFKPLLSHTGIQSQDTMPFCYRMYFGEHLSFSGTLDCLRADIVDSDTAKERKGKRARRQGHVNLPPLEFKPALMLGTFSISAVVMEKSVCTPQNSTSALSFHDLSKRYYNTFHCNFTISCQSISQHVDMALVRLIHQFSTMIDDIKATQTDIKLSRYTAGSASPTPTFKTRKHRDFRSSDFSRSSRGSLNGGNRVNNAKNKRTNNENNKKESRNKNSLGRSERRTSKVSRKGSKDVVDHMTIHMDDSDSITVSEQSEPSAECWQNMYKLLNFYSLISDPTGILEKSSETFGPAGVRSPTEPTCKVVFENEQDNSSLTKTQRKRSLVTSEPQHVTLIVFGIGMVNRTHLEADIGGLTMESELKRIHGSFTLKEKMKDVLHQKMTETCATAHIGGVNIVLLEGITPNIQLEDFPTSPTSTAKQEFLTVVKCSIAKSQALYSAQRGLKTNNAAVFKVGAISINIPQHPATLHSMMVRSSHQLSKQISDLIRQPSTAPQPVKEDIATPLPSEKTPTSVNQTPVETNEFPQLPEGLEKKPIVLKFSAMLDGIAIGAALLPSLKAEYKMGRMRSHGMTGAQTRFTFELPNHRLRFTSKVSATDMSTIPPSASLNLPPVTMSGKYIMEEHDSYSDQVWSIDELPSKQGYYLQGNYLRCVAEVGSFEHNLTTDLLNHLVFVQKVFMKEVNEVIQKVSGGEQPIPLWNEHDGTADGDKPKILLYSLNLQFKGIQVTATTPSMRAVRFETGLIELELSNRLQTKASPGSSSYLKLFGKCQVDLNLALGQIVKHQVYEEAGSDFHQVAYFKTRIGLRNALREEISGSSDREAVLITLNRPIVYAQPVAFDRAVLFWLNYKAAYDNWNEQRMALHKDIHMATKEVVDMLPGIQQTSAQAFGTLFLQLTVNDLGICLPITNTAQSNHTGDLDTGSALVLTIESTLITACSSESLVSKGHFKNFCIRFADGFETSWDDWKPEIHGDLVMNACVVPDGTYEVCSRTTGQAAAESSSAGTWTLNVLWKMCGIDVHMDPNIGKRLNALGNTLTTLTGEEDIDDIADLNSVNIADLSDEDEVDTMSPTIHTEATDYRRQAASASQPGELRGRKIMKRIVDIRELNEQAKVIDDLKKLGASEGTINQEIQRYQQLESVAVNDIRRDVRKKLRRSSMRAASLKDKWGLSYKPSYSRSKSISASGRPPLKRMERASSRVGETEELPEIRVDAASPGPRVTFNIQDTIAEIRRKKISFKVVF

SEQ ID NO: 43457 - protein, 1447 aa, Homo sapiens
  Payload ID: 8931
  Gene Symbol: KIAA1109
  Gene Name: KIAA1109
  ENSP ID: ENSP00000394909
  MOD_RES (1)..(1): Any amino acid
XSRGSIYHSVEGPLTGHGESIQDSRTLPFKTHPSQASFVSALGGEDDVIEHLYIVEGEKTVESEQITPQQPVMNCYQTYLTQFQVINWSVKHPTNKRTSKSSLHRPLDLDTPTSEESSSSFEQLSVPTFKVIKQGLTANSLLDRGMQLSGSTSNTPYTPLEKKLADNTDDETLTEEWTLDQPVSQTRTTAIVEVKGTVDIVLTPLVAEALDRYIEAMVHCASTRHPAAIVDDLHAKVLREAVQNSKTTFSENLSSKQDIRGTKTEQSTIGTTNQGQAQTNLTMKQDNVTIKGLQTNVSIPKVNLCLLQASVEESPTTAPSRSVTHVSLVALCFDRIATQVRMNRGVVEETSNNAEPGRTSNFDRYVHATKMQPQSSGSLRSNAGAEKGKEIAAKLNIHRVHGQLRGLDTTDIGTCAITAIPFEKSKVLFTLEELDEFTFVDETDQQAVPDVTRIGPSQEKWGWIMFECGLENLTIKGGRQSGAVLYNSFGIMGKASDTERGGVLTSNNSSDSPTGSGYNTDVSDDNLPCDRTSPSSDLNGNSVSDEQDEGVESDDLKKDLPLMPPPPDSCSMKLTIKEIWFSFAAPTNVRSHTHAFSRQLNLLSTATPAVGAWLVPIDQLKSSLNKLETEGTLRICAVMGCIMTEALENKSVHFPLRSKYNRLTKVARFLQENPSCLLCNILHHYLHQANYSIIDDATMSDGLPALVTLKKGLVALARQWMKFIVVTPAFKGVSLHRPAQPLKPQIAMDHEHEDGLGLDNGGGLQSDTSADGAEFEFDAATVSEHTMLLEGTANRPPPGSSGPVTGAEIMRKLSKTHTHSDSALKIKGIHPYHSLSYTSGDTATDSPVHVGRAGMPVKDSPRKESLLSYLTGSFPSLHNLLEGTPQRSSAAVKSSSLTRTGNTVATDMLSEHPLLSEPSSVSFYNWMSNAVGNRGSVLQESPVTKSGHNSLPTGVAPNLPTIPSASDFNTVLSSDQNTLDGTHSQHSTSQDDVAGVEEANQGFPAVQLADAQVVFKPLLSHTGIQSQDTMPFCYRMYFGEHLSFSGTLDCLRADIVDSDTAKERKGKRARRQGHVNLPPLEFKPALMLGTFSISAVVMEKSVCTPQNSTSALSFHDLSKRYYNTFHCNFTISCQSISQHVDMALVRLIHQFSTMIDDIKATQTDIKLSRYTAGSASPTPTFKTRKHRDFRSSDFSRSSRGSLNGGNRVNNAKNKRTNNENNKKESRNKNSLGRSERRTSKVSRKGSKDVVDHMTIHMDDSDSITVSEQSEPSAECWQNMYKLLNFYSLISDPTGILEKSSETFGPAGVRSPTEPTCKVVFENEQDNSSLTKTQRKRSLVTSEPQHVTLIVFGIGMVNRTHLEADIGGLTMESELKRIHGSFTLKEKMKDVLHQKMTETCATAHIGGVNIVLLEGITPNIQLEDFPTSPTSTAKQEFLYVILFFFMAL

SEQ ID NO: 43458 - protein, 197 aa, Homo sapiens
  Payload ID: 8931
  Gene Symbol: KIAA1109
  Gene Name: KIAA1109
  ENSP ID: ENSP00000397543
  MOD_RES (1)..(1): Any amino acid
XFSCLPVSRVECMLKLPSLDLVFSSNRGELETLGTTYPAETLSPGGNATQSGTKTSASKTGIPGSSGLGSPLGRSRHSSSQSDLTSSSSSSSGLSFTACMSDFSLYVFHPYGAGKQKTAVSGLTPGSGGLGNVDEEPTSVTGRKDSLSINLEFVKVSLSRIRRSGGASFFESQSVSKSASKMDTTLINISGTQFYSF

SEQ ID NO: 43459 - protein, 1247 aa, Homo sapiens
  Payload ID: 8931
  Gene Symbol: KIAA1109
  Gene Name: KIAA1109
  ENSP ID: ENSP00000398039
  MOD_RES (1)..(1): Any amino acid
XREIGRTRTQSKIERVKVKTESQDPTSSWRSLIPVIKVNVSTGRLAFGNHYQPQTLCINFDDAFLTYTTKPPSSHLDQFMHIVKGKLENVRVMLVPSPRYVGLQNDEPPRLMGEGFVVMQSNDVDIYYYMDEPGLVPEETEENIEGEMSSEDCKLQDLPPCWGLDIVCGKGTDFNYGPWADRQRDCLWKFFFPPDYQVLKVSEIAQPGRPRQILAFELRMNIIADATIDLLFTKNRETNAVHVNVGAGSYLEINIPMTVEENGYTPAIKGQLLHVDATTSMQYRTLLEAEMLAFHINASYPRIWNMPQTWQCELEVYKATYHFIFAQKNFFTDLIQDWSSDSPPDIFSFVPYTWNFKIMFHQFEMIWAANQHNWIDCSTKQQENVYLAACGETLNIDFSLPFTDFVPATCNTKFSLRGEDVDLHLFLPDCHPSKYSLFMLVKNCHPNKMIHDTGIPAECQSGQKTVKPKWRNVTQEKSGWVECWTVPSVMLTIDYTWHPIYPQKADEQLKQSLSEMEETMLSVLRPSQKTSDRVVSSPSTSSRPPIDPSELPPDKLHVEMELSPDSQITLYGPLLNAFLCIKENYFGEDDMYMDFEEVISSPVLSLSTSSSSGWTAVGMENDKKENEGSAKSIHPLALRPWDITVLVNLYKVHGRLPVHGTTDGPECPTAFLERLCFEMKKGFRETMLQLILSPLNVFVSDNYQRPPVDEVLREGHINLSGLQLRAHAMFSAEGLPLGSDSLEYAWLIDVQAGSLTAKVTAPQLACLLEWGQTFVFHVVCREYELERPKSVIICQHGIDRRFCESKLSCIPGPCPTSDDLKYTMIRLAVDGADIYIVEHGCATNIKMGAIRVANCNLHNQSVGEGISAAIQDFQVRQYIEQLNNCRIGLQPAVLRRAYWLEAGSANLGLITVDIALAADHHSKHEAQRHFLETHDARTKRLWFLWPDDILKNKRCRNKCGCLGGCRFFGGTVTGLDFFKLEELTPSSSSAFSSTSAESDMYYGQSLLQPGEWIITKEIPKIIDGNVNGMKRKEWENKSVGIEVERKTQHLSLQVPLRSHSSSSSSEENSSSSAAQPLLAGEKESPSSVADDHLVQKEFLHGTKRDDGQASIPTEISGNSPVSPNTQDKSVGQSPLRSPLKRQASVCSTRLGSTKSLTAAFYGDKQPVTVGVQFSSDVSRSDENVLDSPKQRRSFGSFPYTPSADSNSFHQYRSMDSSMSMADSEAYFSAAEEFEPISSDEGPGTYPG

SEQ ID NO: 43460 - protein, 208 aa, Homo sapiens
  Payload ID: 8931
  Gene Symbol: KIAA1109
  Gene Name: KIAA1109
  ENSP ID: ENSP00000408229
SNHTGDLDTGSALVLTIESTLITACSSESLVSKGHFKNFCIRFADGFETSWDDWKPEIHGDLVMNACVVPDGTYEVCSRTTGQAAAGEEDIDDIADLNSVNIADLSDEDEVDTMSPTIHTSSDGSSISGDGHKLTFGQRLVNHLLGLTPPNQRHSVPAEYLCDPEMWGSPQSSQSHLKACRAHSWGNEATDYRRQAASASQPGELRGR

SEQ ID NO: 43461 - protein, 1674 aa, Homo sapiens
  Payload ID: 8931
  Gene Symbol: KIAA1109
  Gene Name: KIAA1109
  ENSP ID: ENSP00000410874
GHFKNFCIRFADGFETSWDDWKPEIHGDLVMNACVVPDGTYEVCSRTTGQAAAESSSAGTWTLNVLWKMCGIDVHMDPNIGKRLNALGNTLTTLTGEEDIDDIADLNSVNIADLSDEDEVDTMSPTIHTSSDGSSISGDGHKLTFGQRLVNHLLGLTPPNQRHSVPAEYLCDPEMWGSPQSSQSHLKACRAHSWGNEATDYRRQAASASQPGELRGRKIMKRIVDIRELNEQAKVIDDLKKLGASEGTINQEIQRYQQLESVAVNDIRRDVRKKLRRSSMRAASLKDKWGLSYKPSYSRSKSISASGRPPLKRMERASSRVGETEELPEIRVDAASPGPRVTFNIQDTLKNTVWGSTPQSSCPGEGYFQFPEETELDLLSVTIEGPSHYSSNSEGSCSVFSSPKTPGGFSPGIPFQTEEGRRDDSLSSTSEDSEKDEKDEDHERERFYIYRKPSHTSRKKATGFAAVHQLFTERWPTTPVNRSLSGTATERNIDFELDIRVEIDSGKCVLHPTTLLQEHDDISLRRSYDRSSRSLDQDSPSKKKKFQTNYASTTHLMTGKKVPSSLQTKPSDLETTVFYIPGVDVKLHYNSKTLKTESPNASRGSSLPRTLSKESKLYAKGKGSGGVKTAKLYAWVALQSLPEEMVISPCLLDFLEKALETIPITPVERNYTAVSSQDEDMGHFEIPDPMEESTTSLVSSSTSAYSSFPVDVVVYVRVQPSQIKFSCLPVSRVECMLKLPSLDLVFSSNRGELETLGTTYPAETLSPGGNATQSGTKTSASKTGIPGSSGLGSPLGRSRHSSSQSDLTSSSSSSSGLSFTACMSDFSLYVFHPYGAGKQKTAVSGLTPGSGGLGNVDEEPTSVTGRKDSLSINLEFVKVSLSRIRRSGGASFFESQSVSKSASKMDTTLINISAVCDIGSASFKYDMRRLSEILAFPRAWYRRSIARRLFLGDQTINLPTSGPGTPDSIEGVSQHLSPESSRKAYCKTWEQPSQSASFTHMPQSPNVFNEHMTNSTMSPGTVGQSLKSPASIRSRSVSDSSVPRRDSLSKTSTPFNKSNKAASQQGTPWETLVVFAINLKQLNVQMNMSNVMGNTTWTTSGLKSQGRLSVGSNRDREISMSVGLGRSQLDSKGGVVGGTIDVNALEMVAHISEHPNQQPSHKIQITMGSTEARVDYMGSSILMGIFSNADLKLQDEWKVNLYNTLDSSITDKSEIFVHGDLKWDIFQVMISRSTTPDLIKIGMKLQEFFTQQFDTSKRALSTWGPVPYLPPKTMTSNLEKSSQEQLLDAAHHRHWPGVLKVVSGCHISLFQIPLPEDGMQFGGSMSLHGNHMTLACFHGPNFRSKSWALFHLEEPNIAFWTEAQKIWEDGSSDHSTYIVQTLDFHLGHNTMVTKPCGALESPMATITKITRRRHENPPHGVASVKEWFNYVTATRNEELNLLRNVDANNTENSTTVKNSSLLSGFRGGSSYNHETETIFALPRMQLDFKSIHVQEPQEPSLQDASLKPKVECSVVTEFTDHICVTMDAELIMFLHDLVSAYLKEKEKAIFPPRILSTRPGQKSPIIIHDDNSSDKDREDSITYTTVDWRDFMCNTWHLEPTLRLISWTGRKIDPVGVDYILQKLGFHHARTTIPKWLQRGVMDPLDKVLSVLIKKLGTALQDEKEKKGKDKEEH

SEQ ID NO: 43462 - protein, 164 aa, Homo sapiens
  Payload ID: 8931
  Gene Symbol: KIAA1109
  Gene Name: KIAA1109
  ENSP ID: ENSP00000413018
NEGSAKSIHPLALRPWDITVLVNLYKVHGRLPVHGTTDGPECPTAFLERLCFEMKKGFRETMLQLILSPLNVFVSDNYQQRPPVDEVLREGHINLSGLQLRAHAMFSAEGLPLGSDSLEYAWLIDVQAGSLTAKVTAPQLSCIPGPCPTSDDLKYTMIRLAVDG

SEQ ID NO: 43463 - protein, 154 aa, Homo sapiens
  Payload ID: 8932
  Gene Symbol: KIAA1143
  Gene Name: KIAA1143
  Uniprot ID: Q96AT1
  ENSP ID: ENSP00000296121
MSKRNQVSYVRPAEPAFLARFKERVGYREGPTVETKRIQPQPPDEDGDHSDKEDEQPQVVVLKKGDLSVEEVMKIKAEIKAAKADEEPTPADGRIIYRKPVKHPSDEKYSGLTASSKKKKPNEDEVNQDSVKKNSQKQIKNSSLLSFDNEDENE

SEQ ID NO: 43464 - protein, 154 aa, Homo sapiens; identical to SEQ ID NO: 43463
  Payload ID: 8932
  Gene Symbol:
  Gene Name: KIAA1143
  ENSP ID: ENSP00000486878

SEQ ID NO: 43465 - protein, 351 aa, Homo sapiens
  Payload ID: 8933
  Gene Symbol: KIAA1147
  Gene Name: KIAA1147
  ENSP ID: ENSP00000418236
MVEWCLPQDIDLEGVEFKSMASGSHKIQSDFIYFRKGPFFGLACFANMPVESELERGARMKSVGILSPSYTLLYRYMHFLENQVRHQLEMPGHYSHLAAFYEDKKGVLHAGPGRGSSLPPVYWLPSIHRYMYPEMKFFGEQILILWKFALLRKRILIFSPPPVGVVCYRVYCCCCLANVSLPGIGGTIPESKPFFYVNVADIESLEVEVSYVACTTEKIFEEKRELYDVYVDNQNVKTHHDHLQPLLKINSADREKYRRLNEQRQMLLYSQEVEEDYNPCEEDLFVLFFLEQNNRIFQTLLEVSASQDKTLTAEHARGMGLDPQGDRSFLLDLLEAYGIDVMLVIDNPCCP

SEQ ID NO: 43466 - protein, 455 aa, Homo sapiens
  Payload ID: 8933
  Gene Symbol: KIAA1147
  Gene Name: KIAA1147
  Uniprot ID: A4D1U4
  ENSP ID: ENSP00000445768
MVEQGDAAPLLRWAEGPAVSLPQAPQPQAGGWGRGGGGGARPAAEPPRRREPEEPAAPEVLLQPGRLELGDVEEDQVVAVFVVTFDPRSGNMVEWCLPQDIDLEGVEFKSMASGSHKIQSDFIYFRKGPFFGLACFANMPVESELERGARMKSVGILSPSYTLLYRYMHFLENQVRHQLEMPGHYSHLAAFYEDKKGVLHAGPGRGSSLPPVYWLPSIHRYMYPEMKITHPAGCMSQFIKFFGEQILILWKFALLRKRILIFSPPPVGVVCYRVYCCCCLANVSLPGIGGTIPESKPFFYVNVADIESLEVEVSYVACTTEKIFEEKRELYDVYVDNQNVKTHHDHLQPLLKINSADREKYRRLNEQRQMLLYSQEVEEDYNPCEEDLFVLFFLEQNNRIFQTLLEVSASQDKTLTAEHARGMGLDPQGDRSFLLDLLEAYGIDVMLVIDNPCCP

SEQ ID NO: 43467 - protein, 455 aa, Homo sapiens; identical to SEQ ID NO: 43466
  Payload ID: 8933
  Gene Symbol: KIAA1147
  Gene Name: KIAA1147
  Uniprot ID: A4D1U4
  ENSP ID: ENSP00000459381

SEQ ID NO: 43468 - protein, 351 aa, Homo sapiens; identical to SEQ ID NO: 43465
  Payload ID: 8933
  Gene Symbol: KIAA1147
  Gene Name: KIAA1147
  ENSP ID: ENSP00000460973

SEQ ID NO: 43469 - protein, 714 aa, Homo sapiens
  Payload ID: 8934
  Gene Symbol: KIAA1161
  Gene Name: KIAA1161
  Uniprot ID: Q6NSJ0
  ENSP ID: ENSP00000297625
MLQNPQEKSQAYPRRRRPGCYAYRQNPEAIAAAAMYTFLPDNFSPAKPKPSKDLKPLLGSAVLGLLLVLAAVVAWCYYSVSLRKAERLRAELLDLKAGGFSIRNQKGEQVFRLAFRSGALDLDSCSRDGALLGCSLTADGLPLHFFIQTVRPKDTVMCYRVRWEEAAPGRAVEHAMFLGDAAAHWYGGAEMRTQHWPIRLDGQQEPQPFVTSDVYSSDAAFGGILERYWLSSRAAAIKVNDSVPFHLGWNSTERSLRLQARYHDTPYKPPAGRAAAPELSYRVCVGSDVTSIHKYMVRRYFNKPSRVPAPEAFRDPIWSTWALYGRAVDQDKVLRFAQQIRLHHFNSSHLEIDDMYTPAYGDFDFDEVKFPNASDMFRRLRDAGFRVTLWVHPFVNYNSSRFGEGVERELFVREPTGRLPALVRWWNGIGAVLDFTHPKARDWFQGHLRRLRSRYSVASFKFDAGEVSYLPRDFSTYRPLPDPSVWSRRYTEMALPFFSLAEVRVGYQSQNISCFFRLVDRDSVWGYDLGLRSLIPAVLTVSMLGYPFILPDMVGGNAVPQRTAGGDVPERELYIRWLEVAAFMPAMQFSIPPWRYDAEVVAIAQKFAALRASLVAPLLLELAGEVTDTGDPIVRPLWWIAPGDETAHRIDSQFLIGDTLLVAPVLEPGKQERDVYLPAGKWRSYKGELFDKTPVLLTDYPVDLDEIAYFTWAS

SEQ ID NO: 43470 - protein, 160 aa, Homo sapiens
  Payload ID: 8934
  Gene Symbol: KIAA1161
  Gene Name: KIAA1161
  ENSP ID: ENSP00000368437
FLPDNFSPAKPKPSKDLKPLLGSAVLGLLLVLAAVVAWCYYSVSLRKAERLRAELLDLKAGGFSIRNQKGEQEPQPFVTSDVYSSDAAFGGILERYWLSSRAAAIKVNDSVPFHLGWNSTERSLRLQARYHDTPYKPPAGRAAAPELSYRVCVGSDVTSI

SEQ ID NO: 43471 - protein, 305 aa, Homo sapiens
  Payload ID: 8935
  Gene Symbol: KIAA1191
  Gene Name: KIAA1191
  Uniprot ID: Q96A73
  ENSP ID: ENSP00000298569
MASRQPEVPALEASAPLGKMSLPIGIYRRAVSYDDTLEDPAPMTPPPSDMGSVPWKPVIPERKYQHLAKVEEGEASLPSPAMTLSSAIDSVDKVPVVKAKATHVIMNSLITKQTQESIQHFERQAGLRDAGYTPHKGLTTEETKYLRVAEALHKLKLQSGEVTKEERQPASAQSTPSTTPHSSPKQRPRGWFTSGSSTALPGPNPSTMDSGSGDKDRNLSDKWSLFGPRSLQKYDSGSFATQAYRGAQKPSPLELIRAQANRMAEDPAALKPPKMDIPVMEGKKQPPRAHNLKPRDLNVLTPTGF

SEQ ID NO: 43472 - protein, 286 aa, Homo sapiens
  Payload ID: 8935
  Gene Symbol: KIAA1191
  Gene Name: KIAA1191
  Uniprot ID: Q96A73
  ENSP ID: ENSP00000377326
MSLPIGIYRRAVSYDDTLEDPAPMTPPPSDMGSVPWKPVIPERKYQHLAKVEEGEASLPSPAMTLSSAIDSVDKVPVVKAKATHVIMNSLITKQTQESIQHFERQAGLRDAGYTPHKGLTTEETKYLRVAEALHKLKLQSGEVTKEERQPASAQSTPSTTPHSSPKQRPRGWFTSGSSTALPGPNPSTMDSGSGDKDRNLSDKWSLFGPRSLQKYDSGSFATQAYRGAQKPSPLELIRAQANRMAEDPAALKPPKMDIPVMEGKKQPPRAHNLKPRDLNVLTPTGF

SEQ ID NO: 43473 - protein, 305 aa, Homo sapiens; identical to SEQ ID NO: 43471
  Payload ID: 8935
  Gene Symbol: KIAA1191
  Gene Name: KIAA1191
  Uniprot ID: Q96A73
  ENSP ID: ENSP00000421061

SEQ ID NO: 43474 - protein, 95 aa, Homo sapiens
  Payload ID: 8935
  Gene Symbol: KIAA1191
  Gene Name: KIAA1191
  ENSP ID: ENSP00000421746
MSLPIGIYRRAVSYDDTLEDPAPMTPPPSDMGSVPWKPVIPERKYQHLAKVEEGEASLPSPAMTLSSAIDSVDKVPVVKAKATHVIMNSLITKQT

SEQ ID NO: 43475 - protein, 70 aa, Homo sapiens
  Payload ID: 8935
  Gene Symbol: KIAA1191
  Gene Name: KIAA1191
  ENSP ID: ENSP00000423741
MSLPIGIYRRAVSYDDTLEDPAPMTPPPSDMGSVPWKPVIPERKYQHLAKVEEGEASLPSPAMTLSSAID

SEQ ID NO: 43476 - protein, 65 aa, Homo sapiens
  Payload ID: 8935
  Gene Symbol: KIAA1191
  Gene Name: KIAA1191
  ENSP ID: ENSP00000424906
MSLPIGIYRRAVSYDDTLEDPAPMTPPPSDMGSVPWKPVIPERKYQHLAKVEEGEASLPSPAMTL

SEQ ID NO: 43477 - protein, 40 aa, Homo sapiens
  Payload ID: 8935
  Gene Symbol: KIAA1191
  Gene Name: KIAA1191
  ENSP ID: ENSP00000433506
MASRQPEVPETKVTEWRGNKRREAACISPVHPKHHSALFT

SEQ ID NO: 43478 - protein, 224 aa, Homo sapiens
  Payload ID: 8935
  Gene Symbol: KIAA1191
  Gene Name: KIAA1191
  ENSP ID: ENSP00000477518
MTLSSAIDSVDKVPVVKAKATHVIMNSLITKQTQESIQHFERQAGLRDAGYTPHKGLTTEETKYLRVAEALHKLKLQSGEVTKEERQPASAQSTPSTTPHSSPKQRPRGWFTSGSSTALPGPNPSTMDSGSGDKDRNLSDKWSLFGPRSLQKYDSGSFATQAYRGAQKPSPLELIRAQANRMAEDPAALKPPKMDIPVMEGKKQPPRAHNLKPRDLNVLTPTGF

SEQ ID NO: 43479 - protein, 286 aa, Homo sapiens; identical to SEQ ID NO: 43472
  Payload ID: 8935
  Gene Symbol: KIAA1191
  Gene Name: KIAA1191
  Uniprot ID: Q96A73
  ENSP ID: ENSP00000479627

SEQ ID NO: 43480 - protein, 1709 aa, Homo sapiens
  Payload ID: 8936
  Gene Symbol: KIAA1210
  Gene Name: KIAA1210
  Uniprot ID: Q9ULL0
  ENSP ID: ENSP00000384670
MRAGWTPRGFSAFHASLLPGRHPYLAHLGPRDRGARIGSRAYSQGCCSCLWLTYKGKKEGSTKGELGPAAVTDLEIPSYSRGFLPCTPRFPTTWCRGPGCFCGTAVIAGNLGDLARIVGPSHHASQLLLLQEQDSGNHPTMAESLSEISDSLDVLEAGDEGKKKCKFKALKSFFVKKKEKEAEDTQEEEMLELSLSSSNINISSLQPVRENQPTKARAKSSMGSKALSHDSIFMLGPEPERSASKMFPSMDPQRGRPQQRSHISRTLPKPRSKVPGVVSGAMSGAVLQNVPTSAVWVAGPKITENPPSRRRRLSIIPPVIQPEIISKNLVEISLDDESPKNPQKKALPHKSLTATQSFSELSSGPDCSQSLTAFATLASTSSTQLPIGFSTPATTQGCLDSSAARHKMTLNPRKQKKNLQVIIRGLPVWFSHFQGILEGSLQCVTQTLETPNLDEPLPVEPKEEEPNLPLVSEEEKSITKPKEINEKKLGMDSADSSSQKQNNKTEMYDKKTTDQAPNTDASRSQGYPMSAAYGRRWRRKGASVSGLSGCEFKGRSLKQSSEGYGLGDRAGSSPTNKTARNVPFSHLSLEKDNMEQPTTSQPETTTPQGLLSDKDDMGRRNAGIDFGSRKASAAQPIPENMDNSMVSDPQPYHEDAASGAEKTEARASLSLMVESLSTTQEEAILSVAAEAQVFMNPSHIQLEDQEAFSFDLQKAQSKMESAQDVQTICKEKPSGNVHQTFTASVLGMTSTTAKGDVYAKTLPPRSLFQSSRKPDAEEVSSDSENIPEEGDGSEELAHGHSSQSLGKFEDEQEVFSESKSFVEDLSSSEEELDLRCLSQALEEPEDAEVFTESSSYVEKYNTSDDCSSSEEDLPLRHPAQALGKPKNQQEVSSASNNTPEEQNDFMQQLPSRCPSQPIMNPTVQQQVPTSSVGTSIKQSDSVEPIPPRHPFQPWVNPKVEQEVSSSPKSMAVEESISMKPLPPKLLCQPLMNPKVQQNMFSGSEDIAVERVISVEPLLPRYSPQSLTDPQIRQISESTAVEEGTYVEPLPPRCLSQPSERPKFLDSMSTSAEWSSPVAPTPSKYTSPPWVTPKFEELYQLSAHPESTTVEEDISKEQLLPRHLSQLTVGNKVQQLSSNFERAAIEADISGSPLPPQYATQFLKRSKVQEMTSRLEKMAVEGTSNKSPIPRRPTQSFVKFMAQQIFSESSALKRGSDVAPLPPNLPSKSLSKPEVKHQVFSDSGSANPKGGISSKMLPMKHPLQSLGRPEDPQKVFSYSERAPGKCSSFKEQLSPRQLSQALRKPEYEQKVSPVSASSPKEWRNSKKQLPPKHSSQASDRSKFQPQMSSKGPVNVPVKQSSGEKHLPSSSPFQQQVHSSSVNAAARRSVFESNSDNWFLGRDEAFAIKTKKFSQGSKNPIKSIPAPATKPGKFTIAPVRQTSTSGGIYSKKEDLESGDGNNNQHANLSNQDDVEKLFGVRLKRAPPSQKYKSEKQDNFTQLASVPSGPISSSVGRGHKIRSTSQGLLDAAGNLTKISYVADKQQSRPKSESMAKKQPACKTPGKPAGQQSDYAVSEPVWITMAKQKQKSFKAHISVKELKTKSNAGADAETKEPKYEGAGSANENQPKKMFTSSVHKQEKTAQMKPPKPTKSVGFEAQKILQVPAMEKETKRSSTLPAKFQNPVEPIEPVWFSLARKKAKAWSHMAEITQ

SEQ ID NO: 43481 - protein, 1233 aa, Homo sapiens
  Payload ID: 8937
  Gene Symbol: KIAA1211
  Gene Name: KIAA1211
  Uniprot ID: Q6ZU35
  ENSP ID: ENSP00000264229
MGTRAFSHDSIFIPDGGAESEQTVQAMSQDNILGKVKTLQQQLGKNIKFGQRSPNAIPMNKANSGEASLEEDLFLTSPMEIVTQQDIVLSDAENKSSDTPSSLSPLNLPGAGSEMEEKVAPVKPSRPKRHFSSAGTIESVNLDAIPLAIARLDNSAAKHKLAVKPKKQRVSKKHRRLAQDPQHEQGGLESRPCLDQNGHPGEDKPTWHEEEPNPLDSEEERRRQEDYWRELEAKCKRQKAEAAEKRRLEEQRLQALERRLWEENRRQELLEEEGEGQEPPLEAERAPREEQQRSLEAPGWEDAERREREERERLEAEEERRRLQAQAQAEERRRLEEDARLEERRRQEEEEGRCAEELKRQEEEEAEGWEELEQQEAEVQGPPEALEETGEGRRGAEEEDLGEEEEEGQAHLEDWRGQLSELLNDFEERLEDQERLKPEGQREHSEEPGICEEQNPEAERRREQQGRSGDFQGADRPGPEEKREEGDTEPLLKQEGPVEAAQPPVERKEAAALEQGRKVEELRWQEVDERQTMPRPYTFQVSSGGKQILFPKVNLSPVTPAKDTGLTAAPQEPKAPKASPVQHALPSSLSVPHTAILVTGAQLCGPAVNLSQIKDTACKSLLGLEEKKHAEAPAGENPPRGPGDARAGSGKAKPRQESPSSASALAEWASIRSRILKNAESDPRSSERDQLRPGDESTPRGRCDSRGNQRKTPPVNAKFSIMPAWQKFSDGGTETSKQSTEAESIRKRPMLGPSEETAPQPPPAGVRELGKGPEKSEMHREPADTTEGCKFAKDLPSFLVPSLPYPPQKVVAHTEFTTSSDSETANGIAKPDPVMPGGEEKASPFGIKLRRTNYSLRFNCDQQAEQKKKKRHSSTGDSADAGPPAAGSARGEKEMEGVALKHGPSLPQERKQAPSTRRDSAEPSSSRSVPVAHPGPPPASSQTPAPEHDKAANKMPLAQKPALAPKPTSQTPPASPLSKLSRPYLVELLSRRAGRPDPEPSEPSKEDQESSDRRPPSPPGPEERKGQKRDEEEEATERKPASPPLPATQQEKPSQTPEAGRKEKPMLQSRHSLDGSKLTEKVETAQPLWITLALQKQKGFREQQATREERKQAREAKQAEKLSKENVSVSVQPGSSSVSRAGSLHKSTALPEEKRPETAVSRLERREQLKKANTLPTSVTVEISDSAPPAPLVKEVTKRFSTPDAAPVSTEPAWLALAKRKAKAWSDCPQIIK

SEQ ID NO: 43482 - protein, 1233 aa, Homo sapiens; identical to SEQ ID NO: 43481
  Payload ID: 8937
  Gene Symbol: KIAA1211
  Gene Name: KIAA1211
  Uniprot ID: Q6ZU35
  ENSP ID: ENSP00000423366

SEQ ID NO: 43483 - protein, 1226 aa, Homo sapiens
  Payload ID: 8937
  Gene Symbol: KIAA1211
  Gene Name: KIAA1211
  ENSP ID: ENSP00000444006
MGEQKVSRQFKQCHRTTSWAKSKLFSRLSSMFLQQLGKNIKFGQRSPNAIPMNKANSGEASLEEDLFLTSPMEIVTQQDIVLSDAENKSSDTPSSLSPLNLPGAGSEMEEKVAPVKPSRPKRHFSSAGTIESVNLDAIPLAIARLDNSAAKHKLAVKPKKQRVSKKHRRLAQDPQHEQGGLESRPCLDQNGHPGEDKPTWHEEEPNPLDSEEERRRQEDYWRELEAKCKRQKAEAAEKRRLEEQRLQALERRLWEENRRQELLEEEGEGQEPPLEAERAPREEQQRSLEAPGWEDAERREREERERLEAEEERRRLQAQAQAEERRRLEEDARLEERRRQEEEEGRCAEELKRQEEEEAEGWEELEQQEAEVQGPPEALEETGEGRRGAEEEDLGEEEEEGQAHLEDWRGQLSELLNDFEERLEDQERLKPEGQREHSEEPGICEEQNPEAERRREQQGRSGDFQGADRPGPEEKREEGDTEPLLKQEGPVEAAQPPVERKEAAALEQGRKVEELRWQEVDERQTMPRPYTFQVSSGGKQILFPKVNLSPVTPAKDTGLTAAPQEPKAPKASPVQHALPSSLSVPHTAILVTGAQLCGPAVNLSQIKDTACKSLLGLEEKKHAEAPAGENPPRGPGDARAGSGKAKPRQESPSSASALAEWASIRSRILKNAESDPRSSERDQLRPGDESTPRGRCDSRGNQRKTPPVNAKFSIMPAWQKFSDGGTETSKQSTEAESIRKRPMLGPSEETAPQPPPAGVRELGKGPEKSEMHREPADTTEGCKFAKDLPSFLVPSLPYPPQKVVAHTEFTTSSDSETANGIAKPDPVMPGGEEKASPFGIKLRRTNYSLRFNCDQQAEQKKKKRHSSTGDSADAGPPAAGSARGEKEMEGVALKHGPSLPQERKQAPSTRRDSAEPSSSRSVPVAHPGPPPASSQTPAPEHDKAANKMPLAQKPALAPKPTSQTPPASPLSKLSRPYLVELLSRRAGRPDPEPSEPSKEDQESSDRRPPSPPGPEERKGQKRDEEEEATERKPASPPLPATQQEKPSQTPEAGRKEKPMLQSRHSLDGSKLTEKVETAQPLWITLALQKQKGFREQQATREERKQAREAKQAEKLSKENVSVSVQPGSSSVSRAGSLHKSTALPEEKRPETAVSRLERREQLKKANTLPTSVTVEISDSAPPAPLVKEVTKRFSTPDAAPVSTEPAWLALAKRKAKAWSDCPQIIK

SEQ ID NO: 43484 - protein, 85 aa, Homo sapiens
  Payload ID: 8937
  Gene Symbol: KIAA1211
  Gene Name: KIAA1211
  ENSP ID: ENSP00000473672
  MOD_RES (1)..(1): Any amino acid
XQTPEAGRKEKPMLQSRHSLDGSKLTEKVETAQPLWITLALQKQKGFREQQATREERKQAREAKQAEKLSKENWRSPTRLPQRRW

SEQ ID NO: 43485 - protein, 37 aa, Homo sapiens
  Payload ID: 8937
  Gene Symbol: KIAA1211
  Gene Name: KIAA1211
  ENSP ID: ENSP00000486652
MGTRAFSHDSIFIPDGGAESEQTVQAMSQDNILGKVK

SEQ ID NO: 43486 - protein, 962 aa, Homo sapiens
  Payload ID: 8938
  Gene Symbol: KIAA1211L
  Gene Name: KIAA1211-like
  Uniprot ID: Q6NV74
  ENSP ID: ENSP00000380996
MISTRVMDIKLREAAEGLGEDSTGKKKSKFKTFKKFFGKKKRKESPSSTGSSTWKQSQTRNEVIAIESGPVGYDSEDELEESRGTLGSRALSHDSIFIPESGQDATRPVRVFSQENVCDRIKALQLKIQCNVKMGPPPPPGGLPAKRGEDAGMSSEDDGLPRSPPEMSLLHDVGPGTTIKVSVVSPDHVSDSTVSARISDNSLAPVADFSYPAESSSCLDNSAAKHKLQVKPRNQRSSKMRRLSSRAQSESLSDLTCTPEEEENEEKPLLEVSPEERPSSGQQDVAPDRGPEPGPPAPLPPPGGARARRARLQHSSALTASVEEGGVPGEDPSSRPATPELAEPESAPTLRVEPPSPPEGPPNPGPDGGKQDGEAPPAGPCAPATDKAEEVVCAPEDVASPFPTAIPEGDTTPPETDPAATSEAPSARDGPERSVPKEAEPTPPVLPDEEKGPPGPAPEPEREAETEPERGAGTEPERIGTEPSTAPAPSPPAPKSCLKHRPAAASEGPAASPPLAAAESPPVEPGPGSLDAEAAAPERPKAERAEAPPAGAERAAPERKAERGGAELRGAKKFSVSSCRARPRPGVSRPLERASGRLPLARSGPVWRSEAALDDLQGLPEPQHAKPGPRKLAERGPQDSGDRAASPAGPRKSPQEAAAAPGTREPCPAAQEPAPSEDRNPFPVKLRSTSLSLKYRDGASQEVKGVKRYSAEVRLERSLTVLPKEEKCPLGTAPALRGTRAPSDQGKGKARPPEPLSSKPPLPRKPLLQSFTLPHQPAPPDAGPGEREPRKEPRTAEKRPLRRGAEKSLPPAATGPGADGQPAPPWITVTRQKRRGTLDQPPNQEDKPGARTLKSEPGKQAKVPERGQEPVKQADFVRSKSFLITPVKPAVDRKQGAKLNFKEGLQRGISLSHQNLAQSAVMMEKELHQLKRASYASTDQPSWMELARKKSQAWSDMPQIIK

SEQ ID NO: 43487 - protein, 194 aa, Homo sapiens
  Payload ID: 8938
  Gene Symbol: KIAA1211L
  Gene Name: KIAA1211-like
  ENSP ID: ENSP00000387902
MISLASVQDKSELDMISTRVMDIKLREAAEGLGEDSTGKKKSKFKTFKKFFGKKKRKESPSSTGSSTWKQSQTRNEVIAIESGPVGYDSEDELEESRGTLGSRALSHDSIFIPESGQDATRPVRVFSQENVCDRIKALQLKIQCNVKMGPPPPPGGLPAKRGEDAGMSSEDDGLPRSPPEMSLLHDVGPGTTIK

SEQ ID NO: 43488 - protein, 178 aa, Homo sapiens
  Payload ID: 8938
  Gene Symbol: KIAA1211L
  Gene Name: KIAA1211-like
  ENSP ID: ENSP00000390799
MISLASVQDKSELDMISTRVMDIKLREAAEGLGEDSTGKKKSKFKTFKKFFGKKKRKESPSSTGSSTWKQSQTRNEVIAIESGPVGYDSEDELEESRGTLGSRALSHDSIFIPESGQDATRPVRVFSQENVCDRIKALQLKIQCNVKMGPPPPPGGLPAKRGEDAGMSSEDDGLPRSP

SEQ ID NO: 43489 - protein, 268 aa, Homo sapiens
  Payload ID: 8938
  Gene Symbol: KIAA1211L
  Gene Name: KIAA1211-like
  ENSP ID: ENSP00000396657
MRELEAHSTLRRMAAFYQCIRPDPSELDMISTRVMDIKLREAAEGLGEDSTGKKKSKFKTFKKFFGKKKRKESPSSTGSSTWKQSQTRNEVIAIESGPVGYDSEDELEESRGTLGSRALSHDSIFIPESGQDATRPVRVFSQENVCDRIKALQLKIQCNVKMGPPPPPGGLPAKRGEDAGMSSEDDGLPRSPPEMSLLHDVGPGTTIKVSVVSPDHVSDSTVSARISDNSLAPVADFSYPAESSSCLDNSAAKHKLQVKPRNQRSSKM

SEQ ID NO: 43490 - protein, 37 aa, Homo sapiens
  Payload ID: 8938
  Gene Symbol: KIAA1211L
  Gene Name: KIAA1211-like
  ENSP ID: ENSP00000403428
MISLASVQDKSELDMISTRVMDIKLREAAEGLGEDST

SEQ ID NO: 43491 - protein, 606 aa, Homo sapiens
  Payload ID: 8938
  Gene Symbol: KIAA1211L
  Gene Name: KIAA1211-like
  ENSP ID: ENSP00000480530
MDIKLREAAEGLGEDSTGKKKSKFKTFKKFFGKKKRKESPSSTGSSTWKQSQTRNEVIAIESGPVGYDSEDELEESRGTLGSRALSHDSIFIPESGQDATRPVRVFSQENVCDRIKALQLKIQCNVKMGPPPPPGGLPAKRGEDAGMSSEDDGLPRSPPEMSLLHDVGPGTTIKVSVVSPDHVSDSTVSARISDNSLAPVADFSYPAESSSCLDNSAAKHKLQVKPRNQRSSKMRRLSSRAQSESLSDLTCTPEEEENEEKPLLEVSPEERPSSGQQDVAPDRGPEPGPPAPLPPPGGARARRARLQHSSALTASVEEGGVPGEDPSSRPATPELAEPESAPTLRVEPPSPPEGPPNPGPDGGKQDGEAPPAGPCAPATDKAEEVVCAPEDVASPFPTAIPEGDTTPPETDPAATSEAPSARDGPERSVPKEAEPTPPVLPDEEKGPPGPAPEPEREAETEPERGAGTEPERIGTEPSTAPAPSPPAPKSCLKHRPAAASEGRRVPAACRCGVSPGGARPRFPRRRGRRPGAPQGRASRGATGGRREGGARAEGGEGRCRAARREEVLGVLVPSAASSGRLPPAGTGQRPPAPREERPGLEERGGS

SEQ ID NO: 43492 - protein, 932 aa, Homo sapiens
  Payload ID: 8939
  Gene Symbol: KIAA1217
  Gene Name: KIAA1217
  Uniprot ID: Q5T5P2
  ENSP ID: ENSP00000302343
MQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSEDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQAFQKCSFMDVNSNSHAEPSRADSHVKDTRSGATVPPKEKKNLEFFHEDVRKSDVEYENGPQMEFQKGSSGAPQTSRMPVPMSAKNRPGTLDKPGKQSKLQDPRQYRQVVLP

SEQ ID NO: 43493 - protein, 1465 aa, Homo sapiens
  Payload ID: 8939
  Gene Symbol: KIAA1217
  Gene Name: KIAA1217
  Uniprot ID: Q5T5P2
  ENSP ID: ENSP00000365634
MQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSEDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQAFQKCSFMDVNSNSHAEPSRADSHVKDTRSGATVPPKEKKNLEFFHEDVRKSDVEYENGPQMEFQKVTTGAVRPSDPPKWERGMENSISDASRTSEYKTEIIMKENSISNMSLLRDSRNYSQETVPKASFGFSGISPLEDEINKGSKISGLQYSIPDTENQTLNYGKTKEMEKQNTDKCHVSSHTRLTESSVHDFKTEDQEVITTDFGQVVLRPKEARHANVNPNEDGESSSSSPTEENAATDNIAFMITETTVQVLSSGEVHDIVSQKGEDIQTVNIDARKEMTPRQEGTDNEDPVVCLDKKPVIIIFDEPMDIRSAYKRLSTIFEECDEELERMMMEEKIEEEEEEENGDSVVQNNNTSQMSHKKVAPGNLRTGQQVETKSQPHSLATETRNPGGQEMNRTELNKFSHVDSPNSECKGEDATDDQFESPKKKFKFKFPKKQLAALTQAIRTGTKTGKKTLQVVVYEEEEEDGTLKQHKEAKRFEIARSQPEDTPENTVRRQEQPSIESTSPISRTDEIRKNTYRTLDSLEQTIKQLENTISEMSPKALVDTSCSSNRDSVASSSHIAQEASPRPLLVPDEGPTALEPPTSIPSASRKGSSGAPQTSRMPVPMSAKNRPGTLDKPGKQSKLQDPRQYRQVVLP

SEQ ID NO: 43494 - protein, 1374 aa, Homo sapiens
  Payload ID: 8939
  Gene Symbol: KIAA1217
  Gene Name: KIAA1217
  Uniprot ID: Q5T5P2
  ENSP ID: ENSP00000365635
MEENESQKCEPCLPYSADRRQMQEQGKGNLHVTSPEDAECRRTKERLSNGNSRGSVSKSSRNIPRRHTLGGPRSSKEILGMQTSEMDRKREAFLEHLKQKYPHHASAIMGHQERLRDQTRSPKLSHSPQPPSLGDPVEHLSETSADSLEAMSEGDAPTPFSRGSRTRASLPVVRSTNQTKERSLGVLYLQYGDETKQLRMPNEITSADTIRALFVSAFPQQLTMKMLESPSVAIYIKDESRNVYYELNDVRNIQDRSLLKVYNKDPAHAFNHTPKTMNGDMRMQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQAFQKCSFMDVNSNSHAEPSRADSHVKDTRSGATVPPKEKKNLEFFHEDVRKSDVEYENGPQMEFQKGSSGAPQTSRMPVPMSAKNRPGTLDKPGKQSKLQDPRQYRQANGSAKKSGGDFKPTSPSLPASKIPALSPSSGKSSSLPSSSGDSSNLPNPPATKPSIASNPLSPQTGPPAHSASLIPSVSNGSLKFQSLTHTGKGHHLSFSPQSQNGRAPPPLSFSSSPPSPASSVSLNQGAKGTRTIHTPSLTSYKAQNGSSSKATPSTAKETS

SEQ ID NO: 43495 - protein, 1943 aa, Homo sapiens
  Payload ID: 8939
  Gene Symbol: KIAA1217
  Gene Name: KIAA1217
  Uniprot ID: Q5T5P2
  ENSP ID: ENSP00000365637
MEENESQKCEPCLPYSADRRQMQEQGKGNLHVTSPEDAECRRTKERLSNGNSRGSVSKSSRNIPRRHTLGGPRSSKEILGMQTSEMDRKREAFLEHLKQKYPHHASAIMGHQERLRDQTRSPKLSHSPQPPSLGDPVEHLSETSADSLEAMSEGDAPTPFSRGSRTRASLPVVRSTNQTKERSLGVLYLQYGDETKQLRMPNEITSADTIRALFVSAFPQQLTMKMLESPSVAIYIKDESRNVYYELNDVRNIQDRSLLKVYNKDPAHAFNHTPKTMNGDMRMQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETRERMQAMEKQIASLTGLVQSALFKGPITSYSKDASSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSEDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQAFQKCSFMDVNSNSHAEPSRADSHVKDTRSGATVPPKEKKNLEFFHEDVRKSDVEYENGPQMEFQKVTTGAVRPSDPPKWERGMENSISDASRTSEYKTEIIMKENSISNMSLLRDSRNYSQETVPKASFGFSGISPLEDEINKGSKISGLQYSIPDTENQTLNYGKTKEMEKQNTDKCHVSSHTRLTESSVHDFKTEDQEVITTDFGQVVLRPKEARHANVNPNEDGESSSSSPTEENAATDNIAFMITETTVQVLSSGEVHDIVSQKGEDIQTVNIDARKEMTPRQEGTDNEDPVVCLDKKPVIIIFDEPMDIRSAYKRLSTIFEECDEELERMMMEEKIEEEEEEENGDSVVQNNNTSQMSHKKVAPGNLRTGQQVETKSQPHSLATETRNPGGQEMNRTELNKFSHVDSPNSECKGEDATDDQFESPKKKFKFKFPKKQLAALTQAIRTGTKTGKKTLQVVVYEEEEEDGTLKQHKEAKRFEIARSQPEDTPENTVRRQEQPSIESTSPISRTDEIRKNTYRTLDSLEQTIKQLENTISEMSPKALVDTSCSSNRDSVASSSHIAQEASPRPLLVPDEGPTALEPPTSIPSASRKGSSGAPQTSRMPVPMSAKNRPGTLDKPGKQSKLQDPRQYRQANGSAKKSGGDFKPTSPSLPASKIPALSPSSGKSSSLPSSSGDSSNLPNPPATKPSIASNPLSPQTGPPAHSASLIPSVSNGSLKFQSLTHTGKGHHLSFSPQSQNGRAPPPLSFSSSPPSPASSVSLNQGAKGTRTIHTPSLTSYKAQNGSSSKATPSTAKETS

SEQ ID NO: 43496 - protein, 933 aa, Homo sapiens
  Payload ID: 8939
  Gene Symbol: KIAA1217
  Gene Name: KIAA1217
  ENSP ID: ENSP00000365639
MEENESQKCEPCLPYSADRRQMQEQGKGNLHVTSPEDAECRRTKERLSNGNSRGSVSKSSRNIPRRHTLGGPRSSKEILGMQTSEMDRKREAFLEHLKQKYPHHASAIMGHQERLRDQTRSPKLSHSPQPPSLGDPVEHLSETSADSLEAMSEGDAPTPFSRGSRTRASLPVVRSTNQTKERSLGVLYLQYGDETKQLRMPNEITSADTIRALFVSAFPQQLTMKMLESPSVAIYIKDESRNVYYELNDVRNIQDRSLLKVYNKDPAHAFNHTPKTMNGDMRMQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKA

SEQ ID NO: 43497 - protein, 1264 aa, Homo sapiens
  Payload ID: 8939
  Gene Symbol: KIAA1217
  Gene Name: KIAA1217
  Uniprot ID: Q5T5P2
  ENSP ID: ENSP00000365645
MQTSEMDRKREAFLEHLKQKYPHHASAIMGHQERLRDQTRSPKLSHSPQPPSLGDPVEHLSETSADSLEAMSEGDAPTPFSRGSRTRASLPVVRSTNQTKERSLGVLYLQYGDETKQLRMPNEITSADTIRALFVSAFPQQLTMKMLESPSVAIYIKDESRNVYYELNDVRNIQDRSLLKVYNKDPAHAFNHTPKTMNGDMRMQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETRERMQAMEKQIASLTGLVQSALFKGPITSYSKDASSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSEDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQGSSGAPQTSRMPVPMSAKNRPGTLDKPGKQSKLQDPRQYRQANGSAKKSGGDFKPTSPSLPASKIPALSPSSGKSSSLPSSSGDSSNLPNPPATKPSIASNPLSPQTGPPAHSASLIPSVSNGSLKFQSLTHTGKGHHLSFSPQSQNGRAPPPLSFSSSPPSPASSVSLNQGAKGTRTIHTPSLTSYKAQNGSSSKATPSTAKETS

SEQ ID NO: 43498 - protein, 906 aa, Homo sapiens
  Payload ID: 8939
  Gene Symbol: KIAA1217
  Gene Name: KIAA1217
  Uniprot ID: Q5T5P2
  ENSP ID: ENSP00000379722
MQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSEDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQAFQKCSFMDVNSNSHAEPSRADSHVKDTRSGATVPPKEKKGSSGAPQTSRMPVPMSAKNRPGTLDKPGKQSKLQDPRQYRQVVLP

SEQ ID NO: 43499 - protein, 866 aa, Homo sapiens
  Payload ID: 8939
  Gene Symbol: KIAA1217
  Gene Name: KIAA1217
  Uniprot ID: Q5T5P2
  ENSP ID: ENSP00000379723
MQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSEDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQGSSGAPQTSRMPVPMSAKNRPGTLDKPGKQSKLQDPRQYRQVVLP

SEQ ID NO: 43500 - protein, 1264 aa, Homo sapiens; identical to SEQ ID NO: 43497
  Payload ID: 8939
  Gene Symbol: KIAA1217
  Gene Name: KIAA1217
  Uniprot ID: Q5T5P2
  ENSP ID: ENSP00000389680

SEQ ID NO: 43501 - protein, 1349 aa, Homo sapiens
  Payload ID: 8939
  Gene Symbol: KIAA1217
  Gene Name: KIAA1217
  Uniprot ID: Q5T5P2
  ENSP ID: ENSP00000392625
MEENESQKCEPCLPYSADRRQMQEQGKGNLHVTSPEDAECRRTKERLSNGNSRGSVSKSSRNIPRRHTLGGPRSSKEILGMQTSEMDRKREAFLEHLKQKYPHHASAIMGHQERLRDQTRSPKLSHSPQPPSLGDPVEHLSETSADSLEAMSEGDAPTPFSRGSRTRASLPVVRSTNQTKERSLGVLYLQYGDETKQLRMPNEITSADTIRALFVSAFPQQLTMKMLESPSVAIYIKDESRNVYYELNDVRNIQDRSLLKVYNKDPAHAFNHTPKTMNGDMRMQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSEDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQAFQKCSFMDVNSNSHAEPSRADSHVKDTRSGATVPPKEKKGSSGAPQTSRMPVPMSAKNRPGTLDKPGKQSKLQDPRQYRQANGSAKKSGGDFKPTSPSLPASKIPALSPSSGKSSSLPSSSGDSSNLPNPPATKPSIASNPLSPQTGPPAHSASLIPSVSNGSLKFQSLTHTGKGHHLSFSPQSQNGRAPPPLSFSSSPPSPASSVSLNQGAKGTRTIHTPSLTSYKAQNGSSSKATPSTAKETS

SEQ ID NO: 43502 - protein, 783 aa, Homo sapiens
  Payload ID: 8939
  Gene Symbol: KIAA1217
  Gene Name: KIAA1217
  ENSP ID: ENSP00000404798
MSEGDAPTPFSRGSRTRASLPVVRSTNQTKERSLGVLYLQYGDETKQLRMPNEITSADTIRALFVSAFPQQLTMKMLESPSVAIYIKDESRNVYYELNDVRNIQDRSLLKVYNKDPAHAFNHTPKTMNGDMRMQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKA

SEQ ID NO: 43503 - protein, 180 aa, Homo sapiens
  Payload ID: 8939
  Gene Symbol: KIAA1217
  Gene Name: KIAA1217
  ENSP ID: ENSP00000489052
MEENESQKCEPCLPYSADRRQMQEQGKGNLHVTSPEDAECRRTKERLSNGNSRGSVSKSSRNIPRRHTLGGPRSSKEILGMQTSEMDRKREAFLEHLKQKYPHHASAIMGHQERLRDQALKGMLISLQAELDIQRQGAPNCLTVLNHPVWVTRSSIYQRRPLILWKPCLRGMLQPLFPEA

SEQ ID NO: 43504 - protein, 453 aa, Homo sapiens
  Payload ID: 8939
  Gene Symbol: KIAA1217
  Gene Name: KIAA1217
  ENSP ID: ENSP00000489575
  MOD_RES (1)..(1): Any amino acid
XDKIMAELQAFQKCSFMDVNSNSHAEPSRADSHVKDTRSGATVPPKEKKGIFGSWRTKQSKNLEFFHEDVRKSDVEYENGPQMEFQKVTTGAVRPSDPPKWERGMENSISDASRTSEYKTEIIMKENSISNMSLLRDSRNYSQETVPKASFGFSGISPLEDEINKGSKISGLQYSIPDTENQTLNYGKTKEMEKQNTDKCHVSSHTRLTESSVHDFKTEDQEVITTDFGQVVLRPKEARHANVNPNEDGESSSSSPTEENAATDNIAFMITETTVQVLSSGEVHDIVSQKGEDIQTVNIDARKEMTPRQEGTDNEDPVVCLDKKPVIIIFDEPMDIRSAYKRLSTIFEECDEELERMMMEEKIEEEEEEENGDSVVQNNNTSQMSHKKVAPGNLRTGQQVETKSQPHSLATETRNPGGQEMNRTELNKFSHVDSPNSECKGEDATDDQFESPK

SEQ ID NO: 43505 - protein, 409 aa, Homo sapiens
  Payload ID: 8940
  Gene Symbol: KIAA1257
  Gene Name: KIAA1257
  Uniprot ID: Q9ULG3
  ENSP ID: ENSP00000265068
MSLHAWEWEEDPASIEPISSITSFYQSTSECDVEEHLKAKARAQESDSDRPCSSIESSSEPASTFSSDVPHVVPCKFTISLAFPVNMGQKGKYASLIEKYKKHPKTDSSVTKMRRFYHIEYFLLPDDEEPKKVDILLFPMVAKVFLESGVKTVKPWHEGDKAWVSWEQTFNITVTKELLKKINFHKITLRLWNTKDKMSRKVRYYRLKTAGFTDDVGAFHKSEVRHLVLNQRKLSEQGIENTNIVREESNQEHPPGKQEKTEKHPKSLQGSHQAEPETSSKNSEEYEKSLKMDDSSTIQWSVSRTPTISLAGASMMEIKELIESESLSSLTNILDRQRSQIKGKDSEGRRKIQRRHKKPLAEEEADPTLTGPRKQSAFSIQLAVMPLLAGTHCLPCSQQLLLVLWPERP

SEQ ID NO: 43506 - protein, 297 aa, Homo sapiens
  Payload ID: 8940
  Gene Symbol: KIAA1257
  Gene Name: KIAA1257
  Uniprot ID: Q9ULG3
  ENSP ID: ENSP00000422539
MRRFYHIEYFLLPDDEEPKKVDILLFPMVAKVFLESGVKTVKPWHEGDKAWVSWEQTFNITVTKELLKKINFHKITLRLWNTKDKMSRKVRYYRLKTAGFTDDVGAFHKSEVRHLVLNQRKLSEQGIENTNIVREESNQEHPPGKQEKTEKHPKSLQGSHQAEPETSSKNSEEYEKSLKMDDSSTIQWSVSRTPTISLAGASMMEIKELIESESLSSLTNILDRQRSQIKGKDSEGRRKIQRRHKKPLAEEEADPTLTGPRKQSAFSIQLAVMPLLAGTHCLPCSQQLLLVLWPERP

SEQ ID NO: 43507 - protein, 400 aa, Homo sapiens
  Payload ID: 8940
  Gene Symbol: KIAA1257
  Gene Name: KIAA1257
  ENSP ID: ENSP00000426217
MSLHAWEWEEDPASIEPISSITSFYQSTSECDVEEHLKAKARAQESDSDRPCSSIESSSEPASTFSSDVPHVVPCKFTISLAFPVNMGQKGKYASLIEKYKKHPKTDSSVTKMRRFYHIEYFLLPDDEEPKKVDILLFPMVAKVFLESGVKTVKPWHEGDKAWVSWEQTFNITVTKELLKKINFHKITLRLWNTKDKMSRKVRYYRLKTAGFTDDVGAFHKSEVRHLVLNQRKLSEQGIENTNIVREESNQEHPPGKQEKTEKHPKSLQGSHQAEPETSSKNSEEYEKSLKMDDSSTIQWSVSRTPTISLAGASMMEIKELIESESLSSLTNILDRQRSQIKGKDSEGRRKIQRRHKKPLAEEEADPTLTGPRKQSAFSIQLAVMPLLAVRKKKGNSPIS

SEQ ID NO: 43508 - protein, 1013 aa, Homo sapiens
  Payload ID: 8941
  Gene Symbol: KIAA1324
  Gene Name: KIAA1324
  Uniprot ID: Q6UXG2
  ENSP ID: ENSP00000358955
MAEPGHSHHLSARVRGRTERRIPRLWRLLLWAGTAFQVTQGTGPELHACKESEYHYEYTACDSTGSRWRVAVPHTPGLCTSLPDPIKGTECSFSCNAGEFLDMKDQSCKPCAEGRYSLGTGIRFDEWDELPHGFASLSANMELDDSAAESTGNCTSSKWVPRGDYIASNTDECTATLMYAVNLKQSGTVNFEYYYPDSSIIFEFFVQNDQCQPNADDSRWMKTTEKGWEFHSVELNRGNNVLYWRTTAFSVWTKVPKPVLVRNIAITGVAYTSECFPCKPGTYADKQGSSFCKLCPANSYSNKGETSCHQCDPDKYSEKGSSSCNVRPACTDKDYFYTHTACDANGETQLMYKWAKPKICSEDLEGAVKLPASGVKTHCPPCNPGFFKTNNSTCQPCPYGSYSNGSDCTRCPAGTEPAVGFEYKWWNTLPTNMETTVLSGINFEYKGMTGWEVAGDHIYTAAGASDNDFMILTLVVPGFRPPQSVMADTENKEVARITFVFETLCSVNCELYFMVGVNSRTNTPVETWKGSKGKQSYTYIIEENTTTSFTWAFQRTTFHEASRKYTNDVAKIYSINVTNVMNGVASYCRPCALEASDVGSSCTSCPAGYYIDRDSGTCHSCPTNTILKAHQPYGVQACVPCGPGTKNNKIHSLCYNDCTFSRNTPTRTFNYNFSALANTVTLAGGPSFTSKGLKYFHHFTLSLCGNQGRKMSVCTDNVTDLRIPEGESGFSKSITAYVCQAVIIPPEVTGYKAGVSSQPVSLADRLIGVTTDMTLDGITSPAELFHLESLGIPDVIFFYRSNDVTQSCSSGRSTTIRVRCSPQKTVPGSLLLPGTCSDGTCDGCNFHFLWESAAACPLCSVADYHAIVSSCVAGIQKTTYVWREPKLCSGGISLPEQRVTICKTIDFWLKVGISAGTCTAILLTVLTCYFWKKNQKLEYKYSKLVMNATLKDCDLPAADSCAIMEGEDVEDDLIFTSKKSLFGKIKSFTSKRTPDGFDSVPLKTSSGGLDMDL

SEQ ID NO: 43509 - protein, 901 aa, Homo sapiens
  Payload ID: 8941
  Gene Symbol: KIAA1324
  Gene Name: KIAA1324
  ENSP ID: ENSP00000393964
MAEPGHSHHLSARVRGRTERRIPRLWRLLLWAGTAFQVTQGTGPELHACKESEYHYEYTACDSTGSRWRVAVPHTPGLCTSLPDPIKGTECSFSCNAGEFLDMKDQSCKPCAEGRYSLGTGIRFDEWDELPHGFASLSANMELDDSAAESTGNCTSSKWVPRGDYIASNTDECTATLMYAVNLKQSGTVNFEYYYPDSSIIFEFFVQNDQCQPNADDSRWMKTTEKGWEFHSVELNRGNNVLYWRTTAFSVWTKVPKPVLVRNIAITEKGSSSCNVRPACTDKDYFYTHTACDANGETQLMYKWAKPKICSEDLEGAVKLPASGVKTHCPPCNPGFFKTNNSTCQPCPYGSYSNGSDCTRCPAGTEPAVGFEYKWWNTLPTNMETTVLSGINFEYKGMTGWEVAGDHIYTAAGASDNDFMILTLVVPGFRPPQSVMADTENKEVARITFVFETLCSVNCELYFMVGVNSRTNTPVETWKGSKGKQSYTYIIEENTTTSFTWAFQRTTFHEASRKYTNDVAKIYSINVTNVMNGVASYCRPCALEASDVGSSCTSCPAGYYIDRDSGTCHSCPTNTILKAHQPYGVQACVPCGPGTKNNKIHSLCYNDCTFSRNTPTRTFNYNFSALANTVTLAGGPSFTSKGLKYFHHFTLSLCGNQGRKMSVCTDNVTDLRIPEGESGFSKSITAYVCQAVIIPPEVTGYKAGVSSQPVSLADRLIGVTTDMTLDGITSPAELFHLESLGIPDVIFFYRSNDVTQSCSSGRSTTIRVRCSPQKTVPGSLLLPGTCSDGTCDGCNFHFLWESAAACPLCSVADYHAIVSSCVAGIQKTTYVWREPKLCSGGISLPEQRVTICKTIDFWLKVGISAGTCTAILLTVLTCYFWKKNQKLEYKYSKLVMNATLK

SEQ ID NO: 43510 - protein, 91 aa, Homo sapiens
  Payload ID: 8941
  Gene Symbol: KIAA1324
  Gene Name: KIAA1324
  ENSP ID: ENSP00000431134
MAEPGHSHHLSARVRGRTERRIPRLWRLLLWAGTAFQVTQGTGPELHACKESEYHYEYTACDSTGSRWRVAVPHTPGLCTSLPDPIKGTEC

SEQ ID NO: 43511 - protein, 205 aa, Homo sapiens
  Payload ID: 8941
  Gene Symbol: KIAA1324
  Gene Name: KIAA1324
  ENSP ID: ENSP00000431349
MAEPGHSHHLSARVRGRTERRIPRLWRLLLWAGTAFQVTQGTGPELHACKESEYHYEYTACDSTGSRWRVAVPHTPGLCTSLPDPIKGTECSFSCNAGEFLDMKDQSCKPCAEGRYSLGTGIRFDEWDELPHGFASLSANMELDDSAAESTGNCTSSKWVPRGDYIASNTDECTATLMYAVNLKQSGTVNFEYYYPDSSIIFEFF

SEQ ID NO: 43512 - protein, 62 aa, Homo sapiens
  Payload ID: 8941
  Gene Symbol: KIAA1324
  Gene Name: KIAA1324
  ENSP ID: ENSP00000432023
MAEPGHSHHLSARVRGRTERRIPRLWRLLLWAGTAFQVTQGTGPELHACKEPSPATPGSFWI

SEQ ID NO: 43513 - protein, 152 aa, Homo sapiens
  Payload ID: 8941
  Gene Symbol: KIAA1324
  Gene Name: KIAA1324
  ENSP ID: ENSP00000432164
MAEPGHSHHLSARVRGRTERRIPRLWRLLLWAGTAFQVTQGTGPELHACKESEYHYEYTACDSTGSRWRVAVPHTPGLCTSLPDPIKGTECSFSCNAGEFLDMKDQSCKPCAEGRYSLGTGIRFDEWDELPHGFASLSANMELDDSAAESTG

SEQ ID NO: 43514 - protein, 82 aa, Homo sapiens
  Payload ID: 8941
  Gene Symbol: KIAA1324
  Gene Name: KIAA1324
  ENSP ID: ENSP00000433420
ILLTVLTCYFWKKNQKLEYKYSKLVMNATLKDCDLPAADSCAIMEGEDVEDDLIFTSKKSLFGKIKSFTSKVSGSSPLGAES

SEQ ID NO: 43515 - protein, 926 aa, Homo sapiens
  Payload ID: 8941
  Gene Symbol: KIAA1324
  Gene Name: KIAA1324
  Uniprot ID: Q6UXG2
  ENSP ID: ENSP00000434595
MAEPGHSHHLSARVRGRTERRIPRLWRLLLWAGTAFQVTQGTGPELHACKESEYHYEYTACDSTGSRWRVAVPHTPGLCTSLPDPIKGTECSFSCNAGEFLDMKDQSCKPCAEGRYSLGTGIRFDEWDELPHGFASLSANMELDDSAAESTGNCTSSKWVPRGDYIASNTDECTATLMYAVNLKQSGTVNFEYYYPDSSIIFEFFVQNDQCQPNADDSRWMKTTEKGWEFHSVELNRGNNVLYWRTTAFSVWTKVPKPVLTQLMYKWAKPKICSEDLEGAVKLPASGVKTHCPPCNPGFFKTNNSTCQPCPYGSYSNGSDCTRCPAGTEPAVGFEYKWWNTLPTNMETTVLSGINFEYKGMTGWEVAGDHIYTAAGASDNDFMILTLVVPGFRPPQSVMADTENKEVARITFVFETLCSVNCELYFMVGVNSRTNTPVETWKGSKGKQSYTYIIEENTTTSFTWAFQRTTFHEASRKYTNDVAKIYSINVTNVMNGVASYCRPCALEASDVGSSCTSCPAGYYIDRDSGTCHSCPTNTILKAHQPYGVQACVPCGPGTKNNKIHSLCYNDCTFSRNTPTRTFNYNFSALANTVTLAGGPSFTSKGLKYFHHFTLSLCGNQGRKMSVCTDNVTDLRIPEGESGFSKSITAYVCQAVIIPPEVTGYKAGVSSQPVSLADRLIGVTTDMTLDGITSPAELFHLESLGIPDVIFFYRSNDVTQSCSSGRSTTIRVRCSPQKTVPGSLLLPGTCSDGTCDGCNFHFLWESAAACPLCSVADYHAIVSSCVAGIQKTTYVWREPKLCSGGISLPEQRVTICKTIDFWLKVGISAGTCTAILLTVLTCYFWKKNQKLEYKYSKLVMNATLKDCDLPAADSCAIMEGEDVEDDLIFTSKKSLFGKIKSFTSKRTPDGFDSVPLKTSSGGLDMDL

SEQ ID NO: 43516 - protein, 155 aa, Homo sapiens
  Payload ID: 8941
  Gene Symbol: KIAA1324
  Gene Name: KIAA1324
  ENSP ID: ENSP00000435066
MAEPGHSHHLSARVRGRTERRIPRLWRLLLWAGTAFQVTQGTGPELHACKESEYHYEYTACDSTGSRWRVAVPHTPGLCTSLPDPIKGTECSFSCNAGEFLDMKDQSCKPCAEGRYSLGTGIRFDEWDELPHGFASLSANMELDDSAAESTGNCT

SEQ ID NO: 43517 - protein, 85 aa, Homo sapiens
  Payload ID: 8942
  Gene Symbol: KIAA1324L
  Gene Name: KIAA1324-like
  ENSP ID: ENSP00000378203
  MOD_RES (1)..(1): Any amino acid
XSSWIPRGNYIESNRDDCTVSLIYAVHLKKSGYVFFEYQYVDNNIFFEFFIQNDQCQEMDTTTDKWVKLTDNGEWGSHSDSSLNA

SEQ ID NO: 43518 - protein, 112 aa, Homo sapiens
  Payload ID: 8942
  Gene Symbol: KIAA1324L
  Gene Name: KIAA1324-like
  ENSP ID: ENSP00000381325
MKNQVCSKCGEGTYSLGSGIKFDEWDELPAGFSNIATFMDTVVGPSDSRPDGCNNSSWIPRGNYIESNRDDCTVSLIYAVHLKKSGYVFFEYQYVDNNIFFEFFIQNDQCQE

SEQ ID NO: 43519 - protein, 79 aa, Homo sapiens
  Payload ID: 8942
  Gene Symbol: KIAA1324L
  Gene Name: KIAA1324-like
  ENSP ID: ENSP00000387496
  MOD_RES (1)..(1): Any amino acid
XENQSLHYDFSNLSSVGSLMNGPSFTSKGTKYFHFFNISLCGHEKKKTFKRKLVQNKKETCRAKYQLIRGRRWLSVPTI

SEQ ID NO: 43520 - protein, 958 aa, Homo sapiens
  Payload ID: 8942
  Gene Symbol: KIAA1324L
  Gene Name: KIAA1324-like
  ENSP ID: ENSP00000397377
MLFRARGPVRGRGWGRPAEAPRRGRSPPWSPAWICCWALAGCQAAWAGDLPSSSSRPLPPCQEKDYHFEYTECDSSGSRWRVAIPNSAVDCSGLPDPVRGKECTFSCASGEYLEMKNQVCSKCGEGTYSLGSGIKFDEWDELPAGFSNIATFMDTVVGPSDSRPDGCNNSSWIPRGNYIESNRDDCTVSLIYAVHLKKSGYVFFEYQYVDNNIFFEFFIQNDQCQEMDTTTDKWVKLTDNGEWGSHSVMLKSGTNILYWRTTGILMGSKAVKPVLVKNITIEGVAYTSECFPCKPGTFSNKPGSFNCQVCPRNTYSEKGAKECIRCKDDSQFSEEGSSECTERPPCTTKDYFQIHTPCDEEGKTQIMYKWIEPKICREDLTDAIRLPPSGEKKDCPPCNPGFYNNGSSSCHPCPPGTFSDGTKECRPCPAGTEPALGFEYKWWNVLPGNMKTSCFNVGNSKCDGMNGWEVAGDHIQSGAGGSDNDYLILNLHIPGFKPPTSMTGATGSELGRITFVFETLCSADCVLYFMVDINRKSTNVVESWGGTKEKQAYTHIIFKNATFTFTWAFQRTNQGQDATTLRKKPTSARNVHLTPTCPYIRSMAKRLVFHAGLGVKTISNLSSVGSLMNGPSFTSKGTKYFHFFNISLCGHEGKKMALCTNNITDFTVKEIVAGSDDYTNLVGAFVCQSTIIPSESKGFRAALSSQSIILADTFIGVTVETTLKNINIKEDMFPVPTSQIPDVHFFYKSSTATTSCINGRSTAVKMRCNPTKSGAGVISVPSKCPAGTCDGCTFYFLWESAEACPLCTEHDFHEIEGACKRGFQETLYVWNEPKWCIKGISLPEKKLATCETVDFWLKVGAGVGAFTAVLLVALTCYFWKKNQKLEYKYSKLVMTTNSKECELPAADSCAIMEGEDNEEEVVYSNKQSLLGKLKSLATKEKEDHFESVQLKTSRSPNI

SEQ ID NO: 43521 - protein, 862 aa, Homo sapiens
  Payload ID: 8942
  Gene Symbol: KIAA1324L
  Gene Name: KIAA1324-like
  Uniprot ID: A8MWY0
  ENSP ID: ENSP00000402390
MHSSWIPRGNYIESNRDDCTVSLIYAVHLKKSGYVFFEYQYVDNNIFFEFFIQNDQCQEMDTTTDKWVKLTDNGEWGSHSVMLKSGTNILYWRTTGILMGSKAVKPVLVKNITIEGVAYTSECFPCKPGTFSNKPGSFNCQVCPRNTYSEKGAKECIRCKDDSQFSEEGSSECTERPPCTTKDYFQIHTPCDEEGKTQIMYKWIEPKICREDLTDAIRLPPSGEKKDCPPCNPGFYNNGSSSCHPCPPGTFSDGTKECRPCPAGTEPALGFEYKWWNVLPGNMKTSCFNVGNSKCDGMNGWEVAGDHIQSGAGGSDNDYLILNLHIPGFKPPTSMTGATGSELGRITFVFETLCSADCVLYFMVDINRKSTNVVESWGGTKEKQAYTHIIFKNATFTFTWAFQRTNQGQDNRRFINDMVKIYSITATNAVDGVASSCRACALGSEQSGSSCVPCPPGHYIEKETNQCKECPPDTYLSIHQVYGKEACIPCGPGSKNNQDHSVCYSDCFFYHEKENQSLHYDFSNLSSVGSLMNGPSFTSKGTKYFHFFNISLCGHEGKKMALCTNNITDFTVKEIVAGSDDYTNLVGAFVCQSTIIPSESKGFRAALSSQSIILADTFIGVTVETTLKNINIKEDMFPVPTSQIPDVHFFYKSSTATTSCINGRSTAVKMRCNPTKSGAGVISVPSKCPAGTCDGCTFYFLWESAEACPLCTEHDFHEIEGACKRGFQETLYVWNEPKWCIKGISLPEKKLATCETVDFWLKVGAGVGAFTAVLLVALTCYFWKKNQKLEYKYSKLVMTTNSKECELPAADSCAIMEGEDNEEEVVYSNKQSLLGKLKSLATKEKEDHFESVQLKTSRSPNI

SEQ ID NO: 43522 - protein, 971 aa, Homo sapiens
  Payload ID: 8942
  Gene Symbol: KIAA1324L
  Gene Name: KIAA1324-like
  ENSP ID: ENSP00000406961
  MOD_RES (1)..(1): Any amino acid
XDAVPRPGAGTGQGLGAAGGGSPPRALAALEPRLDLLLGARRLPGGLGWGPALLLQPPASSLPGAFSCASGEYLEMKNQVCSKCGEGTYSLGSGIKFDEWDELPAGFSNIATFMDTVVGPSDSRPDGCNNSSWIPRGNYIESNRDDCTVSLIYAVHLKKSGYVFFEYQYVDNNIFFEFFIQNDQCQEMDTTTDKWVKLTDNGEWGSHSVMLKSGTNILYWRTTGILMGSKAVKPVLVKNITIEGVAYTSECFPCKPGTFSNKPGSFNCQVCPRNTYSEKGAKECIRCKDDSQFSEEGSSECTERPPCTTKDYFQIHTPCDEEGKTQIMYKWIEPKICREDLTDAIRLPPSGEKKDCPPCNPGFYNNGSSSCHPCPPGTFSDGTKECRPCPAGTEPALGFEYKWWNVLPGNMKTSCFNVGNSKCDGMNGWEVAGDHIQSGAGGSDNDYLILNLHIPGFKPPTSMTGATGSELGRITFVFETLCSADCVLYFMVDINRKSTNVVESWGGTKEKQAYTHIIFKNATFTFTWAFQRTNQGQDNRRFINDMVKIYSITATNAVDGVASSCRACALGSEQSGSSCVPCPPGHYIEKETNQCKECPPDTYLSIHQVYGKEACIPCGPGSKNNQDHSVCYSDCFFYHEKENQSLHYDFSNLSSVGSLMNGPSFTSKGTKYFHFFNISLCGHEGKKMALCTNNITDFTVKEIVAGSDDYTNLVGAFVCQSTIIPSESKGFRAALSSQSIILADTFIGVTVETTLKNINIKEDMFPVPTSQIPDVHFFYKSSTATTSCINGRSTAVKMRCNPTKSGAGVISVPSKCPAGTCDGCTFYFLWESAEACPLCTEHDFHEIEGACKRGFQETLYVWNEPKWCIKGISLPEKKLATCETVDFWLKVGAGVGAFTAVLLVALTCYFWKKNQKLEYKYSKLVMTTNSKECELPAADSCAIMEGEDNEEEVVYSNKQSLLGKLKSLATK

SEQ ID NO: 43523 - protein, 87 aa, Homo sapiens
  Payload ID: 8942
  Gene Symbol: KIAA1324L
  Gene Name: KIAA1324-like
  ENSP ID: ENSP00000410045
MKNQVCSKCGEGTYSLGSGIKFDEWDELPAGFSNIATFMDTVVGPSDSRPDGCNNSSWIPRGNYIESNRDDCTVSLIYAVHLKKSGY

SEQ ID NO: 43524 - protein, 1029 aa, Homo sapiens
  Payload ID: 8942
  Gene Symbol: KIAA1324L
  Gene Name: KIAA1324-like
  Uniprot ID: A8MWY0
  ENSP ID: ENSP00000413445
MLFRARGPVRGRGWGRPAEAPRRGRSPPWSPAWICCWALAGCQAAWAGDLPSSSSRPLPPCQEKDYHFEYTECDSSGSRWRVAIPNSAVDCSGLPDPVRGKECTFSCASGEYLEMKNQVCSKCGEGTYSLGSGIKFDEWDELPAGFSNIATFMDTVVGPSDSRPDGCNNSSWIPRGNYIESNRDDCTVSLIYAVHLKKSGYVFFEYQYVDNNIFFEFFIQNDQCQEMDTTTDKWVKLTDNGEWGSHSVMLKSGTNILYWRTTGILMGSKAVKPVLVKNITIEGVAYTSECFPCKPGTFSNKPGSFNCQVCPRNTYSEKGAKECIRCKDDSQFSEEGSSECTERPPCTTKDYFQIHTPCDEEGKTQIMYKWIEPKICREDLTDAIRLPPSGEKKDCPPCNPGFYNNGSSSCHPCPPGTFSDGTKECRPCPAGTEPALGFEYKWWNVLPGNMKTSCFNVGNSKCDGMNGWEVAGDHIQSGAGGSDNDYLILNLHIPGFKPPTSMTGATGSELGRITFVFETLCSADCVLYFMVDINRKSTNVVESWGGTKEKQAYTHIIFKNATFTFTWAFQRTNQGQDNRRFINDMVKIYSITATNAVDGVASSCRACALGSEQSGSSCVPCPPGHYIEKETNQCKECPPDTYLSIHQVYGKEACIPCGPGSKNNQDHSVCYSDCFFYHEKENQSLHYDFSNLSSVGSLMNGPSFTSKGTKYFHFFNISLCGHEGKKMALCTNNITDFTVKEIVAGSDDYTNLVGAFVCQSTIIPSESKGFRAALSSQSIILADTFIGVTVETTLKNINIKEDMFPVPTSQIPDVHFFYKSSTATTSCINGRSTAVKMRCNPTKSGAGVISVPSKCPAGTCDGCTFYFLWESAEACPLCTEHDFHEIEGACKRGFQETLYVWNEPKWCIKGISLPEKKLATCETVDFWLKVGAGVGAFTAVLLVALTCYFWKKNQKLEYKYSKLVMTTNSKECELPAADSCAIMEGEDNEEEVVYSNKQSLLGKLKSLATKEKEDHFESVQLKTSRSPNI

SEQ ID NO: 43525 - protein, 577 aa, Homo sapiens
  Payload ID: 8943
  Gene Symbol: KIAA1328
  Gene Name: KIAA1328
  Uniprot ID: Q86T90
  ENSP ID: ENSP00000280020
MADVAGPSRPSAAAFWSRDFSDEEQSVVYVPGISAEGNVRSRHKLMSPKADVKLKTSRVTDASISMESLKGTGDSVDEQNSCRGEIKSASLKDLCLEDKRRIANLIKELARVSEEKEVTEERLKAEQESFEKKIRQLEEQNELIIKEREALQLQYRECQELLSLYQKYLSEQQEKLTMSLSELGAARMQEQQVSSRKSTLQCSSVELDGSYLSIARPQTYYQTKQRPKSAVQDSASESLIAFRNNSLKPVTLHHPKDDLDKIPSETTTCNCESPGRKPAVPTEKMPQEELHMKECPHLKPTPSQCCGHRLAADRVHDSHPTNMTPQHPKTHPESCSYCRLSWASLVHGGGALQPIETLKKQISEDRKQQLMLQKMELEIEKERLQHLLAQQETKLLLKQQQLHQSRLDYNCLLKSNCDGWLLGTSSSIKKHQDPPNSGENRKERKTVGFHSHMKDDAQWSCQKKDTCRPQRGTVTGVRKDASTSPMPTGSLKDFVTTASPSLQHTTSRYETSLLDLVQSLSPNSAPKPQRYPSREAGAWNHGTFRLSPLKSTRKKMGMHRTPEELEENQILEDIFFI

SEQ ID NO: 43526 - protein, 163 aa, Homo sapiens
  Payload ID: 8943
  Gene Symbol: KIAA1328
  Gene Name: KIAA1328
  ENSP ID: ENSP00000465036
MADVAGPSRPSAAAFWSRDFSDEEQSVVYVPGISAEGNVRSRHKLMSPKADVKLKTSRVTDASISMESLKGTGDSVDEQNSCRGEIKSASLKDLCLEDKRRIANLIKELARVSEEKEVTEERLKAEQESFEKKIRQLEEQNELIIKEREDILLKVLFFNVQEV

SEQ ID NO: 43527 - protein, 573 aa, Homo sapiens
  Payload ID: 8943
  Gene Symbol: KIAA1328
  Gene Name: KIAA1328
  Uniprot ID: Q86T90
  ENSP ID: ENSP00000465550
MPDNIIVFSFMFSCVVSDEEQSVVYVPGISAEGNVRSRHKLMSPKADVKLKTSRVTDASISMESLKGTGDSVDEQNSCRGEIKSASLKDLCLEDKRRIANLIKELARVSEEKEVTEERLKAEQESFEKKIRQLEEQNELIIKEREALQLQYRECQELLSLYQKYLSEQQEKLTMSLSELGAARMQEQQVSSRKSTLQCSSVELDGSYLSIARPQTYYQTKQRPKSAVQDSASESLIAFRNNSLKPVTLHHPKDDLDKIPSETTTCNCESPGRKPAVPTEKMPQEELHMKECPHLKPTPSQCCGHRLAADRVHDSHPTNMTPQHPKTHPESCSYCRLSWASLVHGGGALQPIETLKKQISEDRKQQLMLQKMELEIEKERLQHLLAQQETKLLLKQQQLHQSRLDYNCLLKSNCDGWLLGTSSSIKKHQDPPNSGENRKERKTVGFHSHMKDDAQWSCQKKDTCRPQRGTVTGVRKDASTSPMPTGSLKDFVTTASPSLQHTTSRYETSLLDLVQSLSPNSAPKPQRYPSREAGAWNHGTFRLSPLKSTRKKMGMHRTPEELEENQILEDIFFI

SEQ ID NO: 43528 - protein, 601 aa, Homo sapiens
  Payload ID: 8943
  Gene Symbol: KIAA1328
  Gene Name: KIAA1328
  ENSP ID: ENSP00000466355
  MOD_RES (1)..(1): Any amino acid
XTARGEPSRGSPRAEEKLRTNPGDGDVLLGPSLGAGLSPCLGVRWPRDWYCLQVWGHGSDASQRSLPNSCRGEIKSASLKDLCLEDKRRIANLIKELARVSEEKEVTEERLKAEQESFEKKIRQLEEQNELIIKEREALQLQYRECQELLSLYQKYLSEQQEKLTMSLSELGAARMQEQQVSSRKSTLQCSSVELDGSYLSIARPQTYYQTKQRPKSAVQDSASESLIAFRNNSLKPVTLHHPKDDLDKIPSETTTCNCESPGRKPAVPTEKMPQEELHMKECPHLKPTPSQCCGHRLAADRVHDSHPTNMTPQHPKTHPESCSYCRLSWASLVHGGGALQPIETLKKQISEDRKQQLMLQKMELEIEKERLQHLLAQQETKLLLKQQQLHQSRLDYNWLKAQALFKSRELVAEKQLTKPQELKLDMNGSDSGPSLLKSNCDGWLLGTSSSIKKHQDPPNSGENRKERKTVGFHSHMKDDAQWSCQKKDTCRPQRGTVTGVRKDASTSPMPTGSLKDFVTTASPSLQHTTSRYETSLLDLVQSLSPNSAPKPQRYPSREAGAWNHGTFRLSPLKSTRKKMGMHRTPEELEENQILEDIFFI

SEQ ID NO: 43529 - protein, 81 aa, Homo sapiens
  Payload ID: 8943
  Gene Symbol: KIAA1328
  Gene Name: KIAA1328
  ENSP ID: ENSP00000467248
MADVAGPSRPSAAAFWSRDFSDEEQSVVYVPGISAEGNVRSRHKLMSPKADVKLKTSRVTDASISMESLKGTGDSVDEQSK

SEQ ID NO: 43530 - protein, 279 aa, Homo sapiens
  Payload ID: 8943
  Gene Symbol: KIAA1328
  Gene Name: KIAA1328
  Uniprot ID: Q86T90
  ENSP ID: ENSP00000467507
MPQEELHMKECPHLKPTPSQCCGHRLAADRVHDSHPTNMTPQHPKTHPESCSYCRLSWASLVHGGGALQPIETLKKQISEDRKQQLMLQKMELEIEKERLQHLLAQQETKLLLKQQQLHQSRLDYNWLKAQALFKSRELVAEKQLTKPQELKLDMNGSDSGPSLLKSNCDGWLLGTSSSIKKHQDPPNSGENRKERKTVGFHSHMKDDAQWSCQKKDTCRPQRGTVTGVRKDASTSPMPTGSLKDFVTTASPSLQHTTSRPGISTKICFLSNHFFILFS

SEQ ID NO: 43531 - protein, 81 aa, Homo sapiens; identical to SEQ ID NO: 43529
  Payload ID: 8943
  Gene Symbol: KIAA1328
  Gene Name: KIAA1328
  ENSP ID: ENSP00000468653

SEQ ID NO: 43532 - protein, 12 aa, Homo sapiens
  Payload ID: 8943
  Gene Symbol: KIAA1328
  Gene Name: KIAA1328
  ENSP ID: ENSP00000470002
MPQEELHMKECP

SEQ ID NO: 43533 - protein, 129 aa, Homo sapiens
  Payload ID: 8943
  Gene Symbol: KIAA1328
  Gene Name: KIAA1328
  Uniprot ID: Q86T90
  ENSP ID: ENSP00000470371
MPQEELHMKECPHLKPTPSQCCGHRLAADRVHDSHPTNMTPQHPKTHPESCSYCRLSWASLVHGGGALQPIETLKKQISEDRKQQLMLQKMELEIEKERLQHLLAQQETKLLLKQQQLHQSRLDYNCSE

SEQ ID NO: 43534 - protein, 1812 aa, Homo sapiens
  Payload ID: 8944
  Gene Symbol: KIAA1429
  Gene Name: KIAA1429
  Uniprot ID: Q69YN4
  ENSP ID: ENSP00000297591
MAVDSAMELLFLDTFKHPSAEQSSHIDVVRFPCVVYINEVRVIPPGVRAHSSLPDNRAYGETSPHTFQLDLFFNNVSKPSAPVFDRLGSLEYDENTSIIFRPNSKVNTDGLVLRGWYNCLTLAIYGSVDRVISHDRDSPPPPPPPPPPPQPQPSLKRNPKHADGEKEDQFNGSPPRPQPRGPRTPPGPPPPDDDEDDPVPLPVSGDKEEDAPHREDYFEPISPDRNSVPQEGQYSDEGEVEEEQQEEGEEDEDDVDVEEEEDEDEDDRRTVDSIPEEEEEDEEEEGEEDEEGEGDDGYEQISSDEDGIADLERETFKYPNFDVEYTAEDLASVPPMTYDPYDRELVPLLYFSCPYKTTFEIEISRMKDQGPDKENSGAIEASVKLTELLDLYREDRGAKWVTALEEIPSLIIKGLSYLQLKNTKQDSLGQLVDWTMQALNLQVALRQPIALNVRQLKAGTKLVSSLAECGAQGVTGLLQAGVISGLFELLFADHVSSSLKLNAFKALDSVISMTEGMEAFLRGRQNEKSGYQKLLELILLDQTVRVVTAGSAILQKCHFYEVLSEIKRLGDHLAEKTSSLPNHSEPDHDTDAGLERTNPEYENEVEASMDMDLLESSNISEGEIERLINLLEEVFHLMETAPHTMIQQPVKSFPTMARITGPPERDDPYPVLFRYLHSHHFLELVTLLLSIPVTSAHPGVLQATKDVLKFLAQSQKGLLFFMSEYEATNLLIRALCHFYDQDEEEGLQSDGVIDDAFALWLQDSTQTLQCITELFSHFQRCTASEETDHSDLLGTLHNLYLITFNPVGRSAVGHVFSLEKNLQSLITLMEYYSKEALGDSKSKKSVAYNYACILILVVVQSSSDVQMLEQHAASLLKLCKADENNAKLQELGKWLEPLKNLRFEINCIPNLIEYVKQNIDNLMTPEGVGLTTALRVLCNVACPPPPVEGQQKDLKWNLAVIQLFSAEGMDTFIRVLQKLNSILTQPWRLHVNMGTTLHRVTTISMARCTLTLLKTMLTELLRGGSFEFKDMRVPSALVTLHMLLCSIPLSGRLDSDEQKIQNDIIDILLTFTQGVNEKLTISEETLANNTWSLMLKEVLSSILKVPEGFFSGLILLSELLPLPLPMQTTQVIEPHDISVALNTRKLWSMHLHVQAKLLQEIVRSFSGTTCQPIQHMLRRICVQLCDLASPTALLIMRTVLDLIVEDLQSTSEDKEKQYTSQTTRLLALLDALASHKACKLAILHLINGTIKGDERYAEIFQDLLALVRSPGDSVIRQQCVEYVTSILQSLCDQDIALILPSSSEGSISELEQLSNSLPNKELMTSICDCLLATLANSESSYNCLLTCVRTMMFLAEHDYGLFHLKSSLRKNSSALHSLLKRVVSTFSKDTGELASSFLEFMRQILNSDTIGCCGDDNGLMEVEGAHTSRTMSINAAELKQLLQSKEESPENLFLELEKLVLEHSKDDDNLDSLLDSVVGLKQMLESSGDPLPLSDQDVEPVLSAPESLQNLFNNRTAYVLADVMDDQLKSMWFTPFQAEEIDTDLDLVKVDLIELSEKCCSDFDLHSELERSFLSEPSSPGRTKTTKGFKLGKHKHETFITSSGKSEYIEPAKRAHVVPPPRGRGRGGFGQGIRPHDIFRQRKQNTSRPPSMHVDDFVAAESKEVVPQDGIPPPKRPLKVSQKISSRGGFSGNRGGRGAFHSQNRFFTPPASKGNYSRREGTRGSSWSAQNTPRGNYNESRGGQSNFNRGPLPPLRPLSSTGYRPSPRDRASRGRGGLGPSWASANSGSGGSRGKFVSGGSGRGRHVRSFTR

SEQ ID NO: 43535 - protein, 1147 aa, Homo sapiens
  Payload ID: 8944
  Gene Symbol: KIAA1429
  Gene Name: KIAA1429
  Uniprot ID: Q69YN4
  ENSP ID: ENSP00000398390
MAVDSAMELLFLDTFKHPSAEQSSHIDVVRFPCVVYINEVRVIPPGVRAHSSLPDNRAYGETSPHTFQLDLFFNNVSKPSAPVFDRLGSLEYDENTSIIFRPNSKVNTDGLVLRGWYNCLTLAIYGSVDRVISHDRDSPPPPPPPPPPPQPQPSLKRNPKHADGEKEDQFNGSPPRPQPRGPRTPPGPPPPDDDEDDPVPLPVSGDKEEDAPHREDYFEPISPDRNSVPQEGQYSDEGEVEEEQQEEGEEDEDDVDVEEEEDEDEDDRRTVDSIPEEEEEDEEEEGEEDEEGEGDDGYEQISSDEDGIADLERETFKYPNFDVEYTAEDLASVPPMTYDPYDRELVPLLYFSCPYKTTFEIEISRMKDQGPDKENSGAIEASVKLTELLDLYREDRGAKWVTALEEIPSLIIKGLSYLQLKNTKQDSLGQLVDWTMQALNLQVALRQPIALNVRQLKAGTKLVSSLAECGAQGVTGLLQAGVISGLFELLFADHVSSSLKLNAFKALDSVISMTEGMEAFLRGRQNEKSGYQKLLELILLDQTVRVVTAGSAILQKCHFYEVLSEIKRLGDHLAEKTSSLPNHSEPDHDTDAGLERTNPEYENEVEASMDMDLLESSNISEGEIERLINLLEEVFHLMETAPHTMIQQPVKSFPTMARITGPPERDDPYPVLFRYLHSHHFLELVTLLLSIPVTSAHPGVLQATKDVLKFLAQSQKGLLFFMSEYEATNLLIRALCHFYDQDEEEGLQSDGVIDDAFALWLQDSTQTLQCITELFSHFQRCTASEETDHSDLLGTLHNLYLITFNPVGRSAVGHVFSLEKNLQSLITLMEYYSKEALGDSKSKKSVAYNYACILILVVVQSSSDVQMLEQHAASLLKLCKADENNAKLQELGKWLEPLKNLRFEINCIPNLIEYVKQNIDNLMTPEGVGLTTALRVLCNVACPPPPVEGQQKDLKWNLAVIQLFSAEGMDTFIRVLQKLNSILTQPWRLHVNMGTTLHRVTTISMARCTLTLLKTMLTELLRGGSFEFKDMRVPSALVTLHMLLCSIPLSGRLDSDEQKIQNDIIDILLTFTQGVNEKLTISEETLANNTWSLMLKEVLSSILKVPEGFFSGLILLSELLPLPLPMQTTQVSLPYNMHLINDCSNTF

SEQ ID NO: 43536 - protein, 91 aa, Homo sapiens
  Payload ID: 8944
  Gene Symbol: KIAA1429
  Gene Name: KIAA1429
  ENSP ID: ENSP00000428784
  MOD_RES (1)..(1): Any amino acid
XHTSRTMSINAAELKQLLQSKEESPENLFLELEKLVLEHSKDDDNLDSLLDSVVGLKQMLESSGDPLPLSDQDVEPVLSAPESLQNLFNNR

SEQ ID NO: 43537 - protein, 730 aa, Homo sapiens
  Payload ID: 8944
  Gene Symbol: KIAA1429
  Gene Name: KIAA1429
  ENSP ID: ENSP00000429909
QPVKSFPTMARITGPPERDDPYPVLFRYLHSHHFLELVTLLLSIPVTSAHPGVLQATKDVLKFLAQSQKGLLFFMSEYEATNLLIRALCHFYDQDEEEGLQSDGVIDDAFALWLQDSTQTLQCITELFSHFQRCTASEETDHSDLLGTLHNLYLITFNPVGRSAVGHVFSLEKNLQSLITLMEYYSKEALGDSKSKKSVAYNYACILILVVVQSSSDVQMLEQHAASLLKLCKADENNAKLQELGKWLEPLKNLRFEINCIPNLIEYVKQNIDNLMTPEGVGLTTALRVLCNVACPPPPVEGQQKDLKWNLAVIQLFSAEGMDTFIRVLQKLNSILTQPWRLHVNMGTTLHRVTTISMARCTLTLLKTMLTELLRGGSFEFKDMRVPSALVTLHMLLCSIPLSGRLDSDEQKIQNDIIDILLTFTQGVNEKLTISEETLANNTWSLMLKEVLSSILKVPEGFFSGLILLSELLPLPLPMQTTQVIEPHDISVALNTRKLWSMHLHVQAKLLQEIVRSFSGTTCQPIQHMLRRICVQLCDLASPTALLIMRTVLDLIVEDLQSTSEDKEKQYTSQTTRLLALLDALASHKACKLAILHLINGTIKGDERYAEIFQDLLALVRSPGDSVIRQQCVEYVTSILQSLCDQDIALILPSSSEGSISELEQLSNSLPNKELMTSICDCLLATLANSESSYNCLLTCVRTMMFLAEHDYGLFHLKRDAVEMIMVSWK

SEQ ID NO: 43538 - protein, 60 aa, Homo sapiens
  Payload ID: 8944
  Gene Symbol: KIAA1429
  Gene Name: KIAA1429
  ENSP ID: ENSP00000430857
ELERSFLSEPSSPGRTKTTKGFKLGKHKHETFITSRKLQSSGRNKRLQLECSEYSSRKLQ

SEQ ID NO: 43539 - protein, 54 aa, Homo sapiens
  Payload ID: 8945
  Gene Symbol: KIAA1456
  Gene Name: KIAA1456
  ENSP ID: ENSP00000431717
MDHEAAQLEKQHVHNVYESTAPYFSDLQSKAWPRVRQFLQEQKPGSLIADIGCG

SEQ ID NO: 43540 - protein, 454 aa, Homo sapiens
  Payload ID: 8945
  Gene Symbol: KIAA1456
  Gene Name: KIAA1456
  Uniprot ID: Q9P272
  ENSP ID: ENSP00000432695
MDHEAAQLEKQHVHNVYESTAPYFSDLQSKAWPRVRQFLQEQKPGSLIADIGCGTGKYLKVNSQVHTVGCDYCGPLVEIARNRGCEAMVCDNLNLPFRDEGFDAIISIGVIHHFSTKQRRIRAIKEMARVLVPGGQLMIYVWAMEQKNRHFEKQDVLVPWNRALCSQLFSESSQSGRKRQCGYPERGHPYHPPCSECSCSVCFKEQCGSKRSHSVGYEPAMARTCFANISKEGEEEYGFYSTLGKSFRSWFFSRSLDESTLRKQIERVRPLKNTEVWASSTVTVQPSRHSSLDFDHQEPFSTKGQSLDEEVFVESSSGKHLEWLRAPGTLKHLNGDHQGEMRRNGGGNFLDSTNTGVNCVDAGNIEDDNPSASKILRRISAVDSTDFNPDDTMSVEDPQTDVLDSTAFMRYYHVFREGELCSLLKENVSELRILSSGNDHGNWCIIAEKKRGCD

SEQ ID NO: 43541 - protein, 196 aa, Homo sapiens
  Payload ID: 8945
  Gene Symbol: KIAA1456
  Gene Name: KIAA1456
  ENSP ID: ENSP00000443288
MDHEAAQLEKQHVHNVYESTAPYFSDLQSKAWPRVRQFLQEQKPGSLIADIGCGTGKYLKVNSQVHTVGCDYCGPLVEIARNRGCEAMGLEHPWIWYPRASWNQPPTDIEGPQYFYPPCHPIPDLQKQTIICHFKGPTLNEQQKSSPTHHRLHACFQHCREEESRPWLMALSSWDQVAMEGHVSASLTSCIVRLLL

SEQ ID NO: 43542 - protein, 60 aa, Homo sapiens
  Payload ID: 8945
  Gene Symbol: KIAA1456
  Gene Name: KIAA1456
  ENSP ID: ENSP00000466330
MDHEAAQLEKQHVHNVYESTAPYFSDLQSKAWPRVRQFLQEQKPGSLIADIGNQAASSLT

SEQ ID NO: 43543 - protein, 60 aa, Homo sapiens; identical to SEQ ID NO: 43542
  Payload ID: 8945
  Gene Symbol: KIAA1456
  Gene Name: KIAA1456
  ENSP ID: ENSP00000468715

SEQ ID NO: 43544 - protein, 1359 aa, Homo sapiens
  Payload ID: 8946
  Gene Symbol: KIAA1462
  Gene Name: KIAA1462
  Uniprot ID: Q9P266
  ENSP ID: ENSP00000364526
MYSVEDLLISHGYKLSRDPPASREDNPKGRQAARTGTRAGQGLQNGHEDGPAALAHRKTSAGKGHVSDSESRRSTPRGHGEPQSTSASRTSEAGFCNQPPSAWSSHPPTGNDQAYRRRGRQEARSQKPREHENLEARGMAQAHSLPVHVREGPWEVGGRSEHVMKKPVWEEELRMSGPAKWQNVSLESWNQPRKLGRQMSDGDGERLFQDLYPFIQGEHVLNSQNKGKSRSLPRVLSPESLSCTEIPIPLNERHSPKMPPYPPTCAPNLDSTRNSEKSGCSAPFPRPKFGRPLKPPSYSSHQQSRGGADSSDSQDSQQMDAYVPRHELCLSDPGLEPPVYVPPPSYRSPPQNIPNPYLEDTVPINVCGGHSQQQSPTEKAGASGQPPSGPPGTGNEYGVSPRLPQGLPAHPRPVTAYDGFVQYIPFDDPRLRHFKLAQPQGFCEDIKLDDKSYNSSPVTAQEPAHGGMQPDGAIWNPQSLIPPSGDERGLVLADSSPRWLWGQPPGDGENSGLPNQRDRCVARGQWPDVRGSQHGHTGRQVSSPYSQGESTCETQTKLKKFQTGTRTKKSSKKKMNETIFCLVSIPVKSESHLPDRDMDNNDLKPSADQKNGSDKSPALQEQSLLSMSSTDLELQALTGSMGGRTEFQKQDLGEPEEDRQTNDLSFIHLTKHRELKHSGSWPGHRYRDQQTQTSFSEEPQSSQLLPGAKLGGPSRAALSPKCSDPAASEAQTHTAFPTGDHKQRPSARNLKGHRSLSPSSNSAFSRTSLSVDQAPTPKAGRSQPCVDVHGLGAHPGPKREVVKGEPTGPCNSKQLFGQFLLKPVSRRPWDLISQLESFNKELQEEEESSSSSSSSSSSSEESEAEPQQENRAHCRQEDVGFRGNSPEMRVEPQPRMWVPESPVCRSGRGESKSESWSEELQPGHPRAWPPSPGRFRVEEGGGAPFCSADGSTSAEKRHLEVSNGMDELAGSPFPVTRMSSRSSDAKPLPASYPAEPREPQESPKITSAFSSVKPSEAVPRKFDSGGERGAGLPLSLSNKNRGLSAPDLRSVGLTPGQEQGASELEGSLGEASTIEIPPGESLQARAARILGIEVAVESLLPGIRRAGQNQPAEPDASACTPESPQEELLSRPAPADVPRVSTDAFYGRRKCGWTKSPLFVGDRDSARRAPQAFEHSDVDGVVTSTDPVPEPEPSPLESKFFEQKDVETKPPFRSTLFHFVERTPSVAGSEKRLRSPSKVIESLQEKLASPPRRADPDRLMRMKEVSSVSRMRVLSFRNADSQEDAEELKATTRGQAGLPGGLVSPGSGDRAQRLGHSLSVSKDSISREEKEHPAAQKEKSMDQDFWCPDSYDPSRVERV

SEQ ID NO: 43545 - protein, 1250 aa, Homo sapiens
  Payload ID: 8947
  Gene Symbol: KIAA1468
  Gene Name: KIAA1468
  Uniprot ID: Q9P260
  ENSP ID: ENSP00000256858
MAAMAPGGSGSGGGVNPFLSDSDEDDDEVAATEERRAVLRLGAGSGLDPGSAGSLSPQDPVALGSSARPGLPGEASAAAVALGGTGETPARLSIDAIAAQLLRDQYLLTALELHTELLESGRELPRLRDYFSNPGNFERQSGTPPGMGAPGVPGAAGVGGAGGREPSTASGGGQLNRAGSISTLDSLDFARYSDDGNRETDEKVAVLEFELRKAKETIQALRANLTKAAEHEVPLQERKNYKSSPEIQEPIKPLEKRALNFLVNEFLLKNNYKLTSITFSDENDDQDFELWDDVGLNIPKPPDLLQLYRDFGNHQVTGKDLVDVASGVEEDELEALTPIISNLPPTLETPQPAENSMLVQKLEDKISLLNSEKWSLMEQIRRLKSEMDFLKNEHFAIPAVCDSVQPPLDQLPHKDSEDSGQHPDVNSSDKGKNTDIHLSISDEADSTIPKENSPNSFPRREREGMPPSSLSSKKTVHFDKPNRKLSPAFHQALLSFCRMSADSRLGYEVSRIADSEKSVMLMLGRCLPHIVPNVLLAKREELIPLILCTACLHPEPKERDQLLHILFNLIKRPDDEQRQMILTGCVAFARHVGPTRVEAELLPQCWEQINHKYPERRLLVAESCGALAPYLPKEIRSSLVLSMLQQMLMEDKADLVREAVIKSLGIIMGYIDDPDKYHQGFELLLSALGDPSERVVSATHQVFLPAYAAWTTELGNLQSHLILTLLNKIEKLLREGEHGLDEHKLHMYLSALQSLIPSLFALVLQNAPFSSKAKLHGEVPQIEVTRFPRPMSPLQDVSTIIGSREQLAVLLQLYDYQLEQEGTTGWESLLWVVNQLLPQLIEIVGKINVTSTACVHEFSRFFWRLCRTFGKIFTNTKVKPQFQEILRLSEENIDSSAGNGVLTKATVPIYATGVLTCYIQIKEYLHIHNEISWEWDPSLNTKCVSYTHYTHSLKEEDRKLLVGFLEDVMTLLSLSHAPLDSLKASFVELGANPAYHELLLTVLWYGVVHTSALVRCTAARMFELLVKGVNETLVAQRVVPALITLSSDPEISVRIATIPAFGTIMETVIQRELLERVKMQLASFLEDPQYQDQHSLHTEIIKTFGRVGPNAEPRFRDEFVIPHLHKLALVNNLQIVDSKRLDIATHLFEAYSALSCCFISEDLMVNHFLPGLRCLRTDMEHLSPEHEVILSSMIKECEQKVENKTVQEPQGSMSIAASLVSEDTKTKFLNKMGQLTTSGAMLANVFQRKK

SEQ ID NO: 43546 - protein, 1216 aa, Homo sapiens
  Payload ID: 8947
  Gene Symbol: KIAA1468
  Gene Name: KIAA1468
  Uniprot ID: Q9P260
  ENSP ID: ENSP00000381198
MAAMAPGGSGSGGGVNPFLSDSDEDDDEVAATEERRAVLRLGAGSGLDPGSAGSLSPQDPVALGSSARPGLPGEASAAAVALGGTGETPARLSIDAIAAQLLRDQYLLTALELHTELLESGRELPRLRDYFSNPGNFERQSGTPPGMGAPGVPGAAGVGGAGGREPSTASGGGQLNRAGSISTLDSLDFARYSDDGNRETDEKVAVLEFELRKAKETIQALRANLTKAAEHEVPLQERKNYKSSPEIQEPIKPLEKRALNFLVNEFLLKNNYKLTSITFSDENDDQDFELWDDVGLNIPKPPDLLQLYRDFGNHQVTGKDLVDVASGVEEDELEALTPIISNLPPTLETPQPAENSMLVQKLEDKISLLNSEKWSLMEQIRRLKSEMDFLKNEHFAIPAVCDSVQPPLDQLPHKDSEDSGQHPDVNSSDKGKNTDIHLSISDEADSTIPKENSPNSFPRREREGMPPSSLSSKKTVHFDKPNRKLSPAFHQALLSFCRMSADSRLGYEVSRIADSEKSVMLMLGRCLPHIVPNVLLAKREELIPLILCTACLHPEPKERDQLLHILFNLIKRPDDEQRQMILTGCVAFARHVGPTRVEAELLPQCWEQINHKYPERRLLVAESCGALAPYLPKEIRSSLVLSMLQQMLMEDKADLVREAVIKSLGIIMGYIDDPDKYHQGFELLLSALGDPSERVVSATHQVFLPAYAAWTTELGNLQSHLILTLLNKIEKLLREGEHGLDEHKLHMYLSALQSLIPSLFALVLQNAPFSSKAKLHGEVPQIEVTRFPRPMSPLQDVSTIIGSREQLAVLLQLYDYQLEQEGTTGWESLLWVVNQLLPQLIEIVGKINVTSTACVHEFSRFFWRLCRTFGKIFTNTKVKPQFQEILRLSEENIDSSAGNGVLTKATVPIYATGVLTCYIQEEDRKLLVGFLEDVMTLLSLSHAPLDSLKASFVELGANPAYHELLLTVLWYGVVHTSALVRCTAARMFELTLRGMSEALVDKRVAPALVTLSSDPEFSVRIATIPAFGTIMETVIQRELLERVKMQLASFLEDPQYQDQHSLHTEIIKTFGRVGPNAEPRFRDEFVIPHLHKLALVNNLQIVDSKRLDIATHLFEAYSALSCCFISEDLMVNHFLPGLRCLRTDMEHLSPEHEVILSSMIKECEQKVENKTVQEPQGSMSIAASLVSEDTKTKFLNKMGQLTTSGAMLANVFQRKK

SEQ ID NO: 43547 - protein, 255 aa, Homo sapiens
  Payload ID: 8947
  Gene Symbol: KIAA1468
  Gene Name: KIAA1468
  ENSP ID: ENSP00000464995
  MOD_RES (1)..(1): Any amino acid
XFSSKAKLHGEVPQIEVTRFPRPMSPLQDVSTIIGSREQLAVLLQLYDYQLEQEGTTGWESLLWVVNQLLPQLIEIVGKINVTSTACVHEFSRFFWRLCRTFGKIFTNTKVKPQFQEILRLSEENIDSSAGNGVLTKATVPIYATGVLTCYIQEEDRKLLVGFLEDVMTLLSLSHAPLDSLKASFVELGANPAYHELLLTVLWYGVVHTSALVRCTAARMFEVCQHMPLLVSIIMIFFFLRRRREFFLIKRLCIS

SEQ ID NO: 43548 - protein, 1017 aa, Homo sapiens
  Payload ID: 8947
  Gene Symbol: KIAA1468
  Gene Name: KIAA1468
  ENSP ID: ENSP00000468816
MAAMAPGGSGSGGGVNPFLSDSDEDDDEVAATEERRAVLRLGAGSGLDPGSAGSLSPQDPVALGSSARPGLPGEASAAAVALGGTGETPARLSIDAIAAQLLRDQYLLTALELHTELLESGRELPRLRDYFSNPGNFERQSGTPPGMGAPGVPGAAGVGGAGGREPSTASGGGQLNRAGSISTLDSLDFARYSDDGNRETDEKVAVLEFELRKAKETIQALRANLTKAAEHEVPLQERKNYKSSPEIQEPIKPLEKRALNFLVNEFLLKNNYKLTSITFSDENDDQDFELWDDVGLNIPKPPDLLQLYRDFGNHQVTGKDLVDVASGVEEDELEALTPIISNLPPTLETPQPAENSMLVQKLEDKISLLNSEKWSLMEQIRRLKSEMDFLKNEHFAIPAVCDSVQPPLDQLPHKDSEDSGQHPDVNSSDKGKNTDIHLSISDEADSTIPKENSPNSFPRREREGMPPSSLSSKKTVHFDKPNRKLSPAFHQALLSFCRMSADSRLGYEVSRIADSEKSVMLMLGRCLPHIVPNVLLAKREELIPLILCTACLHPEPKERDQLLHILFNLIKRPDDEQRQMILTGCVAFARHVGPTRVEAELLPQCWEQINHKYPERRLLVAESCGALAPYLPKEIRSSLVLSMLQQMLMEDKADLVREAVIKSLGIIMGYIDDPDKYHQGFELLLSALGDPSERVVSATHQVFLPAYAAWTTELGNLQSHLILTLLNKIEKLLREGEHGLDEHKLHMYLSALQSLIPSLFALVLQNAPFSSKAKLHGEVPQIEVTRFPRPMSPLQDVSTIIGSREQLAVLLQLYDYQLEQEGTTGWESLLWVVNQLLPQLIEIVGKINVTSTACVHEFSRFFWRLCRTFGKIFTNTKVKPQFQEILRLSEENIGNGVLTKATVPIYATGVLTCYIQEEDRKLLVGFLEDVMTLLSLSHAPLDSLKASFVELGANPAYHELLLTVLWYGVVHTSALVRCTAARMFEVCQHMPLLVSIIMIFFFLRRRREFFLIKRLCI

SEQ ID NO: 43549 - protein, 143 aa, Homo sapiens
  Payload ID: 8948
  Gene Symbol: KIAA1522
  Gene Name: KIAA1522
  Uniprot ID: Q9P206
  ENSP ID: ENSP00000294521
MVVFVGRRLPALLGLFKKKGSAKAENDKHLSVGPGQGPGSAVDEHQDNVFFPSGRPPHLEELHTQAQEGLRSLQHQEKQKLNKGGWDHGDTQSIQSSRTGPDEDNISFCSQTTSYVAESSTAEDALSIRSEMIQRKDSQKELA

SEQ ID NO: 43550 - protein, 1035 aa, Homo sapiens
  Payload ID: 8948
  Gene Symbol: KIAA1522
  Gene Name: KIAA1522
  Uniprot ID: Q9P206
  ENSP ID: ENSP00000362579
MVVFVGRRLPALLGLFKKKGSAKAENDKHLSVGPGQGPGSAVDEHQDNVFFPSGRPPHLEELHTQAQEGLRSLQHQEKQKLNKGGWDHGDTQSIQSSRTGPDEDNISFCSQTTSYVAESSTAEDALSIRSEMIQRKGSTFRPHDSFPKSGKSGRRRRERRSTVLGLPQHVQKELGLRNEREAPGTPRAPGARDAVRIPTVDGRPRGTSGMGARVSLQALEAEAEAGAETEAMLQRHIDRVYRDDTFVGRSTGTRAPPLTRPMSLAVPGLTGGAGPAEPLSPAMSISPQATYLSKLIPHAVLPPTVDVVALGRCSLRTLSRCSLHSASPASVRSLGRFSSVSSPQPRSRHPSSSSDTWSHSQSSDTIVSDGSTLSSKGGSEGQPESSTASNSVVPPPQGGSGRGSPSGGSTAEASDTLSIRSSGQLSGRSVSLRKLKRPPPPPRRTHSLHQRGLAVPDGPLGLPPKPERKQQPQLPRPPTTGGSEGAGAAPCPPNPANSWVPGLSPGGSRRPPRSPERTLSPSSGYSSQSGTPTLPPKGLAGPPASPGKAQPPKPERVTSLRSPGASVSSSLTSLCSSSSDPAPSDRSGPQILTPLGDRFVIPPHPKVPAPFSPPPSKPRSPNPAAPALAAPAVVPGPVSTTDASPQSPPTPQTTLTPLQESPVISKDQSPPPSPPPSYHPPPPPTKKPEVVVEAPSASETAEEPLQDPNWPPPPPPAPEEQDLSMADFPPPEEAFFSVASPEPAGPSGSPELVSSPAASSSSATALQIQPPGSPDPPPAPPAPAPASSAPGHVAKLPQKEPVGCSKGGGPPREDVGAPLVTPSLLQMVRLRSVGAPGGAPTPALGPSAPQKPLRRALSGRASPVPAPSSGLHAAVRLKACSLAASEGLSSAQPNGPPEAEPRPPQSPASTASFIFSKGSRKLQLERPVSPETQADLQRNLVAELRSISEQRPPQAPKKSPKAPPPVARKPSVGVPPPASPSYPRAEPLTAPPTNGLPHTQDRTKRELAENGGVLQLVGPEEKMGLPGSDSQKELA

SEQ ID NO: 43551 - protein, 1046 aa, Homo sapiens
  Payload ID: 8948
  Gene Symbol: KIAA1522
  Gene Name: KIAA1522
  Uniprot ID: Q9P206
  ENSP ID: ENSP00000362580
MGNSHHKRKAPSGPRVRSFWRFGRSAKRPAGSAKAENDKHLSVGPGQGPGSAVDEHQDNVFFPSGRPPHLEELHTQAQEGLRSLQHQEKQKLNKGGWDHGDTQSIQSSRTGPDEDNISFCSQTTSYVAESSTAEDALSIRSEMIQRKGSTFRPHDSFPKSGKSGRRRRERRSTVLGLPQHVQKELGLRNEREAPGTPRAPGARDAVRIPTVDGRPRGTSGMGARVSLQALEAEAEAGAETEAMLQRHIDRVYRDDTFVGRSTGTRAPPLTRPMSLAVPGLTGGAGPAEPLSPAMSISPQATYLSKLIPHAVLPPTVDVVALGRCSLRTLSRCSLHSASPASVRSLGRFSSVSSPQPRSRHPSSSSDTWSHSQSSDTIVSDGSTLSSKGGSEGQPESSTASNSVVPPPQGGSGRGSPSGGSTAEASDTLSIRSSGQLSGRSVSLRKLKRPPPPPRRTHSLHQRGLAVPDGPLGLPPKPERKQQPQLPRPPTTGGSEGAGAAPCPPNPANSWVPGLSPGGSRRPPRSPERTLSPSSGYSSQSGTPTLPPKGLAGPPASPGKAQPPKPERVTSLRSPGASVSSSLTSLCSSSSDPAPSDRSGPQILTPLGDRFVIPPHPKVPAPFSPPPSKPRSPNPAAPALAAPAVVPGPVSTTDASPQSPPTPQTTLTPLQESPVISKDQSPPPSPPPSYHPPPPPTKKPEVVVEAPSASETAEEPLQDPNWPPPPPPAPEEQDLSMADFPPPEEAFFSVASPEPAGPSGSPELVSSPAASSSSATALQIQPPGSPDPPPAPPAPAPASSAPGHVAKLPQKEPVGCSKGGGPPREDVGAPLVTPSLLQMVRLRSVGAPGGAPTPALGPSAPQKPLRRALSGRASPVPAPSSGLHAAVRLKACSLAASEGLSSAQPNGPPEAEPRPPQSPASTASFIFSKGSRKLQLERPVSPETQADLQRNLVAELRSISEQRPPQAPKKSPKAPPPVARKPSVGVPPPASPSYPRAEPLTAPPTNGLPHTQDRTKRELAENGGVLQLVGPEEKMGLPGSDSQKELA

SEQ ID NO: 43552 - protein, 1094 aa, Homo sapiens
  Payload ID: 8948
  Gene Symbol: KIAA1522
  Gene Name: KIAA1522
  Uniprot ID: Q9P206
  ENSP ID: ENSP00000383851
MAARAPPAAPAAEEPGNPGGPPRRKKSRSGASGLRRAFSWLRGKRRKKKAAGAEGAEPAAPRAKKAEDKAKRAKGKGRGSAKAENDKHLSVGPGQGPGSAVDEHQDNVFFPSGRPPHLEELHTQAQEGLRSLQHQEKQKLNKGGWDHGDTQSIQSSRTGPDEDNISFCSQTTSYVAESSTAEDALSIRSEMIQRKGSTFRPHDSFPKSGKSGRRRRERRSTVLGLPQHVQKELGLRNEREAPGTPRAPGARDAVRIPTVDGRPRGTSGMGARVSLQALEAEAEAGAETEAMLQRHIDRVYRDDTFVGRSTGTRAPPLTRPMSLAVPGLTGGAGPAEPLSPAMSISPQATYLSKLIPHAVLPPTVDVVALGRCSLRTLSRCSLHSASPASVRSLGRFSSVSSPQPRSRHPSSSSDTWSHSQSSDTIVSDGSTLSSKGGSEGQPESSTASNSVVPPPQGGSGRGSPSGGSTAEASDTLSIRSSGQLSGRSVSLRKLKRPPPPPRRTHSLHQRGLAVPDGPLGLPPKPERKQQPQLPRPPTTGGSEGAGAAPCPPNPANSWVPGLSPGGSRRPPRSPERTLSPSSGYSSQSGTPTLPPKGLAGPPASPGKAQPPKPERVTSLRSPGASVSSSLTSLCSSSSDPAPSDRSGPQILTPLGDRFVIPPHPKVPAPFSPPPSKPRSPNPAAPALAAPAVVPGPVSTTDASPQSPPTPQTTLTPLQESPVISKDQSPPPSPPPSYHPPPPPTKKPEVVVEAPSASETAEEPLQDPNWPPPPPPAPEEQDLSMADFPPPEEAFFSVASPEPAGPSGSPELVSSPAASSSSATALQIQPPGSPDPPPAPPAPAPASSAPGHVAKLPQKEPVGCSKGGGPPREDVGAPLVTPSLLQMVRLRSVGAPGGAPTPALGPSAPQKPLRRALSGRASPVPAPSSGLHAAVRLKACSLAASEGLSSAQPNGPPEAEPRPPQSPASTASFIFSKGSRKLQLERPVSPETQADLQRNLVAELRSISEQRPPQAPKKSPKAPPPVARKPSVGVPPPASPSYPRAEPLTAPPTNGLPHTQDRTKRELAENGGVLQLVGPEEKMGLPGSDSQKELA

SEQ ID NO: 43553 - protein, 905 aa, Homo sapiens [sequence omitted]

SEQ ID NO: 43554 - protein, 121 aa, Homo sapiens
  Payload ID: 8949
  Gene Symbol: KIAA1524
  Gene Name: KIAA1524
  ENSP ID: ENSP00000417297
MDSTACLKSLLLTVSQYKAVKSEANATQLLRHLEVISGQKLTRLFTSNQILTSECLSCLVELLEDPNISASLILSIIGLLSQLAVDIETRDCLQNTYNLNSVLAGVVCRSSHTDSVFLQMN

SEQ ID NO: 43555 - protein, 48 aa, Homo sapiens
  Payload ID: 8949
  Gene Symbol: KIAA1524
  Gene Name: KIAA1524
  ENSP ID: ENSP00000419428
MDSTACLKSLLLTVSQYKAVKSEANATQLLRHLELTYCLWEEAEGIIP

SEQ ID NO: 43556 - protein, 746 aa, Homo sapiens
  Payload ID: 8949
  Gene Symbol: KIAA1524
  Gene Name: KIAA1524
  Uniprot ID: Q8TCG1
  ENSP ID: ENSP00000419487
MPCLGLLANLCRHNLSVQTHIKTLSNVKSFYRTLITLLAHSSLTVVVFALSILSSLTLNEEVGEKLFHARNIHQTFQLIFNILINGDGTLTRKYSVDLLMDLLKNPKIADYLTRYEHFSSCLHQVLGLLNGKDPDSSSKVLELLLAFCSVTQLRHMLTQMMFEQSPPGSATLGSHTKCLEPTVALLRWLSQPLDGSENCSVLALELFKEIFEDVIDAANCSSADRFVTLLLPTILDQLQFTEQNLDEALTRKKCERIAKAIEVLLTLCGDDTLKMHIAKILTTVKCTTLIEQQFTYGKIDLGFGTKVADSELCKLAADVILKTLDLINKLKPLVPGMEVSFYKILQDPRLITPLAFALTSDNREQVQSGLRILLEAAPLPDFPALVLGESIAANNAYRQQETEHIPRKMPWQSSNHSFPTSIKCLTPHLKDGVPGLNIEELIEKLQSGMVVKDQICDVRISDIMDVYEMKLSTLASKESRLQDLLETKALALAQADRLIAQHRCQRTQAETEARTLASMLREVERKNEELSVLLKAQQVESERAQSDIEHLFQHNRKLESVAEEHEILTKSYMELLQRNESTEKKNKDLQITCDSLNKQIETVKKLNESLKEQNEKSIAQLIEKEEQRKEVQNQLVDREHKLANLHQKTKVQEEKIKTLQKEREDKEETIDILRKELSRTEQIRKELSIKASSLEVQKAQLEGRLEEKESLVKLQQEELNKHSHMIAMIHSLSGGKINPETVNLSI

SEQ ID NO: 43557 - protein, 906 aa, Homo sapiens
  Payload ID: 8949
  Gene Symbol: KIAA1524
  Gene Name: KIAA1524
  ENSP ID: ENSP00000484616
MDSTACLKSLLLTVSQYKAVKSEANATQLLRHLEVISGQKLTRLFTSNQILTSECLSCLVELLEDPNISASLILSIIGLLSQLAVDIETRDCLQNTYNLNSVLAGVVCRSSHTDSVFLQCIQLLQKLTYNVKIFYSGANIDELITFLIDHIQSSEDELKMPCLGLLANLCRHNLSVQTHIKTLSNVKSFYRTLITLLAHSSLTVVVFALSILSSLTLNEEVGEKLFHARNIHQTFQLIFNILINGDGTLTRKYSVDLLMDLLKNPKIADYLTRYEHFSSCLHQVLGLLNGKDPDSSSKVLELLLAFCSVTQLRHMLTQMMFEQSPPGSATLGSHTKCLEPTVALLRWLSQPLDGSENCSVLALELFKEIFEDVIDAANCSSADRFVTLLLPTILDQLQFTEQNLDEALTRKKCERIAKAIEVLLTPLCGDDTLKMHIAKILTTVKCTTLIEQQFTYGKIDLGFGTKVADSELCKLAADVILKTLDLINKLKPLVPGMEVSFYKILQDPRLITPLAFALTSDNREQVQSGLRILLEAAPLPDFPALVLGESIAANNAYRQQETEHIPRKMPWQSSNHSFPTSIKCLTPHLKDGVPGLNIEELIEKLQSGMVVKDQICDVRISDIMDVYEMKLSTLASKESRLQDLLETKALALAQADRLIAQHRCQRTQAETEARTLASMLREVERKNEELSVLLKAQQVESERAQSDIEHLFQHNRKLESVAEEHEILTKSYMELLQRNESTEKKNKDLQITCDSLNKQIETVKKLNESLKEQNEKSIAQLIEKEEQRKEVQNQLVDREHKLANLHQKTKVQEEKIKTLQKEREDKEETIDILRKELSRTEQIRKELSIKASSLEVQKAQLEGRLEEKESLVKLQQEELNKHSHMIAMIHSLSGGKINPETVNLSI

SEQ ID NO: 43558 - protein, 48 aa, Homo sapiens; identical to SEQ ID NO: 43555
  Payload ID: 8949
  Gene Symbol: KIAA1524
  Gene Name: KIAA1524
  ENSP ID: ENSP00000485696

SEQ ID NO: 43559 - protein, 1934 aa, Homo sapiens
  Payload ID: 8950
  Gene Symbol: KIAA1549
  Gene Name: KIAA1549
  Uniprot ID: Q9HCM3
  ENSP ID: ENSP00000406661
MPGARRRRRGAAMEGKPRAGVALAPGPSGRRPSARCARRRRPGLLLPGLWLLLLARPASCAPDELSPEQHNLSLYSMELVLKKSTGHSAAQVALTETAPGSQHSSPLHVTAPPSATTFDTAFFNQGKQTKSTADPSIFVATYVSVTSKEVAVNDDEMDNFLPDTHWTTPRMVSPIQYITVSPPGLPREALEPMLTPSLPMVSLQDEEVTSGWQNTTRQPAAYAESASHFHTFRSAFRTSEGIVPTPGRNLVLYPTDAYSHLSSRTLPEIVASLTEGVETTLFLSSRSLMPQPLGDGITIPLPSLGEVSQPPEEVWATSADRYTDVTTVLSQSLEETISPRTYPTVTASHAALAFSRTHSPLLSTPLAFASSASPTDVSSNPFLPSDSSKTSELHSNSALPGPVDNTHILSPVSSFRPYTWCAACTVPSPQQVLATSLMEKDVGSGDGAETLCMTVLEESSISLMSSVVADFSEFEEDPQVFNTLFPSRPIVPLSSRSMEISETSVGISAEVDMSSVTTTQVPPAHGRLSVPASLDPTAGSLSVAETQVTPSSVTTAFFSVITSILLDSSFSVIANKNTPSLAVRDPSVFTPYSLVPSVESSLFSDQERSSFSEHKPRGALDFASSFFSTPPLELSGSISSPSEAPASLSLMPSDLSPFTSQSFSPLVETFTLFDSSDLQSSQLSLPSSTNLEFSQLQPSSELPLNTIMLLPSRSEVSPWSSFPSDSLEFVEASTVSLTDSEAHFTSAFIETTSYLESSLISHESAVTALVPPGSESFDILTAGIQATSPLTTVHTTPILTESSLFSTLTPPDDQISALDGHVSVLASFSKAIPTGTVLITDAYLPSGSSFVSEATPFPLPTELTVVGPSLTPTEVPLNTSTEVSTTSTGAATGGPLDSTLMGDAASQSPPESSAAPPLPSLRPVTAFTLEATVDTPTLATAKPPYVCDITVPDAYLITTVLARRAVQEYIITAIKEVLRIHFNRAVELKVYELFTDFTFLVTSGPFVYTAISVINVLINSKLVRDQTPLILSVKPSFLVPESRFQVQTVLQFVPPSVDTGFCNFTQRIEKGLMTALFEVRKHHQGTYNLTVQILNITISSSRVTPRRGPVNIIFAVKSTQGFLNGSEVSELLRNLSVVEFSFYLGYPVLQIAEPFQYPQLNLSQLLKSSWVRTVLLGVMEKQLQNEVFQAEMERKLAQLLSEVSTRRRMWRRATVAAGNSVVQVVNVSRLEGDDNPVQLIYFVEDQDGERLSAVKSSDLINKMDLQRAAIILGYRIQGVIAQPVDRVKRPSPESQSNNLWVIVGVVIPVLVVMVIVVILYWKLCRTDKLDFQPDTVANIQQRQKLQIPSVKGFDFAKQHLGQHNKDDILIIHEPAPLPGPLKDHTTPSENGDVPSPKSKIPSKNVRHRGRVSPSDADSTVSEESSERDAGDKTPGAVNDGRSHRAPQSGPPLPSSGNEQHSSASIFEHVDRISRPPEASRRVPSKIQLIAMQPIPAPPVQRPSPADRVAESNKINKEIQTALRHKSEIEHHRNKIRLRAKRRGHYEFPVVDDLSSGDTKERHRVYRRAQMQIDKILDPTASVPSVFIEPRKSSRIKRSPKPRRKHQVNGCPADAEKDRLITTDSDGTYRRPPGVHNSAYIGCPSDPDLPADVQTPSSVELGRYPALPFPASQYIPPQPSIEEARQTMHSLLDDAFALVAPSSQPASTAGVGPGVPPGLPANSTPSQEERRATQWGSFYSPAQTANNPCSRYEDYGMTPPTGPLPRPGFGPGLLQSTELVPPDPQQPQASAEAPFAARGIYSEEMPSVARPRPVGGTTGSQIQHLTQVGIASRIGAQPVEIPPSRGSQYGGPGWPSYGEDEAGRREAVPRTSGREPSAPSGNLPHRGLQGPGLGYPTSSTEDLQPGHSSASLIKAIREELLRLSQKQSTVQNFHS

SEQ ID NO: 43560 - protein, 1950 aa, Homo sapiens
  Payload ID: 8950
  Gene Symbol: KIAA1549
  Gene Name: KIAA1549
  Uniprot ID: Q9HCM3
  ENSP ID: ENSP00000416040
MPGARRRRRGAAMEGKPRAGVALAPGPSGRRPSARCARRRRPGLLLPGLWLLLLARPASCAPDELSPEQHNLSLYSMELVLKKSTGHSAAQVALTETAPGSQHSSPLHVTAPPSATTFDTAFFNQGKQTKSTADPSIFVATYVSVTSKEVAVNDDEMDNFLPDTHWTTPRMVSPIQYITVSPPGLPREALEPMLTPSLPMVSLQDEEVTSGWQNTTRQPAAYAESASHFHTFRSAFRTSEGIVPTPGRNLVLYPTDAYSHLSSRTLPEIVASLTEGVETTLFLSSRSLMPQPLGDGITIPLPSLGEVSQPPEEVWATSADRYTDVTTVLSQSLEETISPRTYPTVTASHAALAFSRTHSPLLSTPLAFASSASPTDVSSNPFLPSDSSKTSELHSNSALPGPVDNTHILSPVSSFRPYTWCAACTVPSPQQVLATSLMEKDVGSGDGAETLCMTVLEESSISLMSSVVADFSEFEEDPQVFNTLFPSRPIVPLSSRSMEISETSVGISAEVDMSSVTTTQVPPAHGRLSVPASLDPTAGSLSVAETQVTPSSVTTAFFSVITSILLDSSFSVIANKNTPSLAVRDPSVFTPYSLVPSVESSLFSDQERSSFSEHKPRGALDFASSFFSTPPLELSGSISSPSEAPASLSLMPSDLSPFTSQSFSPLVETFTLFDSSDLQSSQLSLPSSTNLEFSQLQPSSELPLNTIMLLPSRSEVSPWSSFPSDSLEFVEASTVSLTDSEAHFTSAFIETTSYLESSLISHESAVTALVPPGSESFDILTAGIQATSPLTTVHTTPILTESSLFSTLTPPDDQISALDGHVSVLASFSKAIPTGTVLITDAYLPSGSSFVSEATPFPLPTELTVVGPSLTPTEVPLNTSTEVSTTSTGAATGGPLDSTLMGDAASQSPPESSAAPPLPSLRPVTAFTLEATVDTPTLATAKPPYVCDITVPDAYLITTVLARRAVQEYIITAIKEVLRIHFNRAVELKVYELFTDFTFLVTSGPFVYTAISVINVLINSKLVRDQTPLILSVKPSFLVPESRFQVQTVLQFVPPSVDTGFCNFTQRIEKGLMTALFEVRKHHQGTYNLTVQILNITISSSRVTPRRGPVNIIFAVKSTQGFLNGSEVSELLRNLSVVEFSFYLGYPVLQIAEPFQYPQLNLSQLLKSSWVRTVLLGVMEKQLQNEVFQAEMERKLAQLLSEVSTRRRMWRRATVAAGNSVVQVVNVSRLEGDDNPVQLIYFVEDQDGERLSAVKSSDLINKMDLQRAAIILGYRIQGVIAQPVDRVKRPSPESQSNNLWVIVGVVIPVLVVMVIVVILYWKLCRTDKLDFQPDTVANIQQRQKLQIPSVKGFDFAKQHLGQHNKDDILIIHEPAPLPGPLKDHTTPSENGDVPSPKSKIPSKNVRHRGRVSPSDADSTVSEESSERDAGDKTPGAVNDGRSHRAPQSGPPLPSSGNEQHSSASIFEHVDRISRPPEASRRVPSKIQLIAMQPIPAPPVQRPSPADRVAESNKINKEIQTALRHKSEIEHHRNKIRLRAKRRGHYEFPVVDDLSSGDTKERHRVYRRAQMQIDKILDPTASVPSVFIEPRKSSRIKRSPKPRRKHQVNGCPADAEKDRLITTDSDGTYRRPPGVHNSAYIGCPSDPDLPADVQTPSSVELGRYPALPFPASQYIPPQPSIEEARQTMHSLLDDAFALVAPSSQPASTAGVGPGVPPGLPANSTPSQEERRATQWGSFYSPAQTANNPCSRYEDYGMTPPTGPLPRPGFGPGLLQSTELVPPDPQQPQASAEAPFAARGIYSEEMPSVARPRPVGGTTGSQIQHLTQVGIASRIGAQPVEIPPSRGSQYGGPGWPSYGEDEAGRREATHMLGHQEYSSSPLFQVPRTSGREPSAPSGNLPHRGLQGPGLGYPTSSTEDLQPGHSSASLIKAIREELLRLSQKQSTVQNFHS

SEQ ID NO: 43561 - protein, 1235 aa, Homo sapiens
  Payload ID: 8951
  Gene Symbol: KIAA1549L
  Gene Name: KIAA1549-like
  Uniprot ID: Q6ZVL6
  ENSP ID: ENSP00000265654
MDHTASQNAQDLIGIPHLGVSGSSTKWHSELSPTEGPHSAGSSTPGFLSPMAELSHPSPPPPALGSLLQLPDGSPSWSMLEVASGPASTQQIKAGVPGRVHNGVSLPTFKNTETATHEAEPPLFQTAESGAIEMTSRKLASATANDSANPLHLSAAPENSRGPALSAEHTSSLVPSLHITTLGQEQAILSGAVPASPSTGTADFPSILTFLQPTENHASPSPVPEMPTLPAEGSDGSPPATRDLLLSSKVPNLLSTSWTFPRWKKDSVTAILGKNEEANVTIPLQAFPRKEVLSLHTVNGFVSDFSTGSVSSPIITAPRTNPLPSGPPLPSILSIQATQTVFPSLGFSSTKPEAYAAAVDHSGLPASASKQVRASPSSMDVYDSLTIGDMKKPATTDVFWSSLSAETGSLSTESIISGLQQQTNYDLNGHTISTTSWETHLAPTAPPNGLTSAADAIKSQDFKDTAGHSVTAEGFSIQDLVLGTSIEQPVQQSDMTMVGSHIDLWPTSNNNHSRDFQTAEVAYYSPTTRHSVSHPQLQLPNQPAHPLLLTSPGPTSTGSLQEMLSDGTDTGSEISSDINSSPERNASTPFQNILGYHSAAESSISTSVFPRTSSRVLRASQHPKKWTGAATNAADTVSSKVQPTAAAAVTLFLRKSSPPALSAALVAKGTSSSPLAVASGPAKSSSMTTLAKNVTNKAASGPKRTPGAVHTAFPFTPTYMYARTGHTTSTHTAMQGNMDTASGLLSTTYLPRKPQAMHTGLPNPTNLEMPRASTPRPLTVTAALTSITASVKATRLPPLRAENTDAVLPAASAAVVTTGKMASNLECQMSSKLLVKTVLFLTQRRVQISESLKFSIAKGLTQALRKAFHQNDVSAHVDILEYSHNVTVGYYATKGKLVYLPAVVIEMLGVYGVSNVTADLKQHTPHLQSVAVLASPWNPQPAGYFQLKTVLQFVSQADNIQSCKFAQTMEQRLQKAFQDAERKVLNTKSNLTIQIVSTSNASQAVTLVYVVGNQSTFLNGTVASSLLSQLSAELVGFYLTYPPLTIAEPLEYPNLDISETTRDYWVITVLQGVDNSLVGLHNQSFARVMEQRLAQLFMMSQQQGRRFKRATTLGSYTVQMVKMQRVPGPKDPAELTYYTLYNGKPLLGTAAAKILSTIDSQRMALTLHHVVLLQADPVVKNPPNNLWIIAAVLAPIAVVTVIIIIITAVLCRKNKNDFKPDTMINLPQRAKQVAQ

SEQ ID NO: 43562 - protein, 1849 aa, Homo sapiens
  Payload ID: 8951
  Gene Symbol: KIAA1549L
  Gene Name: KIAA1549-like
  Uniprot ID: Q6ZVL6
  ENSP ID: ENSP00000315295
MDHTASQNAQDLIGIPHLGVSGSSTKWHSELSPTEGPHSAGSSTPGFLSPMAELSHPSPPPPALGSLLQLPDGSPSWSMLEVASGPASTQQIKAGVPGRVHNGVSLPTFKNTETATHEAEPPLFQTAESGAIEMTSRKLASATANDSANPLHLSAAPENSRGPALSAEHTSSLVPSLHITTLGQEQAILSGAVPASPSTGTADFPSILTFLQPTENHASPSPVPEMPTLPAEGSDGSPPATRDLLLSSKVPNLLSTSWTFPRWKKDSVTAILGKNEEANVTIPLQAFPRKEVLSLHTVNGFVSDFSTGSVSSPIITAPRTNPLPSGPPLPSILSIQATQTVFPSLGFSSTKPEAYAAAVDHSGLPASASKQVRASPSSMDVYDSLTIGDMKKPATTDVFWSSLSAETGSLSTESIISGLQQQTNYDLNGHTISTTSWETHLAPTAPPNGLTSAADAIKSQDFKDTAGHSVTAEGFSIQDLVLGTSIEQPVQQSDMTMVGSHIDLWPTSNNNHSRDFQTAEVAYYSPTTRHSVSHPQLQLPNQPAHPLLLTSPGPTSTGSLQEMLSDGTDTGSEISSDINSSPERNASTPFQNILGYHSAAESSISTSVFPRTSSRVLRASQHPKKWTADTVSSKVQPTAAAAVTLFLRKSSPPALSAALVAKGTSSSPLAVASGPAKSSSMTTLAKNVTNKAASGPKRTPGAVHTAFPFTPTYMYARTGHTTSTHTAMQGNMDTASGLLSTTYLPRKPQAMHTGLPNPTNLEMPRASTPRPLTVTAALTSITASVKATRLPPLRAENTDAVLPAASAAVVTTGKMASNLECQMSSKLLVKTVLFLTQRRVQISESLKFSIAKGLTQALRKAFHQNDVSAHVDILEYSHNVTVGYYATKGKLVYLPAVVIEMLGVYGVSNVTADLKQHTPHLQSVAVLASPWNPQPAGYFQLKTVLQFVSQADNIQSCKFAQTMEQRLQKAFQDAERKVLNTKSNLTIQIVSTSNASQAVTLVYVVGNQSTFLNGTVASSLLSQLSAELVGFYLTYPPLTIAEPLEYPNLDISETTRDYWVITVLQGVDNSLVGLHNQSFARVMEQRLAQLFMMSQQQGRRFKRATTLGSYTVQMVKMQRVPGPKDPAELTYYTLYNGKPLLGTAAAKILSTIDSQRMALTLHHVVLLQADPVVKNPPNNLWIIAAVLAPIAVVTVIIIIITAVLCRKNKNDFKPDTMINLPQRAKPVQGFDYAKQHLGQQGADEEVIPVTQETVVLPLPIRDAPQERDVAQDGSTIKTAKSTETRKSRSPSENGSVISNESGKPSSGRRSPQNVMAQQKVTKEEARKRNVPASDEEEGAVLFDNSSKVAAEPFDTSSGSVQLIAIKPTALPMVPPTSDRSQESSAVLNGEVNKALKQKSDIEHYRNKLRLKAKRKGYYDFPAVETSKGLTERKKMYEKAPKEMEHVLDPDSELCAPFTESKNRQQMKNSVYRSRQSLNSPSPGETEMDLLVTRERPRRGIRNSGYDTEPEIIEETNIDRVPEPRGYSRSRQVKGHSETSTLSSQPSIDEVRQQMHMLLEEAFSLASAGHAGQSRHQEAYGSAQHLPYSEVVTSAPGTMTRPRAGVQWVPTYRPEMYQYSLPRPAYRFSQLPEMVMGSPPPPVPPRTGPVAVASLRRSTSDIGSKTRMAESTGPEPAQLHDSASFTQMSRGPVSVTQLDQSALNYSGNTVPAVFAIPAANRPGFTGYFIPTPPSSYRNQAWMSYAGENELPSQWADSVPLPGYIEAYPRSRYPQSSPSRLPRQYSQPANLHPSLEQAPAPSTAASQQSLAENDPSDAPLTNISTAALVKAIREEVAKLAKKQTDMFEFQV

SEQ ID NO: 43563 - protein, 836 aa, Homo sapiens
  Payload ID: 8951
  Gene Symbol: KIAA1549L
  Gene Name: KIAA1549-like
  ENSP ID: ENSP00000433481
  MOD_RES (1)..(1): Any amino acid
XPSKDSTESLVQPGPKGGQEAADVSADTVSSKVQPTAAAAVTLFLRKSSPPALSAALVAKGTSSSPLAVASGPAKSSSMTTLAKNVTNKAASGPKRTPGAVHTAFPFTPTYMYARTGHTTSTHTAMQGNMDTASGLLSTTYLPRKPQAMHTGLPNPTNLEMPRASTPRPLTVTAALTSITASVKATRLPPLRAENTDAVLPAASAAVVTTGKMASNLECQMSSKLLVKTVLFLTQRRVQISESLKFSIAKGLTQALRKAFHQNDVSAHVDILEYSHNVTVGYYATKGKLVYLPAVVIEMLGVYGVSNVTADLKQHTPHLQSVAVLASPWNPQPAGYFQLKTVLQFVSQADNIQSCKFAQTMEQRLQKAFQDAERKVLNTKSNLTIQIVSTSNASQAVTLVYVVGNQSTFLNGTVASSLLSQLSAELVGFYLTYPPLTIAEPLEYPNLDISETTRDYWVITVLQGVDNSLVGLHNQSFARVMEQRLAQLFMMSQQQGRRFKRATTLGSYTVQMVKMQRVPGPKDPAELTYYTLYNGKPLLGTAAAKILSTIDSQRMALTLHHVVLLQADPVVKNPPNNLWIIAAVLAPIAVVTVIIIIITAVLCRKNKNDFKPDTMINLPQRAKPVQGFDYAKQHLGQQGADEEVIPVTQETVVLPLPIRDAPQERDVAQDGSTIKTAKSTETRKSRSPSENGSVISNESGKPSSGRRSPQNVMAQQKVTKEEARKRNVPASDEEEGAVLFDNSSKVAAEPFDTSSGSVQLIAIKPTALPMVPPTSDRSQESSAVLNGEVNKALKQKSDIEHYRNKLRLKAKRKGYYDFPAVETSKGLTERKKMYEK

SEQ ID NO: 43564 - protein, 1747 aa, Homo sapiens
  Payload ID: 8952
  Gene Symbol: KIAA1551
  Gene Name: KIAA1551
  Uniprot ID: Q9HCM1
  ENSP ID: ENSP00000310338
MNWNEKPKSATLPPLYPKSQPPFLHQSLINQITTTSQSSFSYPGSNQEACMYPGNSNPISQPLLNIQNYPQQISVSDMHNGTVVASHTSVERITYANVNGPKQLTHNLQMSSGVTQNVWLNSPMRNPVHSHIGATVSHQTDFGANVPNMPALQSQLITSDTYSMQMQMIPSNSTRLPVAYQGNQGLNQSFSEQQVDWTQQCISKGLTYPDYRPPPKLYRYSPQSFLPDSTIQKQNFIPHTSLQVKNSQLLNSVLTLPSRQTSAVPSQQYATQTDKRPPPPPYNCRYGSQPLQSTQHITKHLSMEVPQSREMLSSEIRTSFQQQWQNPNENVSTIGNFTNLKVNTNSKQPFNSPIRSSVDGVQTLAQTNEEKIMDSCNPTSNQVLDTSVAKEKLVRDIKTLVEIKQKFSELARKIKINKDLLMAAGCIKMTNTSYSEPAQNSKLSLKQTAKIQSGPQITPVMPENAERQTPTVVESAETNKTQCMLNSDIQEVNCRRFNQVDSVLPNPVYSEKRPMPDSSHDVKVLTSKTSAVEMTQAVLNTQLSSENVTKVEQNSPAVCETISVPKSMSTEEYKSKIQNENMLLLALLSQARKTQKTVLKDANQTIQDSKPDSCEMNPNTQMTGNQLNLKNMETPSTSNVSGRVLDNSFCSGQESSTKGMPAKSDSSCSMEVLATCLSLWKKQPSDTAKEKECDKLRTNTTAVGISKPANIHVKSPCSVVGNSNSQNKISNPSQQTALSMVMHNYESSGINITKGTELQIAVVSPLVLSEVKTLSVKGITPAVLPETVYPVIKEGSVCSLQNQLAENAKATAALKVDVSGPVASTATSTKIFPLTQKEKQNESTNGNSEVTPNVNQGKHNKLESAIHSPMNDQQISQESRNSTVVSSDTLQIDNICSLVEGDTSYNSQIAKIFSSLPLKMVEPQKPSLPNQQGIGSREPEKQLDNTTENKDFGFQKDKPVQCTDVSHKICDQSKSEPPLESSFNNLETNRVILEKSSLEHATEKSTANDTCSSAAIQEDIYPQEIDASSNYTPQDPARNEIHSDKAPVLYLHDQLSELLKEFPYGIEAVNTREGSVGQQTTYQTSEDQTADKTSSDSKDPADQIQITILSSEQMKEIFPEQDDQPYVVDKLAEPQKEEPITEVVSQCDLQAPAAGQSRDSVILDSEKDDIHCCALGWLSMVYEGVPQCQCNSIKNSSSEEEKQKEQCSPLDTNSCKQGERTSDRDVTVVQFKSLVNNPKTPPDGKSHFPELQDDSRKDTPKTKHKSLPRTEQELVAGQFSSKCDKLNPLQNHKRKKLRFHEVTFHSSNKMTASYEQASQETRQKKHVTQNSRPLKTKTAFLPNKDVYKKHSSLGQSLSPEKIKLKLKSVSFKQKRKLDQGNVLDMEVKKKKHDKQEQKGSVGATFKLGDSLSNPNERAIVKEKMVSNTKSVDTKASSSKFSRILTPKEYLQRQKHKEALSNKASKKICVKNVPCDSEHMRPSKLAVQVESCGKSNEKHSSGVQTSKESLNGLTSHGKNLKIHHSQESKTYNILRNVKEKVGGKQPDKIWIDKTKLDKLTNISNEAQFSQMPPQVKDQKKLYLNRVGFKCTERESISLTKLESSPRKLHKDKRQENKHKTFLPVKGNTEKSNMLEFKLCPDILLKNTNSVEERKDVKPHPRKEQAPLQVSGIKSTKEDWLKFVATKKRTQKDSQERDNVNSRLSKRSFSADGFEMLQNPVKDSKEMFQTYKQMYLEKRSRSLGSSPVK

SEQ ID NO: 43565 - protein, 674 aa, Homo sapiens
  Payload ID: 8952
  Gene Symbol: KIAA1551
  Gene Name: KIAA1551
  ENSP ID: ENSP00000370442
MNWNEKPKSATLPPLYPKSQPPFLHQSLINQITTTSQSSFSYPGSNQEACMYPGNSNPISQPLLNIQNYPQQISVSDMHNGTVVASHTSVERITYANVNGPKQLTHNLQMSSGVTQNVWLNSPMRNPVHSHIGATVSHQTDFGANVPNMPALQSQLITSDTYSMQMQMIPSNSTRLPVAYQGNQGLNQSFSEQQVDWTQQCISKGLTYPDYRPPPKLYRYSPQSFLPDSTIQKQNFIPHTSLQVKNSQLLNSVLTLPSRQTSAVPSQQYATQTDKRPPPPPYNCRYGSQPLQSTQHITKHLSMEVPQSREMLSSEIRTSFQQQWQNPNENVSTIGNFTNLKVNTNSKQPFNSPIRSSVDGVQTLAQTNEEKIMDSCNPTSNQVLDTSVAKEKLVRDIKTLVEIKQKFSELARKIKINKDLLMAAGCIKMTNTSYSEPAQNSKLSLKQTAKIQSGPQITPVMPENAERQTPTVVESAETNKTQCMLNSDIQEVNCRRFNQVDSVLPNPVYSEKRPMPDSSHDVKVLTSKTSAVEMTQAVLNTQLSSENVTKVEQNSPAVCETISVPKSMSTEEYKSKIQNENMLLLALLSQARKTQKTVLKDANQTIQDSKPDSCEMNPNTQMTGNQLNLKNMETPSTSNVSGRVLDNSFCSGQESSTKGMPAKSDSSCSMEVLA

SEQ ID NO: 43566 - protein, 35 aa, Homo sapiens
  Payload ID: 8952
  Gene Symbol: KIAA1551
  Gene Name: KIAA1551
  ENSP ID: ENSP00000445152
MNWNEKPKSATLPPLYPKSQPPFLHQSLINQITTT

SEQ ID NO: 43567 - protein, 787 aa, Homo sapiens
  Payload ID: 8953
  Gene Symbol: KIAA1586
  Gene Name: KIAA1586
  Uniprot ID: Q9HCI6
  ENSP ID: ENSP00000359768
MGDPGSEIIESVPPAGPEASESTTDENEDDIQFVSEGPSRPVLEYIDLVCGDDENPSAYYSDILFPKMPKRQGDFLHFLNVKKVKTDTENNEVSKNHCRLSKAKEPHFEYIEQPIIEEKPSLSSKKEIDNLVLPDCWNEKQAFMFTEQYKWLEIKEGKLGCKDCSAVRHLGSKAEKHVHVSKEWIAYLVTPNGSNKTTRQASLRKKIREHDVSKAHGKIQDLLKESTNDSICNLVHKQNNKNIDATVKVFNTVYSLVKHNRPLSDIEGARELQEKNGEVNCLNTRYSATRIAEHIAKEMKMKIFKNIIEENAKICIIIDEASTVSKKTTLVIYLQCTIQSAPAPVMLFVALKELVSTIAECIVNTLLTTLNDCGFTNEYLKANLIAFCSDGANTILGRKSGVATKLLENFPEIIIWNCLNHRLQLSLDDSISEIKQINHLKIFIDKIYSIYHQPNKNQTKLLGTVAKELETEIIKIGRVMGPRWAACSLQAATAVWHAYPILYMHFSHSYSGLAKRLANINFLQDLALMIDILEEFSVLSTALQSRSTNIKKAQKLIKRTIRALENLKIGTGKYESQIEDLIKSDKFKDIPFNKNNKFNALPRSILLDNIIQHMNLRLLSDRNHEDIFNYFDLLEPSTWPYEEITSPWIAGEKTLFHLCKILKYEVDLNDFREFVNNNIKSNNVSIPTTIYKAKKIVSTIAINSAEAERGFNLMNIICTRVRNSLTIDHVSDLMTINLLGKELADWDATPFVKSWSNCNHRLATDTRVRQKSTKVFHENQLAIWNLK

SEQ ID NO: 43568 - protein, 760 aa, Homo sapiens
  Payload ID: 8953
  Gene Symbol: KIAA1586
  Gene Name: KIAA1586
  ENSP ID: ENSP00000445507
MGDPGSEIIESVPPAGPEASESTTDENEDDIQFVSILFPKMPKRQGDFLHFLNVKKVKTDTENNEVSKNHCRLSKAKEPHFEYIEQPIIEEKPSLSSKKEIDNLVLPDCWNEKQAFMFTEQYKWLEIKEGKLGCKDCSAVRHLGSKAEKHVHVSKEWIAYLVTPNGSNKTTRQASLRKKIREHDVSKAHGKIQDLLKESTNDSICNLVHKQNNKNIDATVKVFNTVYSLVKHNRPLSDIEGARELQEKNGEVNCLNTRYSATRIAEHIAKEMKMKIFKNIIEENAKICIIIDEASTVSKKTTLVIYLQCTIQSAPAPVMLFVALKELVSTIAECIVNTLLTTLNDCGFTNEYLKANLIAFCSDGANTILGRKSGVATKLLENFPEIIIWNCLNHRLQLSLDDSISEIKQINHLKIFIDKIYSIYHQPNKNQTKLLGTVAKELETEIIKIGRVMGPRWAACSLQAATAVWHAYPILYMHFSHSYSGLAKRLANINFLQDLALMIDILEEFSVLSTALQSRSTNIKKAQKLIKRTIRALENLKIGTGKYESQIEDLIKSDKFKDIPFNKNNKFNALPRSILLDNIIQHMNLRLLSDRNHEDIFNYFDLLEPSTWPYEEITSPWIAGEKTLFHLCKILKYEVDLNDFREFVNNNIKSNNVSIPTTIYKAKKIVSTIAINSAEAERGFNLMNIICTRVRNSLTIDHVSDLMTINLLGKELADWDATPFVKSWSNCNHRLATDTRVRQKSTKVFHENQLAIWNLK

SEQ ID NO: 43569 - protein, 811 aa, Homo sapiens
  Payload ID: 8954
  Gene Symbol: KIAA1614
  Gene Name: KIAA1614
  Uniprot ID: Q5VZ46
  ENSP ID: ENSP00000356559
MKARTRPLRASHDIVPTITQGSRDGHRSPARDPRTTPACRDSLQNGHTSDSSSGESSGGHRPRRGPSPSHVRFEDESAREAEFRHLERLQQRQRQVLSTVLQAADQGPLRSKPDLADYINGAPRLRDAGQGTFHRLVGSLDRRGHPAPPAPGSERRCQACGSCIDDPRPAQGKAPPVPRTLQELQAACGMERVLGGLSSPLRLLPAEPRLHMEWIRETHIGDTVCPAEVDSALDSTDNSDNCRTDSEEAGTSQAGWACGRTQGSSPRLRLRGSRPRGHRWSKKAEAELPWGLQAQQHLPRADDVEVENEVKEGRGHTPEGTLFLREDAKPPDLELKRVSLGPQWQPGPGLGSHQPHPLDSRTPCRTAYATTAPMTPESSGPGGQAQVTESHESLEIVSPSSLQQSHAEPSAPHQAWQPTASLCPEGWAPTPPPSRKTTSPVSHRKAALAGLLRLGDQTEPVGIPRPPSRSAVLRTCELPPSQTQPSRPQVRHPLLALSTNNCNNSAPRGLQEPYGGAVHEGRVERGPCSREPEPPLENSRDGGPQGFLGSADVATINSTGITLSLSSEESESSKESEGSLQRTGSGSGGHVLSRASAGAGTGPGSPSAAPLDQNKKRSSSIASTLGLKKLFSALGQSSRPKLGKSRSYSVEQLQPAPPGLTSQSRAPSLQSLHPVSPSHQRRKAASFQNLHSLLSSKGNRSSLYLVAGPGDHSAAGRPAKTSPRRALSVEDVGAPSLARTVGRLVEVFPDGTSQLQLQRSPGGTFGFCVASGNGRPDSGMPSPLPQPHGWGGLSKQGRAFWLWSEAFLVFG

SEQ ID NO: 43570 - protein, 1190 aa, Homo sapiens
  Payload ID: 8954
  Gene Symbol: KIAA1614
  Gene Name: KIAA1614
  Uniprot ID: Q5VZ46
  ENSP ID: ENSP00000356560
MEGTEAAAAKPAGGSPQGPKTGSGTASPVEGTSAVEWSGPEPQLDNGHPPRPWPCPQENRTSSLMAPQPPRVWGVQLQGPSVLESKVRALKEKMTVAKQGVSPCSASQEWSSPKKPQCRRGKAGRAGTPSEGSFLPGAVVAPRTQNLPDGQLDGSINEEQPARDGGPRLPRPPAPGREYCNRGSPWPPEAEWTLPDHDRGPLLGPSSLQQSPIHGVTPGRPGGPGHCNKIIHIPSPRTGRSYPFPDGVVTEADLDSTSLTSEEVFVPRTALLGERWRAGDLEALGAGSSVLSLSDRVERNRLLLQEMLNVSGQSPRKVGTPAWTPSWDTAAPERPVGDVDWASGTSLQDSGQNRTVGPNPEPVLSPRHEEATHLLQRARMKARTRPLRASHDIVPTITQGSRDGHRSPARDPRTTPACRDSLQNGHTSDSSSGESSGGHRPRRGPSPSHVRFEDESAREAEFRHLERLQQRQRQVLSTVLQAADQGPLRSKPDLADYINGAPRLRDAGQGTFHRLVGSLDRRGHPAPPAPGSERRCQACGSCIDDPRPAQGKAPPVPRTLQELQAACGMERVLGGLSSPLRLLPAEPRLHMEWIRETHIGDTVCPAEVDSALDSTDNSDNCRTDSEEAGTSQAGWACGRTQGSSPRLRLRGSRPRGHRWSKKAEAELPWGLQAQQHLPRADDVEVENEVKEGRGHTPEGTLFLREDAKPPDLELKRVSLGPQWQPGPGLGSHQPHPLDSRTPCRTAYATTAPMTPESSGPGGQAQVTESHESLEIVSPSSLQQSHAEPSAPHQAWQPTASLCPEGWAPTPPPSRKTTSPVSHRKAALAGLLRLGDQTEPVGIPRPPSRSAVLRTCELPPSQTQPSRPQVRHPLLALSTNNCNNSAPRGLQEPYGGAVHEGRVERGPCSREPEPPLENSRDGGPQGFLGSADVATINSTGITLSLSSEESESSKESEGSLQRTGSGSGGHVLSRASAGAGTGPGSPSAAPLDQNKKRSSSIASTLGLKKLFSALGQSSRPKLGKSRSYSVEQLQPAPPGLTSQSRAPSLQSLHPVSPSHQRRKAASFQNLHSLLSSKGNRSSLYLVAGPGDHSAAGRPAKTSPRRALSVEDVGAPSLARTVGRLVEVFPDGTSQLQLQRSPGGTFGFCVASGNGRPDSGMPSPLPQPHGWGGLSKQGRAFWLWSEAFLVFG

SEQ ID NO: 43571 - protein, 199 aa, Homo sapiens
  Payload ID: 8955
  Gene Symbol: KIAA1644
  Gene Name: KIAA1644
  Uniprot ID: Q3SXP7
  ENSP ID: ENSP00000370568
MTSCGQQSLNVLAVLFSLLFSAVLSAHFRVCEPYTDHKGRYHFGFHCPRLSDNKTFILCCHHNNTVFKYCCNETEFQAVMQANLTASSEGYMHNNYTALLGVWIYGFFVLMLLVLDLLYYSAMNYDICKVYLARWGIQGRWMKQDPRRWGNPARAPRPGQRAPQPQPPPGPLPQAPQAVHTLRGDAHSPPLMTFQSSSA

SEQ ID NO: 43572 - protein, 1806 aa, Homo sapiens
  Payload ID: 8956
  Gene Symbol: KIAA1671
  Gene Name: KIAA1671
  Uniprot ID: Q9BY89
  ENSP ID: ENSP00000351207
MATRVEVGSITPLTAVPGLGEMGKEETLTRTYFLQAGEASGAPPARILEAKSPLRSPARLLPLPRLAPKPFSKEQDVKSPVPSLRPSSTGPSPSGGLSEEPAAKDLDNRMPGLVGQEVGSGEGPRTSSPLFNKAVFLRPSSSTMILFETTKSGPALGKAVSEGAEEAKLGVSGSRPEVAAKPALPTQKPAGTLPRSAPLSQDTKPPVPQEEAGQDHPPSKASSVEDTARPLVEPRPRLKRRPVSAIFTESIQPQKPGPGAAATVGKVPPTPPEKTWVRKPRPLSMDLTARFENKEALLRKVADEGSGPTAGDMAGLERPRAASKLDRDCLVKAEAPLHDPDLDFLEVAKKIRERKEKMLSKPEMGSPRALVGGSSGVTPSNDQSPWEEKAKLDPEPEKAAESPSPRLGRGLELAEVKSRVADGEAAAGGEWASRRSVRKCISLFREDSTLALAVGSESPLATPASPSAAPEPEKGVVSVQERIRGWTAESSEAKPEVRRRTFQARPLSADLTKLFSSSASSNEVKYEKSAELSGEFPKEPREKQKEGHSLDGACIPRSPWKPGTLRDKSRQTEQKVSSNQDPDSCRGGSSVEAPCPSDVTPEDDRSFQTVWATVFEHHVERHTVADQSGRCLSTTPPGDMAHARVSEPRPRPEMGSWLGRDPPDMTKLKKENSRGFDNPETEKLGPTTLLNGELRPYHTPLRDKYPLSENHNNNTFLKHLENPPTSQRIEPRYDIVHAVGERVHSEAISPAPEEKAVTLRSLRSWLSLKDRQLSQEVTPADLECGLEGQAGSVQRASLIWEARGMPEASGPKFGGNCPFPKWTGGAVVSSHKATVAVSEEHCAPGATSVRAIKAAIWESQHEGPEGARSKPGVGARGPPQGCPLDPLSRATNGPSDSQARTHPDAFAVQKGPFIVAAREGDPGPAQVPQPAVRMRKAGAMDQRMDRWRRRTLPPNVKFDTFSSLVPEDSPHVGHRRTDYVSPTASALRKPQLSHYRVETQEVNPGASRDQTSPAVKQGSPVEPKATFFAVTYQIPNTQKAKGVVLSGAESLLEHSRKITPPSSPHSLTSTLVSLGHEEALEMAGSKNWMKGREHENASILKTLKPTDRPSSLGAWSLDPFNGRIIDVDALWSHRGSEDGPRPQSNWKESANKMSPSGGAPQTTPTLRSRPKDLPVRRKTDVISDTFPGKIRDGYRSSVLDIDALMAEYQELSLKVPGEAQERRSPTVEPSTLPRERPVQLGGVEQRRRSLKEMPDTGGLWKPASSAEINHSFTPGLGKQLAETLETAMGTKSSPPFWALPPSAPSERYPGGSPIPADPRKKTGFAEDDRKAFASKHHVAKCQNYLAESKPSGREDPGSGVRVSPKSPPTDQKKGTPRKSTGRGEEDSVAQWGDHPRDCGRVPLDIKRAYSEKGPPANIREGLSIMHEARERRREQPKGRPSLTGENLEAKMGPCWWESGTGDSHKVLPRDLEKEDAPQEKERPLQQVSPVASVPWRSHSFCKDRRSGPFVDQLKQCFSRQPTEPKDTDTLVHEAGSQYGTWTEQCQSGESLATESPDSSATSTRKQPPSSRLSSLSSQTEPTSAGDQYDCSRDQRSTSVDHSSTDLESTDGMEGPPPPDACPEKRVDDFSFIDQTSVLDSSALKTRVQLSKRSRRRAPISHSLRRSRFSESESRSPLEDETDNTWMFKDSTEEKSPRKEESDEEETASKAERTPVSHPQRMPAFPGMDPAVLKAQLHKRPEVDSPGETPSWAPQPKSPKSPFQPGVLGSRVLPSSMDKDERSDEPSPQWLKELKSKKRQSLYENQV

SEQ ID NO: 43573 - protein, 1806 aa, Homo sapiens; identical to SEQ ID NO: 43572
  Payload ID: 8956
  Gene Symbol: KIAA1671
  Gene Name: KIAA1671
  Uniprot ID: Q9BY89
  ENSP ID: ENSP00000385152

SEQ ID NO: 43574 - protein, 313 aa, Homo sapiens
  Payload ID: 8956
  Gene Symbol: KIAA1671
  Gene Name: KIAA1671
  Uniprot ID: Q9BY89
  ENSP ID: ENSP00000385377
MEYYYCPSLLKLLRYLWDQLKQCFSRQPTEPKDTDTLVHEAGSQYGTWTEQCQSGESLATESPDSSATSTRKQPPSSRLSSLSSQTEPTSAGDQYDCSRDQRSTSVDHSSTDLESTDGMEGPPPPDACPEKRVDDFSFIDQTSVLDSSALKTRVQLSKRSRRRAPISHSLRRSRFSESESRSPLEDETDNTWMFKDSTEEKSPRKEESDEEETASKAERTPVSHPQRMPAFPGMDPAVLKAQLHKRPEVDSPGETPSWAPQPKSPKSPFQPGVLGSRVLPSSMDKDERSDEPSPQWLKELKSKKRQSLYENQV

SEQ ID NO: 43575 - protein, 1367 aa, Homo sapiens
  Payload ID: 8957
  Gene Symbol: KIAA1683
  Gene Name: KIAA1683
  Uniprot ID: Q9H0B3
  ENSP ID: ENSP00000376213
MTLQGRADLSGNQGNAAGRLATVHEPVVTQWAVHPPAPAHPSLLDKMEKAPPQPQHEGLKSKEHLPQQPAEGKTASRRVPRLRAVVESQAFKNILVDEMDMMHARAATLIQANWRGYWLRQKLISQMMAAKAIQEAWRRFNKRHILHSSKSLVKKTRAEEGDIPYHAPQQVRFQHPEENRLLSPPIMVNKETQFPSCDNLVLCRPQSSPLLQPPAAQGTPEPCVQGPHAARVRGLAFLPHQTVTIRFPCPVSLDAKCQPCLLTRTIRSTCLVHIEGDSVKTKRVSARTNKARAPETPLSRRYDQAVTRPSRAQTQGPVKAETPKAPFQICPGPMITKTLLQTYPVVSVTLPQTYPASTMTTTPPKTSPVPKVTIIKTPAQMYPGPTVTKTAPHTCPMPTMTKIQVHPTASRTGTPRQTCPATITAKNRPQVSLLASIMKSLPQVCPGPAMAKTPPQMHPVTTPAKNPLQTCLSATMSKTSSQRSPVGVTKPSPQTRLPAMITKTPAQLRSVATILKTLCLASPTVANVKAPPQVAVAAGTPNTSGSIHENPPKAKATVNVKQAAKVVKASSPSYLAEGKIRCLAQPHPGTGVPRAAAELPLEAEKIKTGTQKQAKTDMAFKTSVAVEMAGAPSWTKVAEEGDKPPHVYVPVDMAVTLPRGQLAAPLTNASSQRHPPCLSQRPLAAPLTKASSQGHLPTELTKTPSLAHLDTCLSKMHSQTHLATGAVKVQSQAPLATCLTKTQSRGQPITDITTCLIPAHQAADLSSNTHSQVLLTGSKVSNHACQRLGGLSAPPWAKPEDRQTQPQPHGHVPGKTTQGGPCPAACEVQGMLVPPMAPTGHSTCNVESWGDNGATRAQPSMPGQAVPCQEDTVGSLLASLCAEVAGVLASQEDLRTLLAKALSQGEVWAALNQALSKEVLGATVTKALPQSMLSMALVKALSWSELRLTLSRALSRGELRAELTKVMQGKLAEVLSKALTEEEWVALSQALCQGELGALLSQSWCRVALRTGTILPKAASKSTGSGVTKTPALVKVACRRSPSAAWGPSLGPVRPQTSKGPADAGVVGGQSWNRAWEPARGAASWDTWRNKAVVPPRRSGEPMVSMQAAEEIRILAVITIQAGVRGYLARRRIRLWHRGAMVIQATWRGYRVRRNLAHLCRATTTIQSAWRGYSTRRDQARHWQMLHPVTWVELGSRAGVMSDRSWFQDGRARTVSDHRCFQSCQAHACSVCHSLSSRIGSPPSVVMLVGSSPRTCHTCGRTQPTRVVQGMGQGTEGPGAVSWASAYQLAALSPRQPHRQDKAATAIQSAWRGFKIRQQMRQQQMAAKIVQATWRGHHTRSCLKNTEALLGPADPSASSRHMHWPGI

SEQ ID NO: 43576 - protein, 1180 aa, Homo sapiens
  Payload ID: 8957
  Gene Symbol: KIAA1683
  Gene Name: KIAA1683
  Uniprot ID: Q9H0B3
  ENSP ID: ENSP00000470780
MTLQGRADLSGNQGNAAGRLATVHEPVVTQWAVHPPAPAHPSLLDKMEKAPPQPQHEGLKSKEHLPQQPAEGKTASRRVPRLRAVVESQAFKNILVDEMDMMHARAATLIQANWRGYWLRQKLISQMMAAKAIQEAWRRFNKRHILHSSKSLVKKTRAEEGDIPYHAPQQVRFQHPEENRLLSPPIMVNKETQFPSCDNLVLCRPQSSPLLQPPAAQGTPEPCVQGPHAARVRGLAFLPHQTVTIRFPCPVSLDAKCQPCLLTRTIRSTCLVHIEGDSVKTKRVSARTNKARAPETPLSRRYDQAVTRPSRAQTQGPVKAETPKAPFQICPGPMITKTLLQTYPVVSVTLPQTYPASTMTTTPPKTSPVPKVTIIKTPAQMYPGPTVTKTAPHTCPMPTMTKIQVHPTASRTGTPRQTCPATITAKNRPQVSLLASIMKSLPQVCPGPAMAKTPPQMHPVTTPAKNPLQTCLSATMSKTSSQRSPVGVTKPSPQTRLPAMITKTPAQLRSVATILKTLCLASPTVANVKAPPQVAVAAGTPNTSGSIHENPPKAKATVNVKQAAKVVKASSPSYLAEGKIRCLAQPHPGTGVPRAAAELPLEAEKIKTGTQKQAKTDMAFKTSVAVEMAGAPSWTKVAEEGDKPPHVYVPVDMAVTLPRGQLAAPLTNASSQRHPPCLSQRPLAAPLTKASSQGHLPTELTKTPSLAHLDTCLSKMHSQTHLATGAVKVQSQAPLATCLTKTQSRGQPITDITTCLIPAHQAADLSSNTHSQVLLTGSKVSNHACQRLGGLSAPPWAKPEDRQTQPQPHGHVPGKTTQGGPCPAACEVQGMLVPPMAPTGHSTCNVESWGDNGATRAQPSMPGQAVPCQEDTGPADAGVVGGQSWNRAWEPARGAASWDTWRNKAVVPPRRSGEPMVSMQAAEEIRILAVITIQAGVRGYLARRRIRLWHRGAMVIQATWRGYRVRRNLAHLCRATTTIQSAWRGYSTRRDQARHWQMLHPVTWVELGSRAGVMSDRSWFQDGRARTVSDHRCFQSCQAHACSVCHSLSSRIGSPPSVVMLVGSSPRTCHTCGRTQPTRVVQGMGQGTEGPGAVSWASAYQLAALSPRQPHRQDKAATAIQSAWRGFKIRQQMRQQQMAAKIVQATWRGHHTRSCLKNTEALLGPADPSASSRHMHWPGI

SEQ ID NO: 43577 - protein, 1134 aa, Homo sapiens
  Payload ID: 8957
  Gene Symbol: KIAA1683
  Gene Name: KIAA1683
  Uniprot ID: Q9H0B3
  ENSP ID: ENSP00000472912
MEKAPPQPQHEGLKSKEHLPQQPAEGKTASRRVPRLRAVVESQAFKNILVDEMDMMHARAATLIQANWRGYWLRQKLISQMMAAKAIQEAWRRFNKRHILHSSKSLVKKTRAEEGDIPYHAPQQVRFQHPEENRLLSPPIMVNKETQFPSCDNLVLCRPQSSPLLQPPAAQGTPEPCVQGPHAARVRGLAFLPHQTVTIRFPCPVSLDAKCQPCLLTRTIRSTCLVHIEGDSVKTKRVSARTNKARAPETPLSRRYDQAVTRPSRAQTQGPVKAETPKAPFQICPGPMITKTLLQTYPVVSVTLPQTYPASTMTTTPPKTSPVPKVTIIKTPAQMYPGPTVTKTAPHTCPMPTMTKIQVHPTASRTGTPRQTCPATITAKNRPQVSLLASIMKSLPQVCPGPAMAKTPPQMHPVTTPAKNPLQTCLSATMSKTSSQRSPVGVTKPSPQTRLPAMITKTPAQLRSVATILKTLCLASPTVANVKAPPQVAVAAGTPNTSGSIHENPPKAKATVNVKQAAKVVKASSPSYLAEGKIRCLAQPHPGTGVPRAAAELPLEAEKIKTGTQKQAKTDMAFKTSVAVEMAGAPSWTKVAEEGDKPPHVYVPVDMAVTLPRGQLAAPLTNASSQRHPPCLSQRPLAAPLTKASSQGHLPTELTKTPSLAHLDTCLSKMHSQTHLATGAVKVQSQAPLATCLTKTQSRGQPITDITTCLIPAHQAADLSSNTHSQVLLTGSKVSNHACQRLGGLSAPPWAKPEDRQTQPQPHGHVPGKTTQGGPCPAACEVQGMLVPPMAPTGHSTCNVESWGDNGATRAQPSMPGQAVPCQEDTGPADAGVVGGQSWNRAWEPARGAASWDTWRNKAVVPPRRSGEPMVSMQAAEEIRILAVITIQAGVRGYLARRRIRLWHRGAMVIQATWRGYRVRRNLAHLCRATTTIQSAWRGYSTRRDQARHWQMLHPVTWVELGSRAGVMSDRSWFQDGRARTVSDHRCFQSCQAHACSVCHSLSSRIGSPPSVVMLVGSSPRTCHTCGRTQPTRVVQGMGQGTEGPGAVSWASAYQLAALSPRQPHRQDKAATAIQSAWRGFKIRQQMRQQQMAAKIVQATWRGHHTRSCLKNTEALLGPADPSASSRHMHWPGI

SEQ ID NO: 43578 - protein, 7 aa, Homo sapiens
  Payload ID: 8957
  Gene Symbol: KIAA1683
  Gene Name: KIAA1683
  ENSP ID: ENSP00000475649
MEKAPPQ

SEQ ID NO: 43579 - protein, 22 aa, Homo sapiens
  Payload ID: 8957
  Gene Symbol: KIAA1683
  Gene Name: KIAA1683
  ENSP ID: ENSP00000475861
MEKAPPQPQHEGLKSKEHLPQQ

SEQ ID NO: 43580 - protein, 94 aa, Homo sapiens
  Payload ID: 8957
  Gene Symbol: KIAA1683
  Gene Name: KIAA1683
  ENSP ID: ENSP00000476085
MEKAPPQPQHEGLKSKEHLPQQPAEGKTASRRVPRLRAVVESQAFKNILVDEMDMMHARAATLIQANWRGYWLRQKLISQMMAAKAIQEAWRRF

SEQ ID NO: 43581 - protein, 150 aa, Homo sapiens
  Payload ID: 8957
  Gene Symbol: KIAA1683
  Gene Name: KIAA1683
  ENSP ID: ENSP00000476292
MTLQGRADLSGNQGNAAGRLATVHEPVVTQWAVHPPAPAHPSLLDKMEKAPPQPQHEGLKSKEHLPQQPAEGKTASRRVPRLRAVVESQAFKNILVDEMDMMHARAATLIQANWRGYWLRQKLISQMMAAKAIQEAWRRFNKRHILHSSK

SEQ ID NO: 43582 - protein, 794 aa, Homo sapiens
  Payload ID: 8957
  Gene Symbol: KIAA1683
  Gene Name: KIAA1683
  ENSP ID: ENSP00000481156
MTLQGRADLSGNQGNAAGRLATVHEPVVTQWAVHPPAPAHPSLLDKMEKAPPQPQHEGLKSKEHLPQQPAEGKTASRRVPRLRAVVESQAFKNILVDEMDMMHARAATLIQANWRGYWLRQKLISQMMAAKAIQEAWRRFNKRHILHSSKSLVKKTRAEEGDIPYHAPQQVRFQHPEENRLLSPPIMVNKETQFPSCDNLVLCRPQSSPLLQPPAAQGTPEPCVQGPHAARVRGLAFLPHQTVTIRFPCPVSLDAKCQPCLLTRTIRSTCLVHIEGDSVKTNASSQRHPPCLSQRPLAAPLTKASSQGHLPTELTKTPSLAHLDTCLSKMHSQTHLATGAVKVQSQAPLATCLTKTQSRGQPITDITTCLIPAHQAADLSSNTHSQVLLTGSKVSNHACQRLGGLSAPPWAKPEDRQTQPQPHGHVPGKTTQGGPCPAACEVQGMLVPPMAPTGHSTCNVESWGDNGATRAQPSMPGQAVPCQEDTGPADAGVVGGQSWNRAWEPARGAASWDTWRNKAVVPPRRSGEPMVSMQAAEEIRILAVITIQAGVRGYLARRRIRLWHRGAMVIQATWRGYRVRRNLAHLCRATTTIQSAWRGYSTRRDQARHWQMLHPVTWVELGSRAGVMSDRSWFQDGRARTVSDHRCFQSCQAHACSVCHSLSSRIGSPPSVVMLVGSSPRTCHTCGRTQPTRVVQGMGQGTEGPGAVSWASAYQLAALSPRQPHRQDKAATAIQSAWRGFKIRQQMRQQQMAAKIVQATWRGHHTRSCLKNTEALLGPADPSASSRHMHWPGI

SEQ ID NO: 43583 - protein, 428 aa, Homo sapiens
  Payload ID: 8958
  Gene Symbol: KIAA1715
  Gene Name: KIAA1715
  Uniprot ID: Q9C0E8
  ENSP ID: ENSP00000272748
MGGLFSRWRTKPSTVEVLESIDKEIQALEEFREKNQRLQKLWVGRLILYSSVLYLFTCLIVYLWYLPDEFTARLAMTLPFFAFPLIIWSIRTVIIFFFSKRTERNNEALDDLKSQRKKILEEVMEKETYKTAKLILERFDPDSKKAKECEPPSAGAAVTARPGQEIRQRTAAQRNLSPTPASPNQGPPPQVPVSPGPPKDSSAPGGPPERTVTPALSSNVLPRHLGSPATSVPGMGLHPPGPPLARPILPRERGALDRIVEYLVGDGPQNRYALICQQCFSHNGMALKEEFEYIAFRCAYCFFLNPARKTRPQAPRLPEFSFEKRQVVEGSSSVGPLPSGSVLSSDNQFNEESLEHDVLDDNTEQTDDKIPATEQTNQVIEKASDSEEPEEKQETENEEASVIETNSTVPGADSIPDPELSGESLTAE

SEQ ID NO: 43584 - protein, 114 aa, Homo sapiens
  Payload ID: 8958
  Gene Symbol: KIAA1715
  Gene Name: KIAA1715
  ENSP ID: ENSP00000376323
MEGKTKPSTVEVLESIDKEIQALEEFREKNQRLQKLWVGRLILYSSVLYLFTCLIVYLWYLPDEFTARLAMTLPFFAFPLIIWSIRTVIIFFFSKRTERNNEALDDLKSQRKKI

SEQ ID NO: 43585 - protein, 305 aa, Homo sapiens
  Payload ID: 8958
  Gene Symbol: KIAA1715
  Gene Name: KIAA1715
  Uniprot ID: Q9C0E8
  ENSP ID: ENSP00000386237
MEKETYKTAKLILERFDPDSKKAKECEPPSAGAAVTARPGQEIRQRTAAQRNLSPTPASPNQGPPPQVPVSPGPPKDSSAPGGPPERTVTPALSSNVLPRHLGSPATSVPGMGLHPPGPPLARPILPRERGALDRIVEYLVGDGPQNRYALICQQCFSHNGMALKEEFEYIAFRCAYCFFLNPARKTRPQAPRLPEFSFEKRQVVEGSSSVGPLPSGSVLSSDNQFNEESLEHDVLDDNTEQTDDKIPATEQTNQVIEKASDSEEPEEKQETENEEASVIETNSTVPGADSIPDPELSGESLTAE

SEQ ID NO: 43586 - protein, 83 aa, Homo sapiens
  Payload ID: 8958
  Gene Symbol: KIAA1715
  Gene Name: KIAA1715
  ENSP ID: ENSP00000388262
MGGLFSRWRTKPSTVEVLESIDKEIQALEEFREKNQRLQKLWVGRLILYSSVLYLFTCLIVYLWYLPDEFTARLAMTLPFFAF

SEQ ID NO: 43587 - protein, 69 aa, Homo sapiens
  Payload ID: 8958
  Gene Symbol: KIAA1715
  Gene Name: KIAA1715
  ENSP ID: ENSP00000388507
GSPATSVPGMGLHPPGPPLARPILPRERGALDRIVEYLVGDGPQNSFSMCLLFFLEPCKKNQTSGSKTS

SEQ ID NO: 43588 - protein, 459 aa, Homo sapiens
  Payload ID: 8958
  Gene Symbol: KIAA1715
  Gene Name: KIAA1715
  Uniprot ID: Q9C0E8
  ENSP ID: ENSP00000440905
MGGLFSRWRTKPSTVEVLESIDKEIQALEEFREKNQRLQKLWVGRLILYSSVLYLFTCLIVYLWYLPDEFTARLAMTLPFFAFPLIIWSIRTVIIFFFSKRTERNNEALDDLKSQRKKILEEVMEKETYKTAKLILERFDPDSKKAKECEPPSAGAAVTARPGQEIRQRTAAQRNLSPTPASPNQGPPPQVPVSPGPPKDSSAPGGPPERTVTPALSSNVLPRHLGSPATSVPGMEMGLPHIAQAGLEHLSSSDLSTSTSQSAGITGLHPPGPPLARPILPRERGALDRIVEYLVGDGPQNRYALICQQCFSHNGMALKEEFEYIAFRCAYCFFLNPARKTRPQAPRLPEFSFEKRQVVEGSSSVGPLPSGSVLSSDNQFNEESLEHDVLDDNTEQTDDKIPATEQTNQVIEKASDSEEPEEKQETENEEASVIETNSTVPGADSIPDPELSGESLTAE

SEQ ID NO: 43589 - protein, 1200 aa, Homo sapiens
  Payload ID: 8959
  Gene Symbol: KIAA1755
  Gene Name: KIAA1755
  Uniprot ID: Q5JYT7
  ENSP ID: ENSP00000279024
MDPPSLDTAIQHALAGLYPPFEATAPTVLGQVFRLLDSGFQGDGLSFLLDFLIPAKRLCEQVREAACAPYSHCLFLHEGWPLCLRDEVVVHLAPLNPLLLRQGDFYLQVEPQEEQSVCIMIKCLSLDLCTVDKKPVPEPAYPILFTQEWLEAINSDFEGNPLHNCLVASENGIAPVPWTKITSPEFVDDRPQVVNALCQAWGPLPLEALDLSSPQELHQASSPDNQVLPAQSLAKGKGRTYGSKYPGLIKVEQARCGEVAFRMDEVVSQDFEGDYVALLGFSQESRGESPSREAGTSSGCTSGALEEIAGTKETPLFQKILPLSEANEGPSLGNRACTKPESSEERPYNLGFRRKVNLKAPTHNSERPPQGSYMNVLEDALDCASGLRAGVSQEPAASKMQGPLGNPENMVQLRPGPRQASSPRLSPASPAAAASETKIEVKTKERNGRLPKPMPCPSRNTSSPEPPTPGLKFSFLRGQRQPSVTPEKASLQHNGPWKVLCSLYSPKPNRAKSLGKAGTTQTKTSGPATAPSPLTEEKAALPEASAGSPERGPTLEEEPPGPEPRIGALGVKVFRSRIACLPGGRDRAGRPLLLVSTTEGAWEAPWCTVSEVTKLLSYLCTIPRPEDKAKGLAVLIDARRQPPQPGLVSALQATQAQVPASIRAILFLGEKEAALQLQTLPDVQVEVLTSLKALSHHVDPSQLPAVLEGPFPYCHTEWVHFFQKLDPFLADLHQASSLLQASIEEFEKADPPGGMQEATRCLSKSKELMEAVLRDPGLLGLQREGGATLARLQHDASRLDFSPDVRSHLAAATALYSLVDEQLHVLVTASNSLLGKLELRVRLGRLEAAIHQVSDWMEQEGRRCLQSLTPKDGSLETVEKAHAEFENFFLQAAAQYRRGLELSKQAAQLGATARGAGEAERAEFPELAAFASTQRAFQAELTHFYMAAERQRTDLETLLHLHRFCKRMTWFHMDCQDLMAQLRLDKTSRVSPGDQRRLHRYLQRLASEFPAEKLAAVGLQVASLSRAGLGQELWEEARIRHEEIRMLLEKALTHSSCPEAPAAHSARPERRGVAAKGQGVSVEVTSKGRWDQPPLDSLGMDHLPKSYWPPGPPRGEQNRTFQAGSPPQEAGQAAEAEDGKGSHKLPDPAREHLLATTFFRQQPPRQSQVPRLTGGSFSSEGTDSQTSLEDSPQTSPLASL

SEQ ID NO: 43590 - protein, 266 aa, Homo sapiens
  Payload ID: 8959
  Gene Symbol: KIAA1755
  Gene Name: KIAA1755
  ENSP ID: ENSP00000393503
RAILFLGEKEAALQLQTLPDVQKLDPFLADLHQASSLLQASIEEFEKADPPGGMQEATRCLSKSKELMEAVLRDPGLLGLQREGGATLARLQHDASRLDFSPDVRSHLAAATALYSLVDEQLHVLVTASNSLLGKLELRVRLGRLEAAIHQVSDWMEQEGRRCLQSLTPKDGSLETVEKAHAEFENFFLQAAAQYRRGLELSKQAAQLGATARGAGEAERAEFPELAAFASTQRAFQAELTHFYMAAERQRTDLETLLHLHRFCKR

SEQ ID NO: 43591 - protein, 38 aa, Homo sapiens
  Payload ID: 8959
  Gene Symbol: KIAA1755
  Gene Name: KIAA1755
  ENSP ID: ENSP00000480536
  MOD_RES (1)..(1): Any amino acid
XPGPEPRIGALGVKVFRSRIACLPGSSFLFGSGPFPSG

SEQ ID NO: 43592 - protein, 732 aa, Homo sapiens
  Payload ID: 8959
  Gene Symbol: KIAA1755
  Gene Name: KIAA1755
  ENSP ID: ENSP00000483264
MDPPSLDTAIQHALAGLYPPFEATAPTVLGQVFRLLDSGFQGDGLSFLLDFLIPAKRLCEQVREAACAPYSHCLFLHEGWPLCLRDEVVVHLAPLNPLLLRQGDFYLQVEPQEEQSVCIMIKCLSLDLCTVDKKPVPEPAYPILFTQEWLEAINSDFEGNPLHNCLVASENGIAPVPWTKITSPEFVDDRPQVVNALCQAWGPLPLEALDLSSPQELHQASSPDNQVLPAQSLAKGKGRTYGSKYPGLIKVEQARCGEVAFRMDEVVSQDFEGDYVALLGFSQESRGESPSREAGTSSGCTSGALEEIAGTKETPLFQKILPLSEANEGPSLGNRACTKPESSEERPYNLGFRRKVNLKAPTHNSERPPQGSYMNVLEDALDCASGLRAGVSQEPAASKMQGPLGNPENMVQLRPGPRQASSPRLSPASPAAAASETKIEVKTKERNGRLPKPMPCPSRNTSSPEPPTPGLKFSFLRGQRQPSVTPEKASLQHNGPWKVLCSLYSPKPNRAKSLGKAGTTQTKTSGPATAPSPLTEEKAALPEASAGSPERGPTLEEEPPGPEPRIGALGVKVFRSRIACLPGGRDRAGRPLLLVSTTEGAWEAPWCTVSEVTKLLSYLCTIPRPEDKAKGLAVLIDARRQPPQPGLVSALQATQAQVPASIRAILFLGEKEAALQLQTLPDVQVEVLTSLKALSHHVDPSQLPAVLEGPFPYCHTEWVHFFQVFTVTAFSP

SEQ ID NO: 43593 - protein, 707 aa, Homo sapiens
  Payload ID: 8960
  Gene Symbol: KIAA1841
  Gene Name: KIAA1841
  Uniprot ID: Q6NSI8
  ENSP ID: ENSP00000295031
MSRGYSENNNFLNNNNQMVLDMILYPLIGIPQTINWETIARLVPGLTPKECAKRFDELKSSGSSPVDNQYNSLMAAGESPVETLATYIKSSLLDIHGEFQETPVGHDAVSKTGRHSIASTRNCSSESENCTTHNGGEMTEESEGPNMVIHVCDEAKNLKEDFTCPRDLLISEMKYFAEYLSMDAQRWEEVDISVHCDVHIFNWLIKYIKRNTKENKDCEMPTLEPGNVISILISSEFLKMDSLVEQCIQYCHKNMNAIVATPCNMNCINANLLTRIADLFSHNEVDDLKDKKDKFKSKLFCKKIERLFDPEYLNPDSRSNAATLYRCCLCKKLLTKETERRIPCIPGKINVDRRGNIVYIHIRDKTWDVHEYLNSLFEELKSWRDVYWRLWGTINWLTCSRCYQAFLCIEFSHCQYHSETVVYPTAASSLNTVGTGIYPCCNQKVLRFDPTQLTKGCKVRDHMVTLRDQGEGGDLPSCPTARMLDDLHKYRDVIVVPFSKDTVSDVGVGLCDEKGIECDVLLEPNTPWGPKTGELNAFLSLKNWTLQLKQQSLFSEEEEYTTGSEVTEDEVGDEEEVSKKQRKKEKPKKFTRQPKKQVSSPCAQRKEKALEKSASRDVSPFVMSMQKNKWDATRSLRFNQDAQREDDQRRMTEITGHLIKMRLGDLDRVKSKEAKETDKLRPRDGTVSKSNRKSGLSSVLLMTVLLC

SEQ ID NO: 43594 - protein, 707 aa, Homo sapiens; identical to SEQ ID NO: 43593
  Payload ID: 8960
  Gene Symbol: KIAA1841
  Gene Name: KIAA1841
  Uniprot ID: Q6NSI8
  ENSP ID: ENSP00000349154

SEQ ID NO: 43595 - protein, 718 aa, Homo sapiens
  Payload ID: 8960
  Gene Symbol: KIAA1841
  Gene Name: KIAA1841
  Uniprot ID: Q6NSI8
  ENSP ID: ENSP00000385579
MSRGYSENNNFLNNNNQMVLDMILYPLIGIPQTINWETIARLVPGLTPKECAKRFDELKSSGSSPVDNQYNSLMAAGESPVETLATYIKSSLLDIHGEFQETPVGHDAVSKTGRHSIASTRNCSSESENCTTHNGGEMTEESEGPNMVIHVCDEAKNLKEDFTCPRDLLISEMKYFAEYLSMDAQRWEEVDISVHCDVHIFNWLIKYIKRNTKENKDCEMPTLEPGNVISILISSEFLKMDSLVEQCIQYCHKNMNAIVATPCNMNCINANLLTRIADLFSHNEVDDLKDKKDKFKSKLFCKKIERLFDPEYLNPDSRSNAATLYRCCLCKKLLTKETERRIPCIPGKINVDRRGNIVYIHIRDKTWDVHEYLNSLFEELKSWRDVYWRLWGTINWLTCSRCYQAFLCIEFSHCQYHSETVVYPTAASSLNTVGTGIYPCCNQKVLRFDPTQLTKGCKVRDHMVTLRDQGEGGDLPSCPTARMLDDLHKYRDVIVVPFSKDTVSDVGVGLCDEKGIECDVLLEPNTPWGPKTGELNAFLSLKNWTLQLKQQSLFSEEEEYTTGSEVTEDEVGDEEEVSKKQRKKEKPKKFTRQPKKQVSSPCAQRKEKALEKSASRDVSPFVMSMQKNKWDATRSLRFNQDAQREDDQRRMTEITGHLIKMRLGDLDRVKSKEAKEFAGGIYSRLEAQIKASVPVSARQSSSEKNTRSKSRFGQGRPA

SEQ ID NO: 43596 - protein, 116 aa, Homo sapiens
  Payload ID: 8960
  Gene Symbol: KIAA1841
  Gene Name: KIAA1841
  ENSP ID: ENSP00000413200
MSRGYSENNNFLNNNNQMVLDMILYPLIGIPQTINWETIARLVPGLTPKECAKRFDELKSSGSSPVDNQYNSLMAAGESPVETLATYIKSSLLDIHGEFQETPVGHDAVSKTGQTW

SEQ ID NO: 43597 - protein, 718 aa, Homo sapiens; identical to SEQ ID NO: 43595
  Payload ID: 8960
  Gene Symbol: KIAA1841
  Gene Name: KIAA1841
  Uniprot ID: Q6NSI8
  ENSP ID: ENSP00000416795

SEQ ID NO: 43598 - protein, 572 aa, Homo sapiens
  Payload ID: 8960
  Gene Symbol: KIAA1841
  Gene Name: KIAA1841
  Uniprot ID: Q6NSI8
  ENSP ID: ENSP00000482126
MVIHVCDEAKNLKEDFTCPRDLLISEMKYFAEYLSMDAQRWEEVDISVHCDVHIFNWLIKYIKRNTKENKDCEMPTLEPGNVISILISSEFLKMDSLVEQCIQYCHKNMNAIVATPCNMNCINANLLTRIADLFSHNEVDDLKDKKDKFKSKLFCKKIERLFDPEYLNPDSRSNAATLYRCCLCKKLLTKETERRIPCIPGKINVDRRGNIVYIHIRDKTWDVHEYLNSLFEELKSWRDVYWRLWGTINWLTCSRCYQAFLCIEFSHCQYHSETVVYPTAASSLNTVGTGIYPCCNQKVLRFDPTQLTKGCKVRDHMVTLRDQGEGGDLPSCPTARMLDDLHKYRDVIVVPFSKDTVSDVGVGLCDEKGIECDVLLEPNTPWGPKTGELNAFLSLKNWTLQLKQQSLFSEEEEYTTGSEVTEDEVGDEEEVSKKQRKKEKPKKFTRQPKKQVSSPCAQRKEKALEKSASRDVSPFVMSMQKNKWDATRSLRFNQDAQREDDQRRMTEITGHLIKMRLGDLDRVKSKEAKEFAGGIYSRLEAQIKASVPVSARQSSSEKNTRSKSRFGQGRPA

SEQ ID NO: 43599 - protein, 518 aa, Homo sapiens
  Payload ID: 8961
  Gene Symbol: KIAA1919
  Gene Name: KIAA1919
  Uniprot ID: Q5TF39
  ENSP ID: ENSP00000357840
MLCASFLGLGLSVAIVGPTFQDLATNVNRNISSLSFIFVGRALGYLSGSVIGGFLVDVMNYFLLLGISMSATTVGLYLVPFCKTAILLTVMMSIFGVSIGILDTGGNVLILAIWGDKGAPHMQALHFSFALGAFLAPLLAKLALGPTASAENHTESDFHPALNQSSDADSEALFGVPNDKNLLWAYAVIGTYMFLVSVIFFCLFLKNSSKQEKARASAETFRRAKYHNALLCLLFLFFFFYVGAEVTYGSYVFSFATTHAGMKESEAAGLNSIFWGTFAACRGLAIFFATCLQPGTMIVLSNIGSLTSSLFLVLFDKNPICLWIATSVYGASMATTFPSGVSWIEQYTTIHGKSAAFFVIGASLGEMAIPAVIGILQGKYPDLPVVLYTSLGASIATGILFPVLYKLATSPLDRQRKEDRKSEDQKALLSSSGLNEYEEENEEEDAEKWNEMDFEMIETNDTMRHSIIETSRSSLTEPTAEVYNQYPSNALVFESSPFNTGSAHVKHLPETRTKGTNV

SEQ ID NO: 43600 - protein, 716 aa, Homo sapiens
  Payload ID: 8962
  Gene Symbol: KIAA1958
  Gene Name: KIAA1958
  Uniprot ID: Q8N8K9
  ENSP ID: ENSP00000336940
MEDCLHTSSENLSKLVSWAHSHGTICSLIPNLKHLLSEGSHGNLTAMWGCSAGHAYHWPLTATCRAGSQERVCFQDNRSFNSDSPSIIGVPSETQTSPVERYPGRPVKAKLDCNRTRDSCDFSYCSEPSELDETVEEYEDENTLFDMVCESSVTDEDSDFEPQTQRPQSIARKRPGVVPSSLHSSSQTQMVDECSNDVIIKKIKQEIPEDYYIVANAELTGGVDGPALSLTQMAKPKPQTHAGPSCVGSAKLIPHVTSAISTELDPHGMSASPSVISRPIVQKTARVSLASPNRGPPGTHGTNQQVAMQMPVSTSHPNKQISIPLSALQLPGQDEQVASEEFLSHLPSQVSSCEVALSPSVNTEPEVSSSQQQPPVAPAITTEATAQCIPAYSTKLNKFPVFNINDDLNDLCTSAVSPNTTKATRYALNVWRYWCMTNGLKDHTDITKIPAVKLNELLENFYVTVKKSDGSDFLATSLHAIRRGLDRILKNAGVGFSITSSTFSSSTKKLKEKLWVLSKAGMSGARSRNIVYFSLSDEEEMWQAGCLGDDSPITLLSTVVKYNSQYLNMRTLQEHADLMYGDIELLKDPQNQPYFARTDSVKRESRSGSTRVCHGKIYHEHSRGHKQCPYCLLYKYMYIHRPPTQMEAKSPFYLTARKEATDMGSVWYEEQRMGLRSLRGIVPNLAKKVKLENCENFTFVSFTQVSRRLGSHSCCQ

SEQ ID NO: 43601 - protein, 738 aa, Homo sapiens
  Payload ID: 8962
  Gene Symbol: KIAA1958
  Gene Name: KIAA1958
  Uniprot ID: Q8N8K9
  ENSP ID: ENSP00000363362
MEDCLHTSSENLSKLVSWAHSHGTICSLIPNLKHLLSEGSHGNLTAMWGCSAGHAYHWPLTATCRAGSQERVCFQDNRSFNSDSPSIIGVPSETQTSPVERYPGRPVKAKLDCNRTRDSCDFSYCSEPSELDETVEEYEDENTLFDMVCESSVTDEDSDFEPQTQRPQSIARKRPGVVPSSLHSSSQTQMVDECSNDVIIKKIKQEIPEDYYIVANAELTGGVDGPALSLTQMAKPKPQTHAGPSCVGSAKLIPHVTSAISTELDPHGMSASPSVISRPIVQKTARVSLASPNRGPPGTHGTNQQVAMQMPVSTSHPNKQISIPLSALQLPGQDEQVASEEFLSHLPSQVSSCEVALSPSVNTEPEVSSSQQQPPVAPAITTEATAQCIPDQDERAAELSREQNEKTIRSTQTALRNFREFLISKYPSETREIYVIPCKELDAYLASFFVDARQKDGSEYEPNSLANYQCGLERYLKEHRYGYSITRDKEFKRSQEALKQKQIELRCKGKGNKPHKSMKLTFADELILRKRGLLSRYNPEGLLNLVWLNNTKAFGHCTGFHGSTLKWGDIRLRVTETGLEYLEWMGQDTGDLNAKTKRGGTDSRVYATQHAPQTCPVQDYKEYAQRRPPAMRYEDAPFYLSIKPVVNLAALHWYNCQALGKNKLAKMVKTMCEKGNIPGRKTNFSVYQSCSTLSEAQSNQLVLICNNLSQQAAQSVAGHSNNGNFIVSASYDSSSDTA

SEQ ID NO: 43602 - protein, 744 aa, Homo sapiens
  Payload ID: 8962
  Gene Symbol: KIAA1958
  Gene Name: KIAA1958
  Uniprot ID: Q8N8K9
  ENSP ID: ENSP00000440504
MEDCLHTSSENLSKLVSWAHSHGTICSLIPNLKHLLSEGSHGNLTAMWGCSAGHAYHWPLTATCRAGSQERVCFQDNRSFNSDSPSIIGVPSETQTSPVERYPGRPVKAKLDCNRTRDSCDFSYCSEPSELDETVEEYEDENTLFDMVCESSVTDEDSDFEPQTQRPQSIARKRPGVVPSSLHSSSQTQMVDECSNDVIIKKIKQEIPEDYYIVANAELTGGVDGPALSLTQMAKPKPQTHAGPSCVGSAKLIPHVTSAISTELDPHGMSASPSVISRPIVQKTARVSLASPNRGPPGTHGTNQQVAMQMPVSTSHPNKQISIPLSALQLPGQDEQVASEEFLSHLPSQVSSCEVALSPSVNTEPEVSSSQQQPPVAPAITTEATAQCIPDQDERAAELSREQNEKTIRSTQTALRNFPYSTKLNKFPVFNINDDLNDLCTSAVSPNTTKATRYALNVWRYWCMTNGLKDHTDITKIPAVKLNELLENFYVTVKKSDGSDFLATSLHAIRRGLDRILKNAGVGFSITSSTFSSSTKKLKEKLWVLSKAGMSGARSRNIVYFSLSDEEEMWQAGCLGDDSPITLLSTVVKYNSQYLNMRTLQEHADLMYGDIELLKDPQNQPYFARTDSVKRESRSGSTRVCHGKIYHEHSRGHKQCPYCLLYKYMYIHRPPTQMEAKSPFYLTARKEATDMGSVWYEEQRMGLRSLRGIVPNLAKKVKLENCENFTFVSFTQVSRRLGSHSCCQ

SEQ ID NO: 43603 - protein, 641 aa, Homo sapiens
  Payload ID: 8963
  Gene Symbol: KIAA2012
  Gene Name: KIAA2012
  ENSP ID: ENSP00000419834
VKKKKAPKALKLPPISEEPPRVLEPLKSQFKANEPPTELFILPVEIHYHTKQPPKEKAHRRGAPHPESEPESSEESTPVWRPPLKHASLETPWELTVHLPVDASRDTLSPQDDDAPPHDVAPPLDLLPPIKGKKSPESQKGVDSPRTSDHNSPPSLPNMRVPRRALPAAQAYESVNSNISHEEEGPSSQHFLKANTEPRANLHMNLYETSPLTQTTEKQGAQQSLEAAAQKTGEPQSCINKALICSNRKEFYTRKLHIDMTPFLKESGNALDYQEEAGRPLRETHHNDQDPEPRSMTLDSPRASRTEHIQTPEADIVQKVGRDYDVHHLHRGLLGYGPESPERLSAVYTSLLPREREGKAEPRLFSQETSANISHERDLINEAKRKEKPKKDKTKGPKSEREGKVYGQAEAAIGKSKDSKAKKKLEKKTRPQRKRTQKERNLEIAAELSGPDVSYEETEDTSNRGSFASDSFVEDPWLSPKYDAQESQVSLDGRSSPSQIATVTGNMESKEERRCEDPSKALLTKREQEKASWDRLRAERAEMRWLEVEKKRREQEEQRQLQQEQLERAKKMEEELELEQQRRTEEIRLRKQRLQEEQQRQEEEERKQQLRLKAAQERARQQQEEFRRKLRELQRKKQQEE

SEQ ID NO: 43604 - protein, 1180 aa, Homo sapiens
  Payload ID: 8963
  Gene Symbol: KIAA2012
  Gene Name: KIAA2012
  Uniprot ID: Q0VF49
  ENSP ID: ENSP00000437957
MFTLSLLSRGHGKLGQDKQKLEVYFEPEDYLNWRSPEDYVPVSKPQDKNNASQHSWSLFLPKTFSTRKGALILYSEGFAISAWTPKERRKGPYCPRGPWRKLDLELHTLQDLKEAILAYGRQQGEQDRAWQPYLHFRSQLESQAQRQIQPGHSAKRYLRGLLRTWPPDAMYRLWCAGYIKDSVLLQDSQLNVPKKLRPQQDLSGVPPKYHLLPVFPSFWIQQGKSFEQRQQGLDEGEAGAAGHVDQGPLAKNHGSQGTRLPPRRKQPWQEDETQAEDTSIENHLCLYASKESYNEKTQQTSRKAFGHGRIDHSWLPSDKSHITFCGGAFPNRKADLSDKQRNVKLHKARSSHLLQVLPAERSLFPPVASATGSRIITPGEVKKKKAPKALKLPPISEEPPRVLEPLKSQFKANEPPTELFILPVEIHYHTKQPPKEKAHRRGAPHPESEPESSEESTPVWRPPLKHASLETPWELTVHLPVDASRDTLSPQGSSSLPPASLGNLTLKGSKARHTRVHSQGKGVWKGDDDAPPHDVAPPLDLLPPIKGKKSPESQKGVDSPRTSDHNSPPSLPNMRVPRRALPAAQEDSSDPTLGHFLLGPDGEKVCLSLPGHTQTEALPSGKAYESVNSNISHEEEGPSSQHFLKANTEPRANLHMNLYETSPLTQTTEKQGAQQSLEAAAQKTGEPQSCINKALICSNRKEFYTRKLHIDMTPFLKESGNALDYQEEAGRPLRETHHNDQDPEPRSMTLDSPRASRTEHIQTPEADIVQKVGRDYDVHHLHRGLLGYGPESPERLSAVYTSLLPREREGKAEPRLFSQETSANISHERDLINEAKRKEKPKKDKTKGPKSEREGKVYGQAEAAIGKSKDSKAKKKLEKKTRPQRKRTQKERNLEIAAELSGPDVSYEETEDTSNRGSFASDSFVEDPWLSPKYDAQESQVSLDGRSSPSQIATVTGNMESKEERRCEDPSKALLTKREQEKASWDRLRAERAEMRWLEVEKKRREQEEQRQLQQEQLERAKKMEEELELEQQRRTEEIRLRKQRLQEEQQRQEEEERKQQLRLKAAQERARQQQEEFRRKLRELQRKKQQEEAERAEAEKQRQEELEMQLEEEQKHLMEMAEEERLEYQRRKQEAEEKARLEAEERRQKEEEAARLALEEATKQAQEQARYWIFGQQLP

SEQ ID NO: 43605 - protein, 634 aa, Homo sapiens
  Payload ID: 8964
  Gene Symbol: KIAA2013
  Gene Name: KIAA2013
  Uniprot ID: Q8IYS2
  ENSP ID: ENSP00000365756
MWLQQRLKGLPGLLSSSWARRLLCLLGLLLLLLWFGGSGARRAAGGLHLLPWSRGEPGAAEPSACLEAATRAWRGLRERGEVVPLGPGVPALVANGFLALDVAANRLWVTPGEREPAVAPDFVPFVQLRPLSALAEAGEAVLLLREGLLRRVRCLQLGSPGPGPVAAGPGPASVSGLAAGSGRDCVLLQEDFLAHRGRPHVYLQRIQLNNPTERVAALQTVGPTAGPAPKAFTSTLEKVGDHQFLLYSGRSPPTPTGLVHLVVVAAKKLVNRLQVAPKTQLDETVLWVVHVSGPINPQVLKSKAAKELKALQDLARKEMLELLDMPAAELLQDHQLLWAQLFSPGVEMKKITDTHTPSGLTVNLTLYYMLSCSPAPLLSPSLSHRERDQMESTLNYEDHCFSGHATMHAENLWPGRLSSVQQILQLSDLWRLTLQKRGCKGLVKVGAPGILQGMVLSFGGLQFTENHLQFQADPDVLHNSYALHGIRYKNDHINLAVLADAEGKPYLHVSVESRGQPVKIYACKAGCLDEPVELTSAPTGHTFSVMVTQPITPLLYISTDLTHLQDLRHTLHLKAILAHDEHMAQQDPGLPFLFWFSVASLITLFHLFLFKLIYNEYCGPGAKPLFRSKEDPSV

SEQ ID NO: 43606 - protein, 667 aa, Homo sapiens
  Payload ID: 8964
  Gene Symbol: KIAA2013
  Gene Name: KIAA2013
  Uniprot ID: Q8IYS2
  ENSP ID: ENSP00000365760
MWLQQRLKGLPGLLSSSWARRLLCLLGLLLLLLWFGGSGARRAAGGLHLLPWSRGEPGAAEPSACLEAATRAWRGLRERGEVVPLGPGVPALVANGFLALDVAANRLWVTPGEREPAVAPDFVPFVQLRPLSALAEAGEAVLLLREGLLRRVRCLQLGSPGPGPVAAGPGPASVSGLAAGSGRDCVLLQEDFLAHRGRPHVYLQRIQLNNPTERVAALQTVGPTAGPAPKAFTSTLEKVGDHQFLLYSGRSPPTPTGLVHLVVVAAKKLVNRLQVAPKTQLDETVLWVVHVSGPINPQVLKSKAAKELKALQDLARKEMLELLDMPAAELLQDHQLLWAQLFSPGVEMKKITDTHTPSGLTVNLTLYYMLSCSPAPLLSPSLSHRERDQMESTLNYEDHCFSGHATMHAENLWPGRLSSVQQILQLSDLWRLTLQKRGCKGLVKVGAPGILQGMVLSFGGLQFTENHLQFQADPDVLHNSYALHGIRYKNDHINLAVLADAEGKPYLHVSVESRGQPVKIYACKAGCLDEPVELTSAPTGHTFSVMVTQPITPLLYISTDLTHLQDLRHTLHLKAILAHDEHMAQQDPGLPFLFWFSVASLITLFHLFLFKLIYNEYCGPGAKPLFRSKVGSRHLVETRGLGLALSPVSRKGLAWRGGVRPGQEWVS

SEQ ID NO: 43607 - protein, 634 aa, Homo sapiens; identical to SEQ ID NO: 43605
  Payload ID: 8964
  Gene Symbol: KIAA2013
  Gene Name: KIAA2013
  Uniprot ID: Q8IYS2
  ENSP ID: ENSP00000480577

SEQ ID NO: 43608 - protein, 1516 aa, Homo sapiens
  Payload ID: 8965
  Gene Symbol: KIAA2022
  Gene Name: KIAA2022
  Uniprot ID: Q5QGS0
  ENSP ID: ENSP00000055682
MDNQQDKAIVASANGENTLINGVKENDSEDQDVAMKSFAALEAAAPIQPTPVAQKETLMYPRGLLPLPSKKPCMQSPPSPLGLIEAPEHAANSASVNAISLTSGIAKGLNTWSLPNECEKAPFAIMEPAGMSALNGDCLMQPSRTCLGCFMESKDAVDPEPGISLKVGDLNRDYETCAVSDIGIQCINAGENMKYGEQLLSDQLLGFPLHKSRAGDRRETEKPDIDLEDPAQKSYYEALLLDKCNTEEALLANSNQDWGYFETFISESKIELLDLCSKNELSVNLFSEEDVDNYMFDDDESTLGSDVCSLKIRYESFQDNVRDKTTLLMQEDAQFNFFPSVFTTCPKRESKSGALKQSSDFSQFKVPDVSIIWGEEDKNLDKKKGKEEGQEDKGVEKKDGKDNGEKPALNKPCSGTEVEQLKNPKQGHLANSLETSGSFSDDSSFIEISYDAMGEIKDCSRYMARDTNSGSSSSQQNYGLRAKRKVRYSEDYLYDVDSLEGEKVNERKEWLPVGSKEEDDDEWCPKKRRKVTRKEPPVIIKYIIINRFKGEKNMLVKLGKVDASETTVNLSENQLNKYAKLAPLKGFWQKKKKQRNTNTDSIKTPFSQKQSFEPGSFEVSFLPPARKRKSKLGNRHRIQRIPSIEISASSKQISLCNDQRHASNHKEDGGLKGTLKSAPLGAPSCANGSHLNDITGPDSVKVKAQDTEFKGPERKVLNKIKFKSEARLKSKKVKAAGQESKPIVQMSPLLENQSSKANLKNEVIPGTSNSSRLSEFHEAKAAKSSTFLPTTCSSEMPLSSANVTTNIPVIPGGYLQTLLDASDLSNNTSISYFSHHSPEQNEGSLTQTEKSFVPLQPTQDCVLTSSSDSELQQSSHNFKMESSNYRNVWPNKATSGTQEFMAEVSREIAPTQSSEFGASQVVSMENNLTPTTYNPICLNSGGSNCNKVLYDSMQDTQLPSDDSYQLCHFNNGEICFPFQQGPVNMDDGRLFSFDSMAPLSVSSSNYCSLSLKSCEKDGDDDITDDFLAHCSPKLVIQQSIDEIAPLKESTDLLDISNFTPDKFRHSSLSEMSPPDTPSLSPQITRCESMKTLGTLKGFQEGVPGPLDSVEKIKWDCSTLSRQVQMEDGFTLNNHQFQFHMFNDEDSVSLLQKNPCLSTFNDPSGQISTNNKVSKSRKKSSPSKSGAMNQSSSQKNTRKKSLKGNNKGIEKPPGKNSRQVPKSTKKGKYMAAINGEKMQIGIGRGGSQTNTISSTGKTLAECIQHGGPMASMKMPSQKGLSGDWALGKESSPGWSDMSMGTNTNSLLDDDQREFQEPSYILSNIASGMADVQRFMMASIEPLWEPMEHHGDPNIFYSPESNSLKLKTLKILAGTPQESKKKINSGSQGATKNHRSIKGVSKSNGKTAIGDPGRANMPGYNEDSRSTFFDKKYSNMSTLGNNGPTHKKLYRHKSSSKALRDEKCKGKHMEREQVHKDESGTASFEKLRDSDYNLLKAETTFWVLPVFEEETRIFQKDI

SEQ ID NO: 43609 - protein, 118 aa, Homo sapiens
  Payload ID: 8965
  Gene Symbol: KIAA2022
  Gene Name: KIAA2022
  ENSP ID: ENSP00000407055
  MOD_RES (1)..(1): Any amino acid
XKSNGKTAIGDPGRANMPGYNEDSRSTFFDKKYSNMSTLGNNGPTHKKLYRHKSSSKALRDEKCKGKHMEREQVHKDESGTASFEKLRDSDYNLLKAETTFWVLPVFEEETRIFQKDI

SEQ ID NO: 43610 - protein, 1516 aa, Homo sapiens; identical to SEQ ID NO: 43608
  Payload ID: 8965
  Gene Symbol: KIAA2022
  Gene Name: KIAA2022
  Uniprot ID: Q5QGS0
  ENSP ID: ENSP00000480284

SEQ ID NO: 43611 - protein, 2073 aa, Homo sapiens
  Payload ID: 8966
  Gene Symbol: KIAA2026
  Gene Name: KIAA2026
  Uniprot ID: Q5HYC2
  ENSP ID: ENSP00000370870
MSVPGTPGAMEPAGEEERPPPAAEGEDDEEEVAAAAQTSGPAHGRSASSLEDADDQEEEMEAMVIGGGCCKEQELTYELQQGYRILGEFLQEKHRGLTAPFLQPLGGVATAEEEVAEGPRSGGRGGRAFPQQPGQGMCLLQMEEKFASGQYGGITEFVADFRLMLETCYRLHGVDHWISKQGQKLEMMLEQKLALLSRHLREKTTIAVTSRGYYGLEDEKGTACTSTRRRSTPRSLAGLTSGVFESIMVQVLRQEEQLRAKEEKRLREQERKEAEEASQKEIEEWERKLLAQAAPTCMETMWEIPAIGHFLCLAQQILNLPEIVFYELERCLLMPQCNAFLSKIMTSLLSPPHRRPTLHRRPTLPYRTWEAALRQKVQQWYTAVGQTENPDNCAEKLGLCPQFFKVLGEVNPLEEKPFHELPFYQKVWLLKGLCDFVYETQKEVQDAVLGQPIHECREVILGYDYLENAYVHFPQFCGADVRIYKQRPFQAPEFPIPPIKIQRVPRIKLEKLKCDYVSTSNGEHRCSRDSLPSSFKKEQENNFDPACCPAKMILDNHDISVEMGVKSNYEIRIRRPCEIKKTDCCKENLEKPRSPGEVTGFGEPLSPGEIRFIENQEKYGEASRIKIEPSPLKENTLKSCQIHVNGSHSDHPEINCHKVVRDILLEQSLQSHKKLKLTKMRAKKKKKKKKKLKDVLNENLQRKREGLHSLAFKSYKPEIQNKLLIIKKKAKHKKHKSGKKSVSKKAITKKRKTVIKSPTVPEFQGKWYHRRQAVKELHSTLIRLLNELLPWEPKLMKAFQRNRSRLKKDYDDFRRQPDHDTFNRELWTTDEGEGDLGKDSPKGEISKSIDSTEPLDILEKDHFDSDDMKLSEIDFPMARSKLLKKELPSKDLPKTLLKTLKRQSKQTDYVDDSTKELSPRKKAKLSTNETTVENLESDVQIDCFSESKHTEPSFPESFASLDSVPVSTLQKGTKPIQALLAKNIGNKVTLTNQLPPSTGRNALAVEKPVLSPPEASPIKPALTCHTNTKGPLQMVYKMPCGQWLPIDLQNSSVKIQVQPMVDPKTGEKIMQQVLILPKNFVIQHKEGKAVAKEVPPLQQKGTEQHCSSFPQTTNINSSLASVFVNSPGTVSTQLPNTAFNKTITPLSNISSARPQPLSPVTSVSNLLTPSVKTSQSEAGKAKNAVSAATFSLPSASPTISSTGQPLSSTTTLNGSTNPGSSFNCFAQQTADSSEAKQELKTVCIRDSQSILVRTRGGNTGVVKVQTNPDQNSPNTVSSSSVFTFAPQLQAFLVPKSTTSSSAFSPVAGTTTTSSLSPFSQTPTSVSIPASFAPSMGKNLKLTLGHTTGSGDLGHVIDKTSHMPSSPLKSSICSSTLLPSTTSSSVSVISISAANFGQNNANIIHTPTKQQQVDYITKSYPVTRSEATAATNGDVISGTPVQKLMLVSAPSILSSGNGTAINMTPALTSTGVSAQKLVFINAPVPSGTSTPTLVAESLKQTLPPPLHKAYVKTPEQPQIVLIPSTVGTPIKINSSPAVSQIKDVKIGLNIGQAIVNTSGTVPAIPSINILQNVTPKGEDKSSKGYILPLSTSGNSVPVSSNFVSQNITPVNESVVSSARAVNVLSVTGANLSLGSFPVTSASASAGAQPPVLVSGNDTSSRIMPILSNRLCSSSLGNTVAISTVKTGHLASSVLISTTQPVVSPKCLTSALQIPVTVALPTPATTSPKIINTVPHSAAVPGATRSVSISKRQSRTSLQFHSPGISTTVPTNVNTNKPQTELSSLSTSPGKITNTSNFASLPNQQALVKTPSYSSAPGGTTIHTASAPSNVTSLVGSQFSEPCIQQKIVINTSTPLAPGTQIMINGTRFIVPPQGLGAGSHVLLISTNPKYGAPLVLNSGQGIQSTPIDNSAQKITLASNNSLSGQPLQHPLRSPTKFINSFGNASSIPTVHTSPQLINTTAKVPVPPPVPTVSLTSVIKSPATLLAKTSLVSAICPSNPPLPSSTSVFHLDPPVKKLLVSPEGAILNTINTPASKVSSLSPSLSQIVVSASRSPASVFPAFQSSGLEKPDRAAS

SEQ ID NO: 43612 - protein, 2103 aa, Homo sapiens
  Payload ID: 8966
  Gene Symbol: KIAA2026
  Gene Name: KIAA2026
  Uniprot ID: Q5HYC2
  ENSP ID: ENSP00000382815
MSVPGTPGAMEPAGEEERPPPAAEGEDDEEEVAAAAQTSGPAHGRSASSLEDADDQEEEMEAMVIGGGCCKEQELTYELQQGYRILGEFLQEKHRGLTAPFLQPLGGVATAEEEVAEGPRSGGRGGRAFPQQPGQGMCLLQMEEKFASGQYGGITEFVADFRLMLETCYRLHGVDHWISKQGQKLEMMLEQKLALLSRHLREKTTIAVTSRGYYGLEDEKGTACTSTRRRSTPRSLAGLTSGVFESIMVQVLRQEEQLRAKEEKRLREQERKEAEEASQKEIEEWERKLLAQAAPTCMETMWEIPAIGHFLCLAQQILNLPEIVFYELERCLLMPQCNAFLSKIMTSLLSPPHRRPTLHRRPTLPYRTWEAALRQKVQQWYTAVGQTENPDNCAEKLGLCPQFFKVLGEVNPLEEKPFHELPFYQKVWLLKGLCDFVYETQKEVQDAVLGQPIHECREVILGYDYLENAYVHFPQFCGADVRIYKQRPFQAPEFPIPPIKIQRVPRIKLEKLKCDYVSTSNGEHRCSRDSLPSSFKKEQENNFDPACCPAKMILDNHDISVEMGVKSNYEIRIRRPCEIKKTDCCKENLEKPRSPGEVTGFGEPLSPGEIRFIENQEKYGEASRIKIEPSPLKENTLKSCQIHVNGSHSDHPEINCHKVVRDILLEQSLQSHKKLKLTKMRAKKKKKKKKKLKDVLNENLQRKREGLHSLAFKSYKPEIQNKLLIIKKKAKHKKHKSGKKSVSKKAITKKRKTVIKSPTVPEFQLICTNLDELRELITKIENELKDLENSRKKSGKWYHRRQAVKELHSTLIRLLNELLPWEPKLMKAFQRNRSRLKKDYDDFRRQPDHDTFNRELWTTDEGEGDLGKDSPKGEISKSIDSTEPLDILEKDHFDSDDMKLSEIDFPMARSKLLKKELPSKDLPKTLLKTLKRQSKQTDYVDDSTKELSPRKKAKLSTNETTVENLESDVQIDCFSESKHTEPSFPESFASLDSVPVSTLQKGTKPIQALLAKNIGNKVTLTNQLPPSTGRNALAVEKPVLSPPEASPIKPALTCHTNTKGPLQMVYKMPCGQWLPIDLQNSSVKIQVQPMVDPKTGEKIMQQVLILPKNFVIQHKEGKAVAKEVPPLQQKGTEQHCSSFPQTTNINSSLASVFVNSPGTVSTQLPNTAFNKTITPLSNISSARPQPLSPVTSVSNLLTPSVKTSQSEAGKAKNAVSAATFSLPSASPTISSTGQPLSSTTTLNGSTNPGSSFNCFAQQTADSSEAKQELKTVCIRDSQSILVRTRGGNTGVVKVQTNPDQNSPNTVSSSSVFTFAPQLQAFLVPKSTTSSSAFSPVAGTTTTSSLSPFSQTPTSVSIPASFAPSMGKNLKLTLGHTTGSGDLGHVIDKTSHMPSSPLKSSICSSTLLPSTTSSSVSVISISAANFGQNNANIIHTPTKQQQVDYITKSYPVTRSEATAATNGDVISGTPVQKLMLVSAPSILSSGNGTAINMTPALTSTGVSAQKLVFINAPVPSGTSTPTLVAESLKQTLPPPLHKAYVKTPEQPQIVLIPSTVGTPIKINSSPAVSQIKDVKIGLNIGQAIVNTSGTVPAIPSINILQNVTPKGEDKSSKGYILPLSTSGNSVPVSSNFVSQNITPVNESVVSSARAVNVLSVTGANLSLGSFPVTSASASAGAQPPVLVSGNDTSSRIMPILSNRLCSSSLGNTVAISTVKTGHLASSVLISTTQPVVSPKCLTSALQIPVTVALPTPATTSPKIINTVPHSAAVPGATRSVSISKRQSRTSLQFHSPGISTTVPTNVNTNKPQTELSSLSTSPGKITNTSNFASLPNQQALVKTPSYSSAPGGTTIHTASAPSNVTSLVGSQFSEPCIQQKIVINTSTPLAPGTQIMINGTRFIVPPQGLGAGSHVLLISTNPKYGAPLVLNSGQGIQSTPIDNSAQKITLASNNSLSGQPLQHPLRSPTKFINSFGNASSIPTVHTSPQLINTTAKVPVPPPVPTVSLTSVIKSPATLLAKTSLVSAICPSNPPLPSSTSVFHLDPPVKKLLVSPEGAILNTINTPASKVSSLSPSLSQIVVSASRSPASVFPAFQSSGLEKPDRAAS

SEQ ID NO: 43613 - protein, 207 aa, Homo sapiens
  Payload ID: 8966
  Gene Symbol: KIAA2026
  Gene Name: KIAA2026
  ENSP ID: ENSP00000438370
  MOD_RES (1)..(1): Any amino acid
XQNITPVNESVVSSARAVNVLSVTGANLSLGSFPVTSASASAGAQPPVLVSGNDTSSRIMPILSNRLCSSSLGNTVAISTVKTGHLASSVLISTTQPVVSPKCLTSALQIPVTVALPTPATTSPKIINTVPHSAAVPGATRSVSISKRQSRTSLQFHSPGISTTVPTNVNTNKPQTELSSLSTSPVSFLLSVPSCHPTFLSIFSHGK

SEQ ID NO: 43614 - protein, 131 aa, Homo sapiens
  Payload ID: 8966
  Gene Symbol: KIAA2026
  Gene Name: KIAA2026
  ENSP ID: ENSP00000444949
  MOD_RES (1)..(1): Any amino acid
XEIQNKLLIIKKKAKHKKHKSGKKSVSKKAITKKRKTVIKSPTVPEFQLICTNLDELRELITKIENELKDLENSRKKSVSNVPSISRLPTPSPCHTPASVMLVLSYPSQITVAECSCSLVVRENGIIGGKL

SEQ ID NO: 43615 - protein, 617 aa, Homo sapiens
  Payload ID: 8966
  Gene Symbol: KIAA2026
  Gene Name: KIAA2026
  ENSP ID: ENSP00000444993
MSVPGTPGAMEPAGEEERPPPAAEGEDDEEEVAAAAQTSGPAHGRSASSLEDADDQEEEMEAMVIGGGCCKEQELTYELQQGYRILGEFLQEKHRGLTAPFLQPLGGVATAEEEVAEGPRSGGRGGRAFPQQPGQGMCLLQMEEKFASGQYGGITEFVADFRLMLETCYRLHGVDHWISKQGQKLEMMLEQKLALLSRLREQERKEAEEASQKEIEEWERKLLAQAAPTCMETMWEIPAIGHFLCLAQQILNLPEIVFYELERCLLMPQCNAFLSKIMTSLLSPPHRRPTLHRRPTLPYRTWEAALRQKVQQWYTAVGQTENPDNCAEKLGLCPQFFKVLGEVNPLEEKPFHELPFYQKVWLLKGLCDFVYETQKEVQDAVLGQPIHECREVILGYDYLENAYVHFPQFCGADVRIYKQRPFQAPEFPIPPIKIQRVPRIKLEKLKCDYVSTSNGEHRCSRDSLPSSFKKEQENNFDPACCPAKMILDNHDISVEMGVKSNYEIRIRRPCEIKKTDCCKENLEKPRSPGEVTGFGEPLSPGEIRFIENQEKYGEASRIKIEPSPLKENTLKSCQIHVNGSHSDHPEINCHKVVRDILLEQSLQSHKKLKLTKMRAKK

SEQ ID NO: 43616 - protein, 84 aa, Homo sapiens
  Payload ID: 8967
  Gene Symbol: KAAG1
  Gene Name: kidney associated antigen 1
  Uniprot ID: Q9UBP8
  ENSP ID: ENSP00000274766
MDDDAAPRVEGVPVAVHKHALHDGLRQVAGPGAAAAHLPRWPPPQLAASRREAPPLSQRPHRTQGAGSPPETNEKLTNPQVKEK

SEQ ID NO: 43617 - protein, 1568 aa, Homo sapiens
  Payload ID: 8968
  Gene Symbol: KCP
  Gene Name: kielin/chordin-like protein
  ENSP ID: ENSP00000477644
MAGVGAAALSLLLHLGALALAAGAEGGAVPREPPGQQTTAHSSVLAGNSQEQWHPLREWLGRLEAAVMELREQNKDLQTRVRQLESCECHPASPQCWGLGRAWPEGARWEPDACTACVCQDGAAHCGPQAHLPHCRGCSQNGQTYGNGETFSPDACTTCRCLTGAVQCQGPSCSELNCLESCTPPGECCPICRPGCDYEGQLYEEGVTFLSSSNPCLQCTCLRSRVRCMALKCPPSPCPEPVLRPGHCCPTCQGCTEGGSHWEHGQEWTTPGDPCRICRCLEGHIQCRQRECASLCPYPARPLPGTCCPVCDGCFLNGREHRSGEPVGSGDPCSHCRCANGSVQCEPLPCPPVPCRHPGKIPGQCCPVCDGCEYQGHQYQSQETFRLQERGLCVRCSCQAGEVSCEEQECPVTPCALPASGRQLCPACELDGEEFAEGVQWEPDGRPCTACVCQDGVPKCGAVLCPPAPCQHPTQPPGACCPSCDSCTYHSQVYANGQNFTDADSPCHACHCQDGTVTCSLVDCPPTTCARPQSGPGQCCPRCPDCILEEEVFVDGESFSHPRDPCQECRCQEGHAHCQPRPCPRAPCAHPLPGTCCPNDCSGCAFGGKEYPSGADFPHPSDPCRLCRCLSGNVQCLARRCVPLPCPEPVLLPGECCPQCPAAPAPAGCPRPGAAHARHQEYFSPPGDPCRRCLCLDGSVSCQRLPCPPAPCAHPRQGPCCPSCDGCLYQGKEFASGERFPSPTAACHLCLCWEGSVSCEPKACAPALCPFPARGDCCPDCDGCEYLGESYLSNQEFPDPREPCNLCTCLGGFVTCGRRPCEPPGCSHPLIPSGHCCPTCQGCRYHGVTTASGETLPDPLDPTCSLCTCQEGSMRCQKKPCPPALCPHPSPGPCFCPVCHSCLSQGREHQDGEEFEGPAGSCEWCRCQAGQVSCVRLQCPPLPCKLQVTERGSCCPRCRGCLAHGEEHPEGSRWVPPDSACSSCVCHEGVVTCARIQCISSCAQPRQGPHDCCPQCSDCEHEGRKYEPGESFQPGADPCEVCICEPQPEGPPSLRCHRRQCPSLVGCPPSQLLPPGPQHCCPTCAEALSNCSEGLLGSELAPPDPCYTCQCQDLTWLCIHQACPELSCPLSERHTPPGSCCPVCRAPTQSCVHQGREVASGERWTVDTCTSCSCMAGTVRCQSQRCSPLSCGPDKAPALSPGSCCPRCLPRPASCMAFGDPHYRTFDGRLLHFQGSCSYVLAKDCHSGDFSVHVTNDDRGRSGVAWTQEVAVLLGDMAVRLLQDGAVTVDGHPVALPFLQEPLLYVELRGHTVILHAQPGLQVLWDGQSQVEVSVPGSYQGRTCGLCGNFNGFAQDDLQGPEGLLLPSEAAFGNSWQVSEGLWPGRPCSAGREVDPCRAAGYRARREANARCGVLKSSPFSRCHAVVPPEPFFAACVYDLCACGPGSSADACLCDALEAYASHCRQAGVTPTWRGPTLCVVGCPLERGFVFDECGPPCPRTCFNQHIPLGELAAHCVRPCVPGCQCPAGLVEHEAHCIPPEACPQVLLTGDQPLGARPSPSREPQETP

SEQ ID NO: 43618 - protein, 1628 aa, Homo sapiens
  Payload ID: 8968
  Gene Symbol: KCP
  Gene Name: kielin/chordin-like protein
  ENSP ID: ENSP00000479679
MAGVGAAALSLLLHLGALALAAGAEGGAVPREPPGQQTTAHSSVLAGNSQEQWHPLREWLGRLEAAVMELREQNKDLQTRVRQLESCECHPASPQCWGLGRAWPEGARWEPDACTACVCQDGAAHCGPQAHLPHCRGCSQNGQTYGNGETFSPDACTTCRCLEGTITCNQKPCPRGPCPEPGACCPHCKPGCDYEGQLYEEGVTFLSSSNPCLQCTCLRSRVRCMALKCPPSPCPEPVLRPGHCCPTCQGCTEGGSHWEHGQEWTTPGDPCRICRCLEGHIQCRQRECASLCPYPARPLPGTCCPVCDGCFLNGREHRSGEPVGSGDPCSHCRCANGSVQCEPLPCPPVPCRHPGKIPGQCCPVCDGCEYQGHQYQSQETFRLQERGLCVRCSCQAGEVSCEEQECPVTPCALPASGRQLCPACELDGEEFAEGVQWEPDGRPCTACVCQDGVPKCGAVLCPPAPCQHPTQPPGACCPSCDSCTYHSQVYANGQNFTDADSPCHACHCQDGTVTCSLVDCPPTTCARPQSGPGQCCPRCPDCILEEEVFVDGESFSHPRDPCQECRCQEGHAHCQPRPCPRAPCAHPLPGTCCPNDCSGCAFGGKEYPSGADFPHPSDPCRLCRCLSGNVQCLARRCVPLPCPEPVLLPGECCPQCPAAPAPAGCPRPGAAHARHQEYFSPPGDPCRRCLCLDGSVSCQRLPCPPAPCAHPRQGPCCPSCDGCLYQGKEFASGERFPSPTAACHLCLCWEGSVSCEPKACAPALCPFPARGDCCPDCDGCEYLGESYLSNQEFPDPREPCNLCTCLGGFVTCGRRPCEPPGCSHPLIPSGHCCPTCQGCRYHGVTTASGETLPDPLDPTCSLCTCQEGSMRCQKKPCPPALCPHPSPGPCFCPVCHSCLSQGREHQDGEEFEGPAGSCEWCRCQAGQVSCVRLQCPPLPCKLQVTERGSCCPRCRGCLAHGEEHPEGSRWVPPDSACSSCVCHEGVVTCARIQCISSCAQPRQGPHDCCPQCSDCEHEGRKYEPGESFQPGADPCEVCICEPQPEGPPSLRCHRRQCPSLVGCPPSQLLPPGPQHCCPTCAEALSNCSEGLLGSELAPPDPCYTCQCQDLTWLCIHQACPELSCPLSERHTPPGSCCPVCRECVVEAEGRRVADGESWRDPSNACIACTCHRGHVECHLEECQALSCPHGWAKVPQADSCCERCQAPTQSCVHQGREVASGERWTVDTCTSCSCMAGTVRCQSQRCSPLSCGPDKAPALSPGSCCPRCLPRPASCMAFGDPHYRTFDGRLLHFQGSCSYVLAKDCHSGDFSVHVTNDDRGRSGVAWTQEVAVLLGDMAVRLLQDGAVTVDGHPVALPFLQEPLLYVELRGHTVILHAQPGLQVLWDGQSQVEVSVPGSYQGRTCGLCGNFNGFAQDDLQGPEGLLLPSEAAFGNSWQVSEGLWPGRPCSAGREVDPCRAAGYRARREANARCGVLKSSPFSRCHAVVPPEPFFAACVYDLCACGPGSSADACLCDALEAYASHCRQAGVTPTWRGPTLCVVGCPLERGFVFDECGPPCPRTCFNQHIPLGELAAHCVRPCVPGCQCPAGLVEHEAHCIPPEACPQVLLTGDQPLGARPSPSREPQETP

SEQ ID NO: 43619 - protein, 1275 aa, Homo sapiens
  Payload ID: 8968
  Gene Symbol: KCP
  Gene Name: kielin/chordin-like protein
  ENSP ID: ENSP00000480867
MAGVGAAALSLLLHLGALALAAGAEGGAVPREPPGQQTTAHSSVLAGNSQEQWHPLREWLGRLEAAVMELREQNKDLQTRVRQLESCECHPASPQCWGLGRAWPEGARWEPDACTACVCQDGAAHCGPQAHLPHCRGCSQNGQTYGNGETFSPDACTTCRCLTGAVQCQGPSCSELNCLESCTPPGECCPICRPGCDYEGQLYEEGVTFLSSSNPCLQCTCLRSRVRCMALKCPPSPCPEPVLRPGHCCPTCQGCTEGGSHWEHGQEWTTPGDPCRICRCLEGHIQCRQRECASLCPYPARPLPGTCCPVCDGCFLNGREHRSGEPVGSGDPCSHCRCANGSVQCEPLPCPPVPCRHPGKIPGQCCPVCDGCEYQGHQYQSQETFRLQERGLCVRCSCQAGEVSCEEQECPVTPCALPASGRQLCPACELDGEEFAEGVQWEPDGRPCTACVCQDGVPKCGAVLCPPAPCQHPTQPPGACCPSCDSCTYHSQVYANGQNFTDADSPCHACHCQDGTVTCSLVDCPPTTCARPQSGPGQCCPRCPDCILEEEVFVDGESFSHPRDPCQECRCQEGHAHCQPRPCPRAPCAHPLPGTCCPNDCSGCAFGGKEYPSGADFPHPSDPCRLCRCLSGNVQCLARRCVPLPCPEPVLLPGECCPQCPAAPAPAGCPRPGAAHARHQEYFSPPGDPCRRCLCLDGSVSCQRLPCPPAPCAHPRQGPCCPSCDGCLYQGKEFASGERFPSPTAACHLCLCWEGSVSCEPKACAPALCPFPARGDCCPDCDGCEYLGESYLSNQEFPDPREPCNLCTCLGGFVTCGRRPCEPPGCSHPLIPSGHCCPTCQGCRYHGVTTASGETLPDPLDPTCSLCTCQEGSMRCQKKPCPPALCPHPSPGPCFCPVCHSCLSQGREHQDGEEFEGPAGSCEWCRCQAGQVSCVRLQCPPLPCKLQVTERGSCCPRCRGCLAHGEEHPEGSRWVPPDSACSSCVCHEGVVTCARIQCISSCAQPRQGPHDCCPQCSDCEHEGRKYEPGESFQPGADPCEVCICEPQPEGPPSLRCHRRQCPSLVGCPPSQLLPPGPQHCCPTCAEALSNCSEGLLGSELAPPDPCYTCQCQDLTWLCIHQACPELSCPLSERHTPPGSCCPVCRAPTQSCVHQGREVASGERWTVDTCTSCSCMAGTVRCQSQRCSPLSCGPDKAPALSPGSCCPRCLPRPASCMAFGDPHYRTFDGRLLHFQGSCSYVLAKDCHSGDFRWMGTRWPCPSCRSRCCMWSCEDTL

SEQ ID NO: 43620 - protein, 1504 aa, Homo sapiens
  Payload ID: 8968
  Gene Symbol: KCP
  Gene Name: kielin/chordin-like protein
  ENSP ID: ENSP00000484293
MAGVGAAALSLLLHLGALALAAGAEGGAVPREPPGQQTTAHSSVLAGNSQEQWHPLREWLGRLEAAVMELREQNKDLQTRVRQLESCECHPASPQCWGLGRAWPEGARWEPDACTACVCQDGAAHCGPQAHLPHCRGCSQNGQTYGNGETFSPDACTTCRCLTGAVQCQGPSCSELNCLESCTPPGECCPICRCTEGGSHWEHGQEWTTPGDPCRICRCLEGHIQCRQRECASLCPYPARPLPGTCCPVCDGCFLNGREHRSGEPVGSGDPCSHCRCANGSVQCEPLPCPPVPCRHPGKIPGQCCPVCDGCEYQGHQYQSQETFRLQERGLCVRCSCQAGEVSCEEQECPVTPCALPASGRQLCPACELDGEEFAEGVQWEPDGRPCTACVCQDGVPKCGAVLCPPAPCQHPTQPPGACCPSCDSCTYHSQVYANGQNFTDADSPCHACHCQDGTVTCSLVDCPPTTCARPQSGPGQCCPRCPDCILEEEVFVDGESFSHPRDPCQECRCQEGHAHCQPRPCPRAPCAHPLPGTCCPNDCSGCAFGGKEYPSGADFPHPSDPCRLCRCLSGNVQCLARRCVPLPCPEPVLLPGECCPQCPAPAGCPRPGAAHARHQEYFSPPGDPCRRCLCLDGSVSCQRLPCPPAPCAHPRQGPCCPSCDGCLYQGKEFASGERFPSPTAACHLCLCWEGSVSCEPKACAPALCPFPARGDCCPDCDGCEYLGESYLSNQEFPDPREPCNLCTCLGGFVTCGRRPCEPPGCSHPLIPSGHCCPTCQGCRYHGVTTASGETLPDPLDPTCSLCTCQEGSMRCQKKPCPPALCPHPSPGPCFCPVCHSCLSQGREHQDGEEFEGPAGSCEWCRCQAGQVSCVRLQCPPLPCKLQVTERGSCCPRCRGCLAHGEEHPEGSRWVPPDSACSSCVCHEGVVTCARIQCISSCAQPRQGPHDCCPQCSDCEHEGRKYEPGESFQPGADPCEVCICEPQPEGPPSLRCHRRQCPSLVGCPPSQLLPPGPQHCCPTCAEALSNCSEGLLGSELAPPDPCYTCQCQDLTWLCIHQACPELSCPLSERHTPPGSCCPVCRAPTQSCVHQGREVASGERWTVDTCTSCSCMAGTVRCQSQRCSPLSCGPDKAPALSPGSCCPRCLPRPASCMAFGDPHYRTFDGRLLHFQGSCSYVLAKDCHSGDFSVHVTNDDRGRSGVAWTQEVAVLLGDMAVRLLQDGAVTVDGHPVALPFLQEPLLYVELRGHTVILHAQPGLQVLWDGQSQVEVSVPGSYQGRTCGLCGNFNGFAQDDLQGPEGLLLPSEAAFGNSWQVSEGLWPGRPCSAGREVDPCRAAGYRARREANARCGVLKSSPFSRCHAVVPPEPFFAACVYDLCACGPGSSADACLCDALEAYASHCRQAGVTPTWRGPTLCVVGCPLERGFVFDECGPPCPRTCFNQHIPLGELAAHCVRPCVPGCQCPAGLVEHEAHCIPPEACPQVLLTGDQPLGARPSPSREPQETP

SEQ ID NO: 43621 - protein, 621 aa, Homo sapiens
  Payload ID: 8969
  Gene Symbol: KIF1BP
  Gene Name: KIF1 binding protein
  Uniprot ID: Q96EK5
  ENSP ID: ENSP00000354848
MANVPWAEVCEKFQAALALSRVELHKNPEKEPYKSKYSARALLEEVKALLGPAPEDEDERPEAEDGPGAGDHALGLPAEVVEPEGPVAQRAVRLAVIEFHLGVNHIDTEELSAGEEHLVKCLRLLRRYRLSHDCISLCIQAQNNLGILWSEREEIETAQAYLESSEALYNQYMKEVGSPPLDPTERFLPEEEKLTEQERSKRFEKVYTHNLYYLAQVYQHLEMFEKAAHYCHSTLKRQLEHNAYHPIEWAINAATLSQFYINKLCFMEARHCLSAANVIFGQTGKISATEDTPEAEGEVPELYHQRKGEIARCWIKYCLTLMQNAQLSMQDNIGELDLDKQSELRALRKKELDEEESIRKKAVQFGTGELCDAISAVEEKVSYLRPLDFEEARELFLLGQHYVFEAKEFFQIDGYVTDHIEVVQDHSALFKVLAFFETDMERRCKMHKRRIAMLEPLTVDLNPQYYLLVNRQIQFEIAHAYYDMMDLKVAIADRLRDPDSHIVKKINNLNKSALKYYQLFLDSLRDPNKVFPEHIGEDVLRPAMLAKFRVARLYGKIITADPKKELENLATSLEHYKFIVDYCEKHPEAAQEIEVELELSKEMVSLLPTKMERFRTKMALT

SEQ ID NO: 43622 - protein, 297 aa, Homo sapiens
  Payload ID: 8969
  Gene Symbol: KIF1BP
  Gene Name: KIF1 binding protein
  ENSP ID: ENSP00000486692
MANVPWAEVCEKFQAALALSRVELHKNPEKEPYKSKYSARALLEEVKALLGPAPEDEDERPEAEDGPGAGDHALGLPAEVVEPEGPVAQRAVRLAVIEFHLGVNHIDTEELSAGEEHLVKCLRLLRRYRLSHDCISLCIQAQNNLGILWSEREEIETAQAYLESSEALYNQYMKEVGSPPLDPTERFLPEEEKLTEQERSKRFEKVYTHNLYYLAQVYQHLEMFEKAAHYCHSTLKRQLEHNAYHPIEWAINAATLSQFYINKLCFMEARHCLSAANVIFGQTGKISATEDRQHRRA

SEQ ID NO: 43623 - protein, 427 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000326868
MSLMVVSMACVGLFLVQRAGPHMGGQDKPFLSAWPSAVVPRGGHVTLRCHYRHRFNNFMLYKEDRIHIPIFHGRIFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 43624 - protein, 349 aa, Homo sapiens
  Payload ID: 8970
  Gene Symbol: KIR3DL1
  Gene Name: killer cell immunoglobulin-like receptor, three domains, long cytoplasmic tail, 1
  Uniprot ID: P43629
  ENSP ID: ENSP00000350901
MSLMVVSMACVGLFLVQRAGPHMGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 43625 - protein, 444 aa, Homo sapiens
  Payload ID: 8970
  Gene Symbol: KIR3DL1
  Gene Name: killer cell immunoglobulin-like receptor, three domains, long cytoplasmic tail, 1
  Uniprot ID: P43629
  ENSP ID: ENSP00000375608
MSLMVVSMACVGLFLVQRAGPHMGGQDKPFLSAWPSAVVPRGGHVTLRCHYRHRFNNFMLYKEDRIHIPIFHGRIFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 43626 - protein, 455 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000384528
MSLMVVSMACVGLFLVQRAGPHMGGQDKPFLSAWPSAVVPRGGHVTLRCHYRHRFNNFMLYKEDRIHIPIFHGRIFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 43627 - protein, 427 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000477743
MLLMVVSMACVGFFLVQRAGPHVGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSRERGAHERRLPAVRKVNRTFQADFPLGPATHGGTYRCFGSFRHSPYEWSDPSDPLLVSVTGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 43628 - protein, 455 aa, Homo sapiens; identical to SEQ ID NO: 43626
  Payload ID: 8970
  Gene Symbol: KIR3DL1
  Gene Name: killer cell immunoglobulin-like receptor, three domains, long cytoplasmic tail, 1
  ENSP ID: ENSP00000477777

SEQ ID NO: 43629 - protein, 444 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000477840
MSLMVVSMACVGFFLVQRAGPHVGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFKADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 43630 - protein, 455 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000477900
MSLMVVSMACVGFFLLQGAWPHEGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFKADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCPRAPQSGLEGIF

SEQ ID NO: 43631 - protein, 444 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000478023
MLLMVVSMACVGFFLVQRAGPHVGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLHVLIGTSVVIILFILLLFFLLHLWCSNKKNAAVMDQEPAGNRTANSEDSDEQDPQEVTYAQLDHCVFTQRKITRPSQRPKTPPTDTILYTELPNAKPRSKVVSCP

SEQ ID NO: 43632 - protein, 444 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000478110
MLLMVVSMACVGFFLVQRAGPHVGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSSLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPQEVTYAQLDHCVFTQRKITRPSQRPKTPPTDTILYTELPNAKPRSKVVSCP

SEQ ID NO: 43633 - protein, 444 aa, Homo sapiens [sequence omitted]

SEQ ID NO: 43634 - protein, 427 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000478424
MLLMVVSMACVGFFLVQRAGPHMGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 43635 - protein, 427 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000478631
MLLMVVSMACVGFFLVQRAGPHVGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 43636 - protein, 444 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000478759
MLLMVVSMACVGFFLVQRAGPHVGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPQEVTYAQLDHCVFTQRKITRPSQRPKTPPTDTILYTELPNAKPRSKVVSCP

SEQ ID NO: 43637 - protein, 455 aa, Homo sapiens; identical to SEQ ID NO: 43626
  Payload ID: 8970
  Gene Symbol: KIR3DL1
  Gene Name: killer cell immunoglobulin-like receptor, three domains, long cytoplasmic tail, 1
  ENSP ID: ENSP00000478761

SEQ ID NO: 43638 - protein, 444 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000478844
MSLMVVSMACVGFFLVQRAGPHVGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 43639 - protein, 444 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000478871
MSLMVVSMACVGLFLVQRAGPHMGGQDKPFLSAWPSAVVPRGGHVTLRCHYRHRFNNFMLYKEDRIHIPIFHGRIFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTSYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYELSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 43640 - protein, 444 aa, Homo sapiens; identical to SEQ ID NO: 43639
  Payload ID: 8970
  Gene Symbol: KIR3DL1
  Gene Name: killer cell immunoglobulin-like receptor, three domains, long cytoplasmic tail, 1
  ENSP ID: ENSP00000478978

SEQ ID NO: 43641 - protein, 444 aa, Homo sapiens; identical to SEQ ID NO: 43625
  Payload ID: 8970
  Gene Symbol: KIR3DL1
  Gene Name: killer cell immunoglobulin-like receptor, three domains, long cytoplasmic tail, 1
  Uniprot ID: P43629
  ENSP ID: ENSP00000479009

SEQ ID NO: 43642 - protein, 444 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000479177
MLLMVVSMACVGFFLVQRAGPHVGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 43643 - protein, 444 aa, Homo sapiens; identical to SEQ ID NO: 43638
  Payload ID: 8970
  Gene Symbol: KIR3DL1
  Gene Name: killer cell immunoglobulin-like receptor, three domains, long cytoplasmic tail, 1
  ENSP ID: ENSP00000479259

SEQ ID NO: 43644 - protein, 427 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000479469
MLLMVVSMACVGFFLVQRAGPHVGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSSLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPRHLHILIGTSVVIILFILLLFFLLHLWCSNKKNAAVMDQEPAGNRTANSEDSDEQDPQEVTYAQLDHCVFTQRKITRPSQRPKTPPTDTILYTELPNAKPRSKVVSCP

SEQ ID NO: 43645 - protein, 455 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000479776
MSLMVVSMACVGFFLVQRAGPHVGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 43646 - protein, 444 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000480064
MSLMVVSMACVGFFLVQRAGPHMGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 43647 - protein, 455 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000480397
MSLMVVSMACVGLFLVQRAGPHMGGQDKPFLSAWPSAVVPRGGHVTLRCHYRHRFNNFMLYKEDRIHIPIFHGRIFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTSYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYELSDPSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 43648 - protein, 444 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000480456
MLLMVVSMACVGFFLVQRAGPHVGGQDKPFLSAWPSAVVPRGGHVTLRCHYHHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 43649 - protein, 427 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000480639
MLLMVVSMACVGFFLVQRAGPHVGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPRHLHVLIGTSVVIILFILLLFFLLHLWCSNKKNAAVMDQEPAGNRTANSEDSDEQDPQEVTYAQLDHCVFTQRKITRPSQRPKTPPTDTILYTELPNAKPRSKVVSCP

SEQ ID NO: 43650 - protein, 455 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000480651
MSLMVVSMACVGFFLLQGAWPHEGGQDKPFLSAWPSAVVPRGGHVTLRCHYHHRFNNFMLYKEDGIHIPIFHGRIFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTSYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYELSDPSDPLLVSVTGNPSSSWPSPTEPSSKSGNPRHLHVLIGTSVVIILFILLLFFLLHLWYSNKKNAAVMDQEPAGNRTANSEDSDEQDPQEVTYAQLDHCVFTQRKITRPSQRPKTPPTDTILYTELPNAKPRSKVVSCPRAPQSGLEGIF

SEQ ID NO: 43651 - protein, 455 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000480747
MSLMVVSMACVGLFLVQRAGPHMGGQDKPFLSAWPSAVVPRGGHVTLRCHYRHRFNNFMLYKEDRIHIPIFHGRIFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTSYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYELSDPSDPLLVSVTGNPSSSWPSPTEPSSKSGICRHLHVLIGTSVVIFLFILLLFFLLYRWCSNKKNAAVMDQEPAGDRTVNRQDSDEQDPQEVMYAQLDHCVFIQRKISRPSQRPKTPLTDTSVYTELPNAEPRSKVVSCPRAPQSGLEGVF

SEQ ID NO: 43652 - protein, 444 aa, Homo sapiens; identical to SEQ ID NO: 43642
  Payload ID: 8970
  Gene Symbol: KIR3DL1
  Gene Name: killer cell immunoglobulin-like receptor, three domains, long cytoplasmic tail, 1
  ENSP ID: ENSP00000480934

SEQ ID NO: 43653 - protein, 427 aa, Homo sapiens; identical to SEQ ID NO: 43635
  Payload ID: 8970
  Gene Symbol: KIR3DL1
  Gene Name: killer cell immunoglobulin-like receptor, three domains, long cytoplasmic tail, 1
  ENSP ID: ENSP00000481188

SEQ ID NO: 43654 - protein, 455 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000481222
MSLMVVSMACVGLFLVQRAGPHMGGQDKPFLSAWPSAVVPRGGHVTLRCHYHHRFNNFMLYKEDGIHIPIFHGRIFQESFNMSPVTTAHAGNYTCRGSHPHSPTGWLAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTSYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYELSDPSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 43655 - protein, 427 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000481266
MLLMVVSMACVGFFLVQRAGPHVGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPRHLHILIGTSVVIILFILLLFFLLHLWCSNKKNAAVMDQEPAGNRTANSEDSDEQDPQEVTYAQLDHCVFTQRKITRPSQRPKTPPTDTILYTELPNAKPRSKVVSCP

SEQ ID NO: 43656 - protein, 444 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000481282
MLLMVVSMACVGFFLVQRAGPHVGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFKADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 43657 - protein, 444 aa, Homo sapiens; identical to SEQ ID NO: 43638
  Payload ID: 8970
  Gene Symbol: KIR3DL1
  Gene Name: killer cell immunoglobulin-like receptor, three domains, long cytoplasmic tail, 1
  ENSP ID: ENSP00000481501

SEQ ID NO: 43658 - protein, 444 aa, Homo sapiens; identical to SEQ ID NO: 43642
  Payload ID: 8970
  Gene Symbol: KIR3DL1
  Gene Name: killer cell immunoglobulin-like receptor, three domains, long cytoplasmic tail, 1
  ENSP ID: ENSP00000481576

SEQ ID NO: 43659 - protein, 427 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000481631
MLLMVVSMACVGFFLVQRAGPHVGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFKADFPLGPATHGGTYRCFGSFRHSPYEWSDPSDPLLVSVTGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 43660 - protein, 444 aa, Homo sapiens; identical to SEQ ID NO: 43656
  Payload ID: 8970
  Gene Symbol: KIR3DL1
  Gene Name: killer cell immunoglobulin-like receptor, three domains, long cytoplasmic tail, 1
  ENSP ID: ENSP00000481653

SEQ ID NO: 43661 - protein, 444 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000481716
MSLMVVSMACVGLFLVQRAGPHMGGQDKPFLSAWPSAVVPRGGHVTLRCHYHHRFNNFMLYKEDGIHIPIFHGRIFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTSYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYELSDPSDPLLVSVTGNPSSSWPSPTEPSSKSGNPRHLHVLIGTSVVIILFILLLFFLLHLWYSNKKNAAVMDQEPAGNRTANSEDSDEQDPQEVTYAQLDHCVFTQRKITRPSQRPKTPPTDTILYTELPNAKPRSKVVSCP

SEQ ID NO: 43662 - protein, 444 aa, Homo sapiens; identical to SEQ ID NO: 43638
  Payload ID: 8970
  Gene Symbol: KIR3DL1
  Gene Name: killer cell immunoglobulin-like receptor, three domains, long cytoplasmic tail, 1
  ENSP ID: ENSP00000481756

SEQ ID NO: 43663 - protein, 444 aa, Homo sapiens; identical to SEQ ID NO: 43625
  Payload ID: 8970
  Gene Symbol: KIR3DL1
  Gene Name: killer cell immunoglobulin-like receptor, three domains, long cytoplasmic tail, 1
  Uniprot ID: P43629
  ENSP ID: ENSP00000481802

SEQ ID NO: 43664 - protein, 427 aa, Homo sapiens; identical to SEQ ID NO: 43649
  Payload ID: 8970
  Gene Symbol: KIR3DL1
  Gene Name: killer cell immunoglobulin-like receptor, three domains, long cytoplasmic tail, 1
  ENSP ID: ENSP00000481960

SEQ ID NO: 43665 - protein, 427 aa, Homo sapiens; identical to SEQ ID NO: 43659
  Payload ID: 8970
  Gene Symbol: KIR3DL1
  Gene Name: killer cell immunoglobulin-like receptor, three domains, long cytoplasmic tail, 1
  ENSP ID: ENSP00000482105

SEQ ID NO: 43666 - protein, 444 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000482160
MSLMVVSMACVGLFLVQRAGPHMGGQDKPFLSAWPSAVVPRGGHVTLRCHYHHRFNNFMLYKEDGIHIPIFHGRIFQESFNMSPVTTAHAGNYTCRGSHPHSPTGWLAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTSYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYELSDPSDPLLVSVTGNPSSSWPSPTEPSSKSGNPRHLHVLIGTSVVIILFILLLFFLLHLWYSNKKNAAVMDQEPAGNRTANSEDSDEQDPQEVTYAQLDHCVFTQRKITRPSQRPKTPPTDTILYTELPNAKPRSKVVSCP

SEQ ID NO: 43667 - protein, 455 aa, Homo sapiens; identical to SEQ ID NO: 43626
  Payload ID: 8970
  Gene Symbol: KIR3DL1
  Gene Name: killer cell immunoglobulin-like receptor, three domains, long cytoplasmic tail, 1
  ENSP ID: ENSP00000482675

SEQ ID NO: 43668 - protein, 444 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000482930
MSLMVVSMACVGFFLVQRAGPHVGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLHVLIGTSVVIILFILLLFFLLHLWCSNKKNAAVMDQEPAGNRTANSEDSDEQDPQEVTYAQLDHCVFTQRKITRPSQRPKTPPTDTILYTELPNAKPRSKVVSCP

SEQ ID NO: 43669 - protein, 444 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000483147
MSLMVVSMACVGFFLVQRAGPHVGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSSLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPQEVTYAQLDHCVFTQRKITRPSQRPKTPPTDTILYTELPNAKPRSKVVSCP

SEQ ID NO: 43670 - protein, 444 aa, Homo sapiens; identical to SEQ ID NO: 43642
  Payload ID: 8970
  Gene Symbol: KIR3DL1
  Gene Name: killer cell immunoglobulin-like receptor, three domains, long cytoplasmic tail, 1
  ENSP ID: ENSP00000483156

SEQ ID NO: 43671 - protein, 349 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000483200
MLLMVVSMACVGFFLVQRAGPHVGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPQEVTYAQLDHCVFTQRKITRPSQRPKTPPTDTILYTELPNAKPRSKVVSCP

SEQ ID NO: 43672 - protein, 455 aa, Homo sapiens; identical to SEQ ID NO: 43626
  Payload ID: 8970
  Gene Symbol: KIR3DL1
  Gene Name: killer cell immunoglobulin-like receptor, three domains, long cytoplasmic tail, 1
  ENSP ID: ENSP00000483209

SEQ ID NO: 43673 - protein, 427 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000483355
MSLMVVSMACVGLFLVQRAGPHMGGQDKPFLSAWPSAVVPRGGHVTLRCHYRHRFNNFMLYKEDRIHIPIFHGRIFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTSYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYELSDPSDPLLVSVTGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 43674 - protein, 427 aa, Homo sapiens; identical to SEQ ID NO: 43673
  Payload ID: 8970
  Gene Symbol: KIR3DL1
  Gene Name: killer cell immunoglobulin-like receptor, three domains, long cytoplasmic tail, 1
  ENSP ID: ENSP00000483410

SEQ ID NO: 43675 - protein, 349 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000483664
MLLMVVSMACVGFFLVQRAGPHVGNHRKPSLLAHPGPLVKSGERVILQCWSDIMFEHFFLHKEGISKDPSSLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPQEVTYAQLDHCVFTQRKITRPSQRPKTPPTDTILYTELPNAKPRSKVVSCP

SEQ ID NO: 43676 - protein, 444 aa, Homo sapiens; identical to SEQ ID NO: 43631
  Payload ID: 8970
  Gene Symbol: KIR3DL1
  Gene Name: killer cell immunoglobulin-like receptor, three domains, long cytoplasmic tail, 1
  ENSP ID: ENSP00000483758

SEQ ID NO: 43677 - protein, 444 aa, Homo sapiens; identical to SEQ ID NO: 43666
  Payload ID: 8970
  Gene Symbol: KIR3DL1
  Gene Name: killer cell immunoglobulin-like receptor, three domains, long cytoplasmic tail, 1
  ENSP ID: ENSP00000483877

SEQ ID NO: 43678 - protein, 444 aa, Homo sapiens; identical to SEQ ID NO: 43639
  Payload ID: 8970
  Gene Symbol: KIR3DL1
  Gene Name: killer cell immunoglobulin-like receptor, three domains, long cytoplasmic tail, 1
  ENSP ID: ENSP00000483884

SEQ ID NO: 43679 - protein, 444 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000483885
MLLMVVSMACVGFFLVQRAGPHVGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSRERGAHERRLPAVRKVNRTFQADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 43680 - protein, 444 aa, Homo sapiens; identical to SEQ ID NO: 43625
  Payload ID: 8970
  Gene Symbol: KIR3DL1
  Gene Name: killer cell immunoglobulin-like receptor, three domains, long cytoplasmic tail, 1
  Uniprot ID: P43629
  ENSP ID: ENSP00000484036

SEQ ID NO: 43681 - protein, 455 aa, Homo sapiens; identical to SEQ ID NO: 43626
  Payload ID: 8970
  Gene Symbol: KIR3DL1
  Gene Name: killer cell immunoglobulin-like receptor, three domains, long cytoplasmic tail, 1
  ENSP ID: ENSP00000484124

SEQ ID NO: 43682 - protein, 455 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000484233
MSLMVVSMACVGFFLLQGAWPHEGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLHVLIGTSVVIILFILLLFFLLHLWCSNKKNAAVMDQEPAGNRTANSEDSDEQDPQEVTYAQLDHCVFTQRKITRPSQRPKTPPTDTILYTELPNAKPRSKVVSCPRAPQSGLEGIF

SEQ ID NO: 43683 - protein, 427 aa, Homo sapiens; identical to SEQ ID NO: 43635
  Payload ID: 8970
  Gene Symbol: KIR3DL1
  Gene Name: killer cell immunoglobulin-like receptor, three domains, long cytoplasmic tail, 1
  ENSP ID: ENSP00000484234

SEQ ID NO: 43684 - protein, 444 aa, Homo sapiens; identical to SEQ ID NO: 43639
  Payload ID: 8970
  Gene Symbol: KIR3DL1
  Gene Name: killer cell immunoglobulin-like receptor, three domains, long cytoplasmic tail, 1
  ENSP ID: ENSP00000484292

SEQ ID NO: 43685 - protein, 427 aa, Homo sapiens; identical to SEQ ID NO: 43635
  Payload ID: 8970
  Gene Symbol: KIR3DL1
  Gene Name: killer cell immunoglobulin-like receptor, three domains, long cytoplasmic tail, 1
  ENSP ID: ENSP00000484314

SEQ ID NO: 43686 - protein, 427 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000484350
MLLMVVSMACVGFFLVQRAGPHVGGQDKPFLSAWPSAVVPRGGHVTLRCHYHHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 43687 - protein, 444 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000484476
MSLMVVSMACVGFFLVQRAGPHVGGQDKPFLSAWPSAVVPRGGHVTLRCHYHHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 43688 - protein, 444 aa, Homo sapiens; identical to SEQ ID NO: 43625
  Payload ID: 8970
  Gene Symbol: KIR3DL1
  Gene Name: killer cell immunoglobulin-like receptor, three domains, long cytoplasmic tail, 1
  Uniprot ID: P43629
  ENSP ID: ENSP00000484488

SEQ ID NO: 43689 - protein, 444 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000484661
MLLMVVSMACVGFFLVQRAGPHMGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 43690 - protein, 455 aa, Homo sapiens; identical to SEQ ID NO: 43626
  Payload ID: 8970
  Gene Symbol: KIR3DL1
  Gene Name: killer cell immunoglobulin-like receptor, three domains, long cytoplasmic tail, 1
  ENSP ID: ENSP00000484957

SEQ ID NO: 43691 - protein, 444 aa, Homo sapiens; identical to SEQ ID NO: 43625
  Payload ID: 8970
  Gene Symbol: KIR3DL1
  Gene Name: killer cell immunoglobulin-like receptor, three domains, long cytoplasmic tail, 1
  Uniprot ID: P43629
  ENSP ID: ENSP00000484972

SEQ ID NO: 43692 - protein, 444 aa, Homo sapiens
  Payload ID: 8970
  Gene Symbol: KIR3DL1
  Gene Name: killer cell immunoglobulin-like receptor, three domains, long cytoplasmic tail, 1
  ENSP ID: ENSP00000484995
MSLMVVSMACVGFFLVQRAGPHVGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSRERGAHERRLPAVRKVNRTFQADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 43693 - protein, 438 aa, Homo sapiens
  Payload ID: 8971
  Gene Symbol: KIR3DL2
  Gene Name: killer cell immunoglobulin-like receptor, three domains, long cytoplasmic tail, 2
  Uniprot ID: P43630
  ENSP ID: ENSP00000270442
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSAPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 43694 - protein, 455 aa, Homo sapiens
  Payload ID: 8971
  Gene Symbol: KIR3DL2
  Gene Name: killer cell immunoglobulin-like receptor, three domains, long cytoplasmic tail, 2
  Uniprot ID: P43630
  ENSP ID: ENSP00000325525
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSAPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 43695 - protein, 455 aa, Homo sapiens; identical to SEQ ID NO: 43694
  Payload ID: 8971
  Gene Symbol: KIR3DL2
  Gene Name: killer cell immunoglobulin-like receptor, three domains, long cytoplasmic tail, 2
  Uniprot ID: P43630
  ENSP ID: ENSP00000477516

SEQ ID NO: 43696 - protein, 455 aa, Homo sapiens
  Payload ID: 8971
  Gene Symbol: KIR3DL2
  Gene Name: killer cell immunoglobulin-like receptor, three domains, long cytoplasmic tail, 2
  Uniprot ID: P43630
  ENSP ID: ENSP00000477519
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSAPSNPLVIMVTGNHRKPSLLAHPGPLLKSGETVILQCWSDVMFEHFFLHRDGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 43697 - protein, 438 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000477550
MSLTVVSMACVGFFLLQGAWPLMGGQDKPFLSAWPSTVVPRGGHVALQCHYRRGFNNFMLYKEDRSHVPIFHGRIFQESFIMGPVTPAHAGTYRCRGSRPHSLTGWSAPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 43698 - protein, 455 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000477628
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSTPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVMYAQLDHCVFIQRKISRPSQRPKTPLTDTSVYTELPNAEPRSKVVSCPRAPQSGLEGVF

SEQ ID NO: 43699 - protein, 455 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000477666
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSTPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSRGGEAHERRLRAVPKVNRTFQADFPLGPATHGGTYRCFGSFRALPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVMYAQLDHCVFIQRKISRPSQRPKTPLTDTSVYTELPNAEPRSKVVSCPRAPQSGLEGVF

SEQ ID NO: 43700 - protein, 455 aa, Homo sapiens; identical to SEQ ID NO: 43699
  Payload ID: 8971
  Gene Symbol: KIR3DL2
  Gene Name: killer cell immunoglobulin-like receptor, three domains, long cytoplasmic tail, 2
  ENSP ID: ENSP00000477702

SEQ ID NO: 43701 - protein, 438 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000477889
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSAPSNPLVIMVTGNHRKPSLLAHPGPLLKSGETVILQCWSDVMFEHFFLHRDGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 43702 - protein, 438 aa, Homo sapiens; identical to SEQ ID NO: 43701
  Payload ID: 8971
  Gene Symbol: KIR3DL2
  Gene Name: killer cell immunoglobulin-like receptor, three domains, long cytoplasmic tail, 2
  ENSP ID: ENSP00000477965

SEQ ID NO: 43703 - protein, 455 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000477978
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSAPSNPLVIMVTGNHRKPSLLAHPGPLLKSGETVILQCWSDIMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 43704 - protein, 438 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000478100
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSTPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGICRHLHVLIGTSVVIFLFILLLFFLLYRWCSNKKNAAVMDQEPAGDRTVNRQDSDEQDPQEVMYAQLDHCVFIQRKISRPSQRPKTPLTDTSVYTELPNAEPRSKVVSCPRAPQSGLEGVF

SEQ ID NO: 43705 - protein, 438 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000478140
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSAPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFHALPCVWSNSSDPLLVSVTGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 43706 - protein, 455 aa, Homo sapiens; identical to SEQ ID NO: 43696
  Payload ID: 8971
  Gene Symbol: KIR3DL2
  Gene Name: killer cell immunoglobulin-like receptor, three domains, long cytoplasmic tail, 2
  Uniprot ID: P43630
  ENSP ID: ENSP00000478251

SEQ ID NO: 43707 - protein, 455 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000478268
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSAPSNPLVIMVTGNHRKPSLLAHPGPLLKSGETVILQCWSDVMFEHFFLHREGISEDPSHLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 43708 - protein, 438 aa, Homo sapiens; identical to SEQ ID NO: 43704
  Payload ID: 8971
  Gene Symbol: KIR3DL2
  Gene Name: killer cell immunoglobulin-like receptor, three domains, long cytoplasmic tail, 2
  ENSP ID: ENSP00000478472

SEQ ID NO: 43709 - protein, 438 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000478587
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSAPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGICRHLHVLIGTSVVIFLFILLLFFLLYRWCSNKKNAAVMDQEPAGDRTVNRQDSDEQDPQEVMYAQLDHCVFIQRKISRPSQRPKTPLTDTSVYTELPNAEPRSKVVSCPRAPQSGLEGVF

SEQ ID NO: 43710 - protein, 455 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000478836
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSTPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRDLPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVMYAQLDHCVFIQRKISRPSQRPKTPLTDTSVYTELPNAEPRSKVVSCPRAPQSGLEGVF

SEQ ID NO: 43711 - protein, 455 aa, Homo sapiens; identical to SEQ ID NO: 43696
  Payload ID: 8971
  Gene Symbol: KIR3DL2
  Gene Name: killer cell immunoglobulin-like receptor, three domains, long cytoplasmic tail, 2
  Uniprot ID: P43630
  ENSP ID: ENSP00000479299

SEQ ID NO: 43712 - protein, 438 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000479302
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSAPSNPVVIMVTGNHRKPSLLAHPGPLLKSGETVILQCWSDVMFEHFFLHREGISEDPSHLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 43713 - protein, 455 aa, Homo sapiens [sequence omitted]

SEQ ID NO: 43714 - protein, 438 aa, Homo sapiens; identical to SEQ ID NO: 43704
  Payload ID: 8971
  Gene Symbol: KIR3DL2
  Gene Name: killer cell immunoglobulin-like receptor, three domains, long cytoplasmic tail, 2
  ENSP ID: ENSP00000479475

SEQ ID NO: 43715 - protein, 438 aa, Homo sapiens; identical to SEQ ID NO: 43701
  Payload ID: 8971
  Gene Symbol: KIR3DL2
  Gene Name: killer cell immunoglobulin-like receptor, three domains, long cytoplasmic tail, 2
  ENSP ID: ENSP00000479519

SEQ ID NO: 43716 - protein, 455 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000479746
MSLTVVSMACVGFFLLQGAWPLMGGQDKPFLSAWPSTVVPRGGHVALQCHYRRGFNNFMLYKEDRSHVPIFHGRIFQESFIMGPVTPAHAGTYRCRGSRPHSLTGWSAPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 43717 - protein, 455 aa, Homo sapiens; identical to SEQ ID NO: 43694
  Payload ID: 8971
  Gene Symbol: KIR3DL2
  Gene Name: killer cell immunoglobulin-like receptor, three domains, long cytoplasmic tail, 2
  Uniprot ID: P43630
  ENSP ID: ENSP00000479772

SEQ ID NO: 43718 - protein, 438 aa, Homo sapiens; identical to SEQ ID NO: 43701
  Payload ID: 8971
  Gene Symbol: KIR3DL2
  Gene Name: killer cell immunoglobulin-like receptor, three domains, long cytoplasmic tail, 2
  ENSP ID: ENSP00000479868

SEQ ID NO: 43719 - protein, 455 aa, Homo sapiens; identical to SEQ ID NO: 43694
  Payload ID: 8971
  Gene Symbol: KIR3DL2
  Gene Name: killer cell immunoglobulin-like receptor, three domains, long cytoplasmic tail, 2
  Uniprot ID: P43630
  ENSP ID: ENSP00000479903

SEQ ID NO: 43720 - protein, 438 aa, Homo sapiens; identical to SEQ ID NO: 43701
  Payload ID: 8971
  Gene Symbol: KIR3DL2
  Gene Name: killer cell immunoglobulin-like receptor, three domains, long cytoplasmic tail, 2
  ENSP ID: ENSP00000480098

SEQ ID NO: 43721 - protein, 438 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000480168
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSTPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSRGGEAHERRLRAVPKVNRTFQADFPLGPATHGGTYRCFGSFRALPCVWSNSSDPLLVSVTGICRHLHVLIGTSVVIFLFILLLFFLLYRWCSNKKNAAVMDQEPAGDRTVNRQDSDEQDPQEVMYAQLDHCVFIQRKISRPSQRPKTPLTDTSVYTELPNAEPRSKVVSCPRAPQSGLEGVF

SEQ ID NO: 43722 - protein, 438 aa, Homo sapiens; identical to SEQ ID NO: 43693
  Payload ID: 8971
  Gene Symbol: KIR3DL2
  Gene Name: killer cell immunoglobulin-like receptor, three domains, long cytoplasmic tail, 2
  Uniprot ID: P43630
  ENSP ID: ENSP00000480578

SEQ ID NO: 43723 - protein, 438 aa, Homo sapiens; identical to SEQ ID NO: 43704
  Payload ID: 8971
  Gene Symbol: KIR3DL2
  Gene Name: killer cell immunoglobulin-like receptor, three domains, long cytoplasmic tail, 2
  ENSP ID: ENSP00000480595

SEQ ID NO: 43724 - protein, 438 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000480628
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSAPSNPLVIMVTGNHRKPSLLAHPGPLLKSGETVILQCWSDIMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 43725 - protein, 455 aa, Homo sapiens; identical to SEQ ID NO: 43698
  Payload ID: 8971
  Gene Symbol: KIR3DL2
  Gene Name: killer cell immunoglobulin-like receptor, three domains, long cytoplasmic tail, 2
  ENSP ID: ENSP00000480737

SEQ ID NO: 43726 - protein, 118 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000480896
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSTPSNPLVIMVT

SEQ ID NO: 43727 - protein, 222 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000480951
MSLTVVSMACVGFFLLQGAWPLMGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTG

SEQ ID NO: 43728 - protein, 455 aa, Homo sapiens; identical to SEQ ID NO: 43698
  Payload ID: 8971
  Gene Symbol: KIR3DL2
  Gene Name: killer cell immunoglobulin-like receptor, three domains, long cytoplasmic tail, 2
  ENSP ID: ENSP00000481193

SEQ ID NO: 43729 - protein, 455 aa, Homo sapiens; identical to SEQ ID NO: 43696
  Payload ID: 8971
  Gene Symbol: KIR3DL2
  Gene Name: killer cell immunoglobulin-like receptor, three domains, long cytoplasmic tail, 2
  Uniprot ID: P43630
  ENSP ID: ENSP00000481209

SEQ ID NO: 43730 - protein, 438 aa, Homo sapiens; identical to SEQ ID NO: 43693
  Payload ID: 8971
  Gene Symbol: KIR3DL2
  Gene Name: killer cell immunoglobulin-like receptor, three domains, long cytoplasmic tail, 2
  Uniprot ID: P43630
  ENSP ID: ENSP00000481306

SEQ ID NO: 43731 - protein, 438 aa, Homo sapiens; identical to SEQ ID NO: 43701
  Payload ID: 8971
  Gene Symbol: KIR3DL2
  Gene Name: killer cell immunoglobulin-like receptor, three domains, long cytoplasmic tail, 2
  ENSP ID: ENSP00000481311

SEQ ID NO: 43732 - protein, 455 aa, Homo sapiens; identical to SEQ ID NO: 43694
  Payload ID: 8971
  Gene Symbol: KIR3DL2
  Gene Name: killer cell immunoglobulin-like receptor, three domains, long cytoplasmic tail, 2
  Uniprot ID: P43630
  ENSP ID: ENSP00000481579

SEQ ID NO: 43733 - protein, 455 aa, Homo sapiens; identical to SEQ ID NO: 43696
  Payload ID: 8971
  Gene Symbol: KIR3DL2
  Gene Name: killer cell immunoglobulin-like receptor, three domains, long cytoplasmic tail, 2
  Uniprot ID: P43630
  ENSP ID: ENSP00000481662

SEQ ID NO: 43734 - protein, 438 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000481788
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSTPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRDLPCVWSNSSDPLLVSVTGICRHLHVLIGTSVVIFLFILLLFFLLYRWCSNKKNAAVMDQEPAGDRTVNRQDSDEQDPQEVMYAQLDHCVFIQRKISRPSQRPKTPLTDTSVYTELPNAEPRSKVVSCPRAPQSGLEGVF

SEQ ID NO: 43735 - protein, 438 aa, Homo sapiens; identical to SEQ ID NO: 43704
  Payload ID: 8971
  Gene Symbol: KIR3DL2
  Gene Name: killer cell immunoglobulin-like receptor, three domains, long cytoplasmic tail, 2
  ENSP ID: ENSP00000481845

SEQ ID NO: 43736 - protein, 438 aa, Homo sapiens; identical to SEQ ID NO: 43693
  Payload ID: 8971
  Gene Symbol: KIR3DL2
  Gene Name: killer cell immunoglobulin-like receptor, three domains, long cytoplasmic tail, 2
  Uniprot ID: P43630
  ENSP ID: ENSP00000481871

SEQ ID NO: 43737 - protein, 455 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000481911
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSAPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFHALPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 43738 - protein, 455 aa, Homo sapiens; identical to SEQ ID NO: 43694
  Payload ID: 8971
  Gene Symbol: KIR3DL2
  Gene Name: killer cell immunoglobulin-like receptor, three domains, long cytoplasmic tail, 2
  Uniprot ID: P43630
  ENSP ID: ENSP00000482110

SEQ ID NO: 43739 - protein, 455 aa, Homo sapiens; identical to SEQ ID NO: 43696
  Payload ID: 8971
  Gene Symbol: KIR3DL2
  Gene Name: killer cell immunoglobulin-like receptor, three domains, long cytoplasmic tail, 2
  Uniprot ID: P43630
  ENSP ID: ENSP00000482301

SEQ ID NO: 43740 - protein, 455 aa, Homo sapiens; identical to SEQ ID NO: 43696
  Payload ID: 8971
  Gene Symbol: KIR3DL2
  Gene Name: killer cell immunoglobulin-like receptor, three domains, long cytoplasmic tail, 2
  Uniprot ID: P43630
  ENSP ID: ENSP00000482565

SEQ ID NO: 43741 - protein, 438 aa, Homo sapiens; identical to SEQ ID NO: 43693
  Payload ID: 8971
  Gene Symbol: KIR3DL2
  Gene Name: killer cell immunoglobulin-like receptor, three domains, long cytoplasmic tail, 2
  Uniprot ID: P43630
  ENSP ID: ENSP00000482589

SEQ ID NO: 43742 - protein, 438 aa, Homo sapiens; identical to SEQ ID NO: 43693
  Payload ID: 8971
  Gene Symbol: KIR3DL2
  Gene Name: killer cell immunoglobulin-like receptor, three domains, long cytoplasmic tail, 2
  Uniprot ID: P43630
  ENSP ID: ENSP00000482655

SEQ ID NO: 43743 - protein, 333 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000482956
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSTPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGNPSSSWPSPTEPSSKS

SEQ ID NO: 43744 - protein, 438 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000483009
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSAPSNPLVIMVTGNHRKPSLLAHPGPLLKSGETVILQCWSDVMFEHFFLHREGISEDPSHLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 43745 - protein, 455 aa, Homo sapiens; identical to SEQ ID NO: 43698
  Payload ID: 8971
  Gene Symbol: KIR3DL2
  Gene Name: killer cell immunoglobulin-like receptor, three domains, long cytoplasmic tail, 2
  ENSP ID: ENSP00000483218

SEQ ID NO: 43746 - protein, 438 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000483284
MSLTVVSMACVGFFLLQGAWPLMGGQDKPFLSARPSTVVPQGGHVALQCHYRRGFNNFMLYKEDRSHVPIFHGRIFQESFIMGPVTPAHAGTYRCRGSRPHSLTGWSAPSNPLVIMVTGNHRKPSLLAHPGTLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGICRHLHVLIGTSVVIFLFILLLFFLLYRWCSNKKNAAVMDQEPAGDRTVNRQDSDEQDPQEVTYAQLDHCVFIQRKISRPSQRPKTPPTDTSVYTELPNAEPRSKVVSCPRAPQSGLEGVF

SEQ ID NO: 43747 - protein, 455 aa, Homo sapiens; identical to SEQ ID NO: 43698
  Payload ID: 8971
  Gene Symbol: KIR3DL2
  Gene Name: killer cell immunoglobulin-like receptor, three domains, long cytoplasmic tail, 2
  ENSP ID: ENSP00000483422

SEQ ID NO: 43748 - protein, 455 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000483790
MSLTVVSMACVGFFLLQGAWPLMGGQDKPFLSARPSTVVPQGGHVALQCHYRRGFNNFMLYKEDRSHVPIFHGRIFQESFIMGPVTPAHAGTYRCRGSRPHSLTGWSAPSNPLVIMVTGNHRKPSLLAHPGTLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPPTDTSVYTELPNAEPRSKVVSCPRAPQSGLEGVF

SEQ ID NO: 43749 - protein, 333 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000483850
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSAPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGNPSSSWPSPTEPSSKS

SEQ ID NO: 43750 - protein, 438 aa, Homo sapiens; identical to SEQ ID NO: 43701
  Payload ID: 8971
  Gene Symbol: KIR3DL2
  Gene Name: killer cell immunoglobulin-like receptor, three domains, long cytoplasmic tail, 2
  ENSP ID: ENSP00000483917

SEQ ID NO: 43751 - protein, 438 aa, Homo sapiens; identical to SEQ ID NO: 43705
  Payload ID: 8971
  Gene Symbol: KIR3DL2
  Gene Name: killer cell immunoglobulin-like receptor, three domains, long cytoplasmic tail, 2
  ENSP ID: ENSP00000484059

SEQ ID NO: 43752 - protein, 455 aa, Homo sapiens
  Payload ID: 8971
  Gene Symbol: KIR3DL2
  Gene Name: killer cell immunoglobulin-like receptor, three domains, long cytoplasmic tail, 2
  ENSP ID: ENSP00000484092
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSAPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVMYAQLDHCVFIQRKISRPSQRPKTPLTDTSVYTELPNAEPRSKVVSCPRAPQSGLEGVF

SEQ ID NO: 43753 - protein, 455 aa, Homo sapiens; identical to SEQ ID NO: 43737
  Payload ID: 8971
  Gene Symbol: KIR3DL2
  Gene Name: killer cell immunoglobulin-like receptor, three domains, long cytoplasmic tail, 2
  ENSP ID: ENSP00000484518

SEQ ID NO: 43754 - protein, 410 aa, Homo sapiens
  Payload ID: 8972
  Gene Symbol: KIR3DL3
  Gene Name: killer cell immunoglobulin-like receptor, three domains, long cytoplasmic tail, 3
  ENSP ID: ENSP00000291860
MSLMVVSMACVGFFLLEGPWPHVGGQDKPFLSAWPGTVVSEGQHVTLQCRSRLGFNEFSLSKEDGMPVPELYNRIFRNSFLMGPVTPAHAGTYRCCSSHPHSPTGWSAPSNPVVIMVTGVHRKPSLLAHPGPLVKSGETVILQCWSDVRFERFLLHREGITEDPLRLVGQLHDAGSQVNYSMGPMTPALAGTYRCFGSVTHLPYELSAPSDPLDIVVVGLYGKPSLSAQPGPTVQAGENVTLSCSSRSLFDIYHLSREAEAGELRLTAVLRVNGTFQANFPLGPVTHGGNYRCFGSFRALPHAWSDPSDPLPVSVTGNSRNLHVLIGTSVVIIPFAILLFFLLHRWCANKKNAVVMDQEPAGNRTVNREDSDEQDPQEVTYAQLNHCVFTQRKITRPSQRPKTPPTDTSV

SEQ ID NO: 43755 - protein, 410 aa, Homo sapiens
  Payload ID: 8972
  Gene Symbol: KIR3DL3
  Gene Name: killer cell immunoglobulin-like receptor, three domains, long cytoplasmic tail, 3
  ENSP ID: ENSP00000477652
MSLMVVSMACVGFFLLEGPWPHVGGQDKPFLSAWPGTVVSEGQHVTLQCRSRLGFNEFSLSKEDGMPVPELYNRIFRNSFLMGPVTPAHAGTYRCCSSHPHSPTGWSAPSNPVVIMVTGVHRKPSLLAHPGPLVKSGETVILQCWSDVRFERFLLHREGITEDPLRLIGQLHDAGSQVNYSMGPMTPALAGTYRCFGSVTHLPYELSAPSDPLDIVVVGLYGKPSLSAQPGPTVQAGENVTLSCSSRSLFDIYHLSREAEAGELRLTAVLRVNGTFQANFPLGPVTHGGNYRCFGSFRALPHAWSDPSDPLPVSVTGNSRHLHVLIGTSVVIIPFAILLFFLLHRWCANKKNAVVMDQEPAGNRTVNREDSDEQDPQEVTYAQLNHCVFTQRKITRPSQRPKTPPTDTSV

SEQ ID NO: 43756 - protein, 410 aa, Homo sapiens
  Payload ID: 8972
  Gene Symbol: KIR3DL3
  Gene Name: killer cell immunoglobulin-like receptor, three domains, long cytoplasmic tail, 3
  ENSP ID: ENSP00000477728
MSLMVVSMACVGFFLLEGPWPHVGGQDKPFLSAWPGTVVSEGQHVTLQCRSRLGFNEFSLSKEDGMPVPELYNRIFRNSFLMGPVTPAHAGTYRCCSSHPHSPTGWSAPSNPVVIMVTGVHRKPSLLAHPGPLVKSGETVILQCWSDVRFERFLLHREGITEDPLRLIGQLHDAGSQVNYSMGPMTPALAGTYRCFGSVTHLPYELSAPSDPLDIVVVGLYGKPSLSAQPGPTVQAGENVTLSCSSRSLFDIYHLSREAEAGELRLTAVLRVNGTFQANFPLGPVTHGGNYRCFGSFRALPHAWSDPSDPLPVSVTGNSRYLHALIGTSVVIIPFAILLFFLLHRWCANKKNAVVMDQEPAGNRTVNREDSDEQDPQEVTYAQLNHCVFTQRKITRPSQRPKTPPTDTSV

SEQ ID NO: 43757 - protein, 410 aa, Homo sapiens; identical to SEQ ID NO: 43756
  Payload ID: 8972
  Gene Symbol: KIR3DL3
  Gene Name: killer cell immunoglobulin-like receptor, three domains, long cytoplasmic tail, 3
  ENSP ID: ENSP00000477820

SEQ ID NO: 43758 - protein, 410 aa, Homo sapiens
  Payload ID: 8972
  Gene Symbol: KIR3DL3
  Gene Name: killer cell immunoglobulin-like receptor, three domains, long cytoplasmic tail, 3
  Uniprot ID: Q8N743
  ENSP ID: ENSP00000478200
MSLMVVSMACVGFFLLEGPWPHVGGQDKPFLSAWPGTVVSEGQHVTLQCRSRLGFNEFSLSKEDGMPVPELYNRIFRNSFLMGPVTPAHAGTYRCCSSHPHSPTGWSAPSNPVVIMVTGVHRKPSLLAHPGPLVKSGETVILQCWSDVRFERFLLHREGITEDPLRLVGQLHDAGSQVNYSMGPMTPALAGTYRCFGSVTHLPYELSAPSDPLDIVVVGLYGKPSLSAQPGPTVQAGENVTLSCSSRSLFDIYHLSREAEAGELRLTAVLRVNGTFQANFPLGPVTHGGNYRCFGSFRALPHAWSDPSDPLPVSVTGNSRHLHVLIGTSVVIIPFAILLFFLLHRWCANKKNAVVMDQEPAGNRTVNREDSDEQDPQEVTYAQLNHCVFTQRKITRPSQRPKTPPTDTSV

SEQ ID NO: 43759 - protein, 410 aa, Homo sapiens
  Payload ID: 8972
  Gene Symbol: KIR3DL3
  Gene Name: killer cell immunoglobulin-like receptor, three domains, long cytoplasmic tail, 3
  ENSP ID: ENSP00000478247
MSLMVVSMACVGFFLLEGPWPHVGGQDKPFLSAWPGTVVSEGQHVTLQCRSRLGFNEFSLSKEDGMPVPELYNRIFRNSFLMGPVTPAHAGTYRCCSSHPHSPTGWSAPSNPVVIMVTGVHRKPSLLAHPGPLVKSGETVILQCWSDVRFEHFLLHREGITEDPLRLVGQLHDAGSQVNYSMGPMTPALAGTYRCFGSVTHLPYELSAPSDPLDIVVVGLYGKPSLSAQPGPTVQAGENVTLSCSSRSLFDIYHLSREAEAGELRLTAVLRVNGTFQANFPLGPVTHGGNYRCFGSFRALPHAWSDPSDPLPVSVTGNSRNLHVLIGTSVVIIPFAILLFFLLHRWCANKKNAVVMDQEPAGNRTVNREDSDEQDPQEVTYAQLNHCVFTQRKITRPSQRPKTPPTDTSV

SEQ ID NO: 43760 - protein, 410 aa, Homo sapiens
  Payload ID: 8972
  Gene Symbol: KIR3DL3
  Gene Name: killer cell immunoglobulin-like receptor, three domains, long cytoplasmic tail, 3
  ENSP ID: ENSP00000478304
MSLMVVSMACVGFFLLEGPWPHVGGQDKPFLSAWPGTVVSEGQHVTLQCRSRLGFNEFSLSKEDGMPVPELYNRIFRNSFLMGPVTPAHAGTYRCCSSHPHSPTGWSAPSNPVVIMVTGVHRKPSLLAHPGPLVKSGETVILQCWSDVRFERFLLHREGITEDPLRLIGQLHDAGSQVNYSMGPMTPALAGTYRCFGSVTHLPYELSAPSDPLDIVVVGLYGKPSLSAQPGPTVQAGENVTLSCSSRSLFDIYHLSREAEAGELRLTAVLRVNGTFQANFPLGPVTHGGNYRCFGSFRALPHAWSDPSDPLPVSVTGNSRNLHVLIGTSVVIIPFAILLFFLLHRWCANKKNAVVMDQEPAGNRTVNREDSDEQDPQEVTYAQLNHCVFTQRKITRPSQRPKTPPTDTSV

SEQ ID NO: 43761 - protein, 410 aa, Homo sapiens
  Payload ID: 8972
  Gene Symbol: KIR3DL3
  Gene Name: killer cell immunoglobulin-like receptor, three domains, long cytoplasmic tail, 3
  ENSP ID: ENSP00000478344
MSLMVVSMACVGFFLLEGPWPHVGGQDKPFLSAWPGTVVSEGQHVTLQCRSRLGFNEFSLSKEDGMPVPELYNRIFRNSFLMGPVTPAHAGTYRCCSSHPHSPTGWSAPSNPVVIMVTGVHRKPSLLAHPGPLVKSGETVILQCWSDVRFERFLLHREGITEDPLRLVGQLHDAGSQVNYSMGPMTPALAGTYRCFGSVTHLPYELSAPSDPLDIVVVGLYGKPSLSAQPGPTVQAGENVTLSCSSRSLFDIYHLSREAEAGELRLTAVLRVNGTFQANFPLGPVTHGGNYRCFGSFRALPHAWSDPSDPLPVSVTGNSRYLHALIGTSVVIIPFAILLFFLLHRWCANKKNAVVMDQEPAGNRTVNREDSDEQDPQEVTYAQLNHCVFTQRKITRPSQRPKTPPTDTSV

SEQ ID NO: 43762 - protein, 410 aa, Homo sapiens; identical to SEQ ID NO: 43755
  Payload ID: 8972
  Gene Symbol: KIR3DL3
  Gene Name: killer cell immunoglobulin-like receptor, three domains, long cytoplasmic tail, 3
  ENSP ID: ENSP00000478407

SEQ ID NO: 43763 - protein, 410 aa, Homo sapiens
  Payload ID: 8972
  Gene Symbol: KIR3DL3
  Gene Name: killer cell immunoglobulin-like receptor, three domains, long cytoplasmic tail, 3
  ENSP ID: ENSP00000478410
MSLMVVSMACVGFFLLEGPWPHVGGQDKPFLSAWPGTVVSEGQHVTLQCRSRLGFKEFSLSKEDGMPVPELYNRIFRNSFLMGPVTPAHAGTYRCCSSHPHSPTGWSAPSNPVVIMVTGVHRKPSLLAHPGPLVKSGETVILQCWSDVSFERFLLHREGITEDPLRLVGQLHDAGSQVNYSMGPMTPALAGTYRCFGSVTHLPYELSAPSDPLDIVVVGLYGKPSLSAQPGPTVQAGENVTLSCSSRSLFDIYHLSREAEAGELRLTAVLRVNGTFQANFPLGPVTHGGTYRCFGSFRALPHAWSDPSDPLPVSVTGNSRNLHVLIGTSVVIIPFAILLFFLLHRWCANKKNAVVMDQEPAGNRTVNREDSDEQDPQEVTYAQLNHCVFTQRKITRPSQRPKTPPTDTSV

SEQ ID NO: 43764 - protein, 410 aa, Homo sapiens
  Payload ID: 8972
  Gene Symbol: KIR3DL3
  Gene Name: killer cell immunoglobulin-like receptor, three domains, long cytoplasmic tail, 3
  ENSP ID: ENSP00000478741
MSLMVVSMACVGFFLLEGPWPHVGGQDKPFLSAWPGTVVSEGQHVTLQCRSHLGFNEFSLSKEDGMPVPELYNRIFRNSFLMGPVTPAHAGTYRCCSSHPHSPTGWSAPSNPVVIMVTGVHRKPSLLAHPGPLVKSGETVILQCWSDVRFERFLLHREGITEDPLRLVGQLHDAGSQVNYSMGPMTPALAGTYRCFGSVTHLPYELSAPSDPLDIVVVGLYGKPSLSAQPGPTVQAGENVTLSCSSRSLFDIYHLSREAEAGELRLTAVLRVNGTFQANFPLGPVTHGGNYRCFGSFRALPHAWSDPSDPLPVSVTGNSRYLHALIGTSVVIIPFAILLFFLLHRWCANKKNAVVMDQEPAGNRTVNREDSDEQDPQEVTYAQLNHCVFTQRKITRPSQRPKTPPTDTSV

SEQ ID NO: 43765 - protein, 410 aa, Homo sapiens; identical to SEQ ID NO: 43755
  Payload ID: 8972
  Gene Symbol: KIR3DL3
  Gene Name: killer cell immunoglobulin-like receptor, three domains, long cytoplasmic tail, 3
  ENSP ID: ENSP00000479596

SEQ ID NO: 43766 - protein, 410 aa, Homo sapiens
  Payload ID: 8972
  Gene Symbol: KIR3DL3
  Gene Name: killer cell immunoglobulin-like receptor, three domains, long cytoplasmic tail, 3
  ENSP ID: ENSP00000479747
MSLMVVSMACVGFFLLEGPWPHVGGQDKPFLSAWPGTVVSEGQHVTLQCRSRLGFNEFSLSKEDGMPVPELYNRIFWNSFLMGPVTPAHAGTYRCCSSHPHSPTGWSAPSNPVVIMVTGVHRKPSLLAHPGPLVKSGETVILQCWSDVRFERFLLHREGITEDPLRLIGQLHDAGSQVNYSMGPMTPALAGTYRCFGSVTHLPYELSAPSDPLDIVVVGLYGKPSLSAQPGPTVQAGENVTLSCSSRSLFDIYHLSREAEAGELRLTAVLRVNGTFQANFPLGPVTHGGNYRCFGSFRALPHAWSDPSDPLPVSVTGNSRHLHVLIGTSVVIIPFAILLFFLLHRWCANKKNAVVMDQEPAGNRTVNREDSDEQDPQEVTYAQLNHCVFTQRKITRPSQRPKTPPTDTSV

SEQ ID NO: 43767 - protein, 410 aa, Homo sapiens; identical to SEQ ID NO: 43756
  Payload ID: 8972
  Gene Symbol: KIR3DL3
  Gene Name: killer cell immunoglobulin-like receptor, three domains, long cytoplasmic tail, 3
  ENSP ID: ENSP00000479771

SEQ ID NO: 43768 - protein, 410 aa, Homo sapiens; identical to SEQ ID NO: 43755
  Payload ID: 8972
  Gene Symbol: KIR3DL3
  Gene Name: killer cell immunoglobulin-like receptor, three domains, long cytoplasmic tail, 3
  ENSP ID: ENSP00000479915

SEQ ID NO: 43769 - protein, 410 aa, Homo sapiens; identical to SEQ ID NO: 43756
  Payload ID: 8972
  Gene Symbol: KIR3DL3
  Gene Name: killer cell immunoglobulin-like receptor, three domains, long cytoplasmic tail, 3
  ENSP ID: ENSP00000480099

SEQ ID NO: 43770 - protein, 410 aa, Homo sapiens; identical to SEQ ID NO: 43763
  Payload ID: 8972
  Gene Symbol: KIR3DL3
  Gene Name: killer cell immunoglobulin-like receptor, three domains, long cytoplasmic tail, 3
  ENSP ID: ENSP00000480163

SEQ ID NO: 43771 - protein, 410 aa, Homo sapiens; identical to SEQ ID NO: 43764
  Payload ID: 8972
  Gene Symbol: KIR3DL3
  Gene Name: killer cell immunoglobulin-like receptor, three domains, long cytoplasmic tail, 3
  ENSP ID: ENSP00000480720

SEQ ID NO: 43772 - protein, 410 aa, Homo sapiens
  Payload ID: 8972
  Gene Symbol: KIR3DL3
  Gene Name: killer cell immunoglobulin-like receptor, three domains, long cytoplasmic tail, 3
  ENSP ID: ENSP00000481461
MSLMVVSMACVGFFLLEGPWPHVGGQDKPFLSAWPGTVVSEGQHVTLQCRSHLGFNEFSLSKEDGMPVPELYNRIFRNSFLMGPVTPAHAGTYRCCSSHPHSPTGWSAPSNPVVIMVTGVHRKPSLLAHPGPLVKSGETVILQCWSDVRFERFLLHREGITEDPLRLVGQLHDAGSQVNYSMGPMTPALAGTYRCFGSVTHLPYELSAPSDPLDIVVVGLYGKPSLSAQPGPTVQAGENVTLSCSSRSLFDIYHLSREAEAGELRLTAVLRVNGTFQANFPLGPVTHGGNYRCFGSFRALPHAWSDPSDPLPVSVTGNSRHLHVLIGTSVVIIPFAILLFFLLHRWCANKKNAVVMDQEPAGNRTVNREDSDEQDPQEVTYAQLNHCVFTQRKITRPSQRPKTPPTDTSV

SEQ ID NO: 43773 - protein, 410 aa, Homo sapiens
  Payload ID: 8972
  Gene Symbol: KIR3DL3
  Gene Name: killer cell immunoglobulin-like receptor, three domains, long cytoplasmic tail, 3
  ENSP ID: ENSP00000481489
MSLMVVSMACVGFFLLEGPWPHVGGQDKPFLSAWPGTVVSEGQHVTLQCRSRLGFNEFSLSKEDGMPVPELYNRIFRNSFLMGPVTPAHAGTYRCCSSHPHSPTGWSAPSNPVVIMVTGVHRKPSLLAHPGPLVKSGETVILQCWSDVSFERFLLHREGITEDPLRLVGQLHDAGSQVNYSMGPMTPALAGTYRCFGSVTHLPYELSAPSDPLDIVVVGLYGKPSLSAQPGPTVQAGENVTLSCSSRSLFDIYHLSREAEAGELRLTAVLRVNGTFQANFPLGPVTHGGTYRCFGSFRALPHAWSDPSDPLPVSVTGNSRYLHALIGTSVVIIPFAILLFFLLHRWCANKKNAVVMDQEPAGNRTVNREDSDEQDPQEVTYAQLNHCVFTQRKITRPSQRPKTPPTDTSV

SEQ ID NO: 43774 - protein, 410 aa, Homo sapiens; identical to SEQ ID NO: 43760
  Payload ID: 8972
  Gene Symbol: KIR3DL3
  Gene Name: killer cell immunoglobulin-like receptor, three domains, long cytoplasmic tail, 3
  ENSP ID: ENSP00000481535

SEQ ID NO: 43775 - protein, 410 aa, Homo sapiens; identical to SEQ ID NO: 43755
  Payload ID: 8972
  Gene Symbol: KIR3DL3
  Gene Name: killer cell immunoglobulin-like receptor, three domains, long cytoplasmic tail, 3
  ENSP ID: ENSP00000481664

SEQ ID NO: 43776 - protein, 410 aa, Homo sapiens; identical to SEQ ID NO: 43755
  Payload ID: 8972
  Gene Symbol: KIR3DL3
  Gene Name: killer cell immunoglobulin-like receptor, three domains, long cytoplasmic tail, 3
  ENSP ID: ENSP00000481803

SEQ ID NO: 43777 - protein, 425 aa, Homo sapiens
  Payload ID: 8972
  Gene Symbol: KIR3DL3
  Gene Name: killer cell immunoglobulin-like receptor, three domains, long cytoplasmic tail, 3
  ENSP ID: ENSP00000481968
MSLMVVSMACVGFFLLEGPWPHVGGQDKPFLSAWPGTVVSEGQHVTLQCRSRLGFKEFSLSKEDGMPVPELYNRIFRNSFLMGPVTPAHAGTYRCCSSHPHSPTGWSAPSNPVVIMVTGVHRKPSLLAHPGPLVKSGETVILQCWSDVRFERFLLHREGITEDPLRLVGQLHDAGSQVNYSMGPMTPALAGTYRCFGSVTHLPYELSAPSDPLDIVVVGLYGKPSLSAQPGPTVQAGENVTLSCSSRSLFDIYHLSREAEAGELRLTAVLRVNGTFQANFPLGPVTHGGTYRCFGSFRALPHAWSDPSDPLPVSVTGTAMISFLLVSCLPPGNSRHLHVLIGTSVVIIPFAILLFFLLHRWCANKKNAVVMDQEPAGNRTVNREDSDEQDPQEVTYAQLNHCVFTQRKITRPSQRPKTPPTDTSV

SEQ ID NO: 43778 - protein, 454 aa, Homo sapiens
  Payload ID: 8972
  Gene Symbol: KIR3DL3
  Gene Name: killer cell immunoglobulin-like receptor, three domains, long cytoplasmic tail, 3
  ENSP ID: ENSP00000481982
MSLMVVSMACVGFFLLEGPWPHVGGQDKPFLSAWPGTVVSEGQHVTLQCRSRLGFNEFSLSKEDGMPVPELYNRIFRNSFLMGPVTPAHAGTYRCCSSHPHSPTGWSAPSNPVVIMVTGVHRKPSLLAHPGPLVKSGETVILQCWSDVRFERFLLHREGITEDPLRLIGQLHDAGSQVNYSMGPMTPALAGTYRCFGSVTHLPYELSAPSDPLDIVVVGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLHVLIGTSVVKIPFTILLFFLLHRWCSNKKNAAVMDQEPAGNRTVNSEDSDEQDPQEVTYTQLNHCVFTQRKITRPSQRPKTPPTDIIVYTELPNAESRSKVVSCPAPQSGLEGVF

SEQ ID NO: 43779 - protein, 410 aa, Homo sapiens; identical to SEQ ID NO: 43761
  Payload ID: 8972
  Gene Symbol: KIR3DL3
  Gene Name: killer cell immunoglobulin-like receptor, three domains, long cytoplasmic tail, 3
  ENSP ID: ENSP00000482181

SEQ ID NO: 43780 - protein, 410 aa, Homo sapiens; identical to SEQ ID NO: 43758
  Payload ID: 8972
  Gene Symbol: KIR3DL3
  Gene Name: killer cell immunoglobulin-like receptor, three domains, long cytoplasmic tail, 3
  Uniprot ID: Q8N743
  ENSP ID: ENSP00000482580

SEQ ID NO: 43781 - protein, 410 aa, Homo sapiens; identical to SEQ ID NO: 43761
  Payload ID: 8972
  Gene Symbol: KIR3DL3
  Gene Name: killer cell immunoglobulin-like receptor, three domains, long cytoplasmic tail, 3
  ENSP ID: ENSP00000483190

SEQ ID NO: 43782 - protein, 410 aa, Homo sapiens
  Payload ID: 8972
  Gene Symbol: KIR3DL3
  Gene Name: killer cell immunoglobulin-like receptor, three domains, long cytoplasmic tail, 3
  ENSP ID: ENSP00000483308
MSLMVVSMACVGFFLLEGPWPHVGGQDKPFLSAWPGTVVSEGQHVTLQCRSRLGFNEFSLSKEDGMPVPELYNRIFWNSFLMGPVTPAHAGTYRCCSSHPHSPTGWSAPSNPVVIMVTGVHRKPSLLAHPGPLVKSGETVILQCWSDVRFERFLLHREGITEDPLRLIGQLHDAGSQVNYSMGPMTPALAGTYRCFGSVTHLPYELSAPSDPLDIVVVGLYGKPSLSAQPGPTVQAGENVTLSCSSRSLFDIYHLSREAEAGELRLTAVLRVNGTFQANFPLGPVTHGGNYRCFGSFRALPHAWSDPSDPLPVSVTGNSRNLHVLIGTSVVIIPFAILLFFLLHRWCANKKNAVVMDQEPAGNRTVNREDSDEQDPQEVTYAQLNHCVFTQRKITRPSQRPKTPPTDTSV

SEQ ID NO: 43783 - protein, 410 aa, Homo sapiens; identical to SEQ ID NO: 43756
  Payload ID: 8972
  Gene Symbol: KIR3DL3
  Gene Name: killer cell immunoglobulin-like receptor, three domains, long cytoplasmic tail, 3
  ENSP ID: ENSP00000483578

SEQ ID NO: 43784 - protein, 410 aa, Homo sapiens
  Payload ID: 8972
  Gene Symbol: KIR3DL3
  Gene Name: killer cell immunoglobulin-like receptor, three domains, long cytoplasmic tail, 3
  ENSP ID: ENSP00000483714
MSLMVVSMACVGFFLLEGPWPHVGGQDKPFLSAWPGTVVSEGQHVTLQCRSRLGFKEFSLSKEDGMPVPELYNRIFRNSFLMGPVTPAHAGTYRCCSSHPHSPTGWSAPSNPVVIMVTGVHRKPSLLAHPGPLVKSGETVILQCWSDVRFERFLLHREGITEDPLRLVGQLHDAGSQVNYSMGPMTPALAGTYRCFGSVTHLPYELSAPSDPLDIVVVGLYGKPSLSAQPGPTVQAGENVTLSCSSRSLFDIYHLSREAEAGELRLTAVLRVNGTFQANFPLGPVTHGGTYRCFGSFRALPHAWSDPSDPLPVSVTGNSRHLHVLIGTSVVIIPFAILLFFLLHRWCANKKNAVVMDQEPAGNRTVNREDSDEQDPQEVTYAQLNHCVFTQRKITRPSQRPKTPPTDTSV

SEQ ID NO: 43785 - protein, 410 aa, Homo sapiens; identical to SEQ ID NO: 43772
  Payload ID: 8972
  Gene Symbol: KIR3DL3
  Gene Name: killer cell immunoglobulin-like receptor, three domains, long cytoplasmic tail, 3
  ENSP ID: ENSP00000484541

SEQ ID NO: 43786 - protein, 410 aa, Homo sapiens; identical to SEQ ID NO: 43754
  Payload ID: 8972
  Gene Symbol: KIR3DL3
  Gene Name: killer cell immunoglobulin-like receptor, three domains, long cytoplasmic tail, 3
  ENSP ID: ENSP00000484725

SEQ ID NO: 43787 - protein, 387 aa, Homo sapiens
  Payload ID: 8972
  Gene Symbol: KIR3DL3
  Gene Name: killer cell immunoglobulin-like receptor, three domains, long cytoplasmic tail, 3
  ENSP ID: ENSP00000484879
GGQDKPFLSAWPGTVVSEGQHVTLQCRSRLGFNEFSLSKEDGMPVPELYNRIFRNSFLMGPVTPAHAGTYRCCSSHPHSPTGWSAPSNPVVIMVTGVHRKPSLLAHPGPLVKSGETVILQCWSDVRFERFLLHREGITEDPLRLVGQLHDAGSQVNYSMGPMTPALAGTYRCFGSVTHLPYELSAPSDPLDIVVVGLYGKPSLSAQPDPTVQAGENVTLSCSSRSLFDIYHLSREAEAGELRLTAVLRVNGTFQANFPLGPVTHGGNYRCFGSFRALPHAWSDPSDPLPVSVTGNSRHLHVLIGTSVVIIPFAILLFFLLHRWCANKKNAVVMDQEPAGNRTVNREDSDEQDPQEVTYAQLNHCVFTQRKITRPSQRPKTPPTDTSV

SEQ ID NO: 43788 - protein, 328 aa, Homo sapiens
  Payload ID: 8973
  Gene Symbol: KIR3DP1
  Gene Name: killer cell immunoglobulin-like receptor, three domains, pseudogene 1
  ENSP ID: ENSP00000480312
MSLMVVSMACVGFFLLQGAWPHEGGQDKPFLSAWPSPVVSEGEHVALQCRSRLGFNEFSLSKEDGMPVPELYNRVFRNTVFIGPVTPAHAGTYRCRGSHPHFLTGWSAPSNPLVIMVTGVHRKPSLLAHPGPLVKSEETVILQCWSDVMFEHFLLHREGKFNDTLRLTGELHDGVSKANFSIGRMTQDLAGTYRCYGSVPHSPYQLSAPSDPLDIVITGLCGKPSLSAQPRPMVKAGESVTLSCSSRSSYDIYHLSRDGEAHELRFPAVPKVNGTFQANFPLGPATHGGTYRCFGSFRDSPYEWSDLSDPLLVSVTDSMKEKGKDVIL

SEQ ID NO: 43789 - protein, 328 aa, Homo sapiens; identical to SEQ ID NO: 36735
  Payload ID: 8973
  Gene Symbol: KIR3DP1
  Gene Name: killer cell immunoglobulin-like receptor, three domains, pseudogene 1
  ENSP ID: ENSP00000480363

SEQ ID NO: 43790 - protein, 275 aa, Homo sapiens
  Payload ID: 8974
  Gene Symbol: KIR3DS1
  Gene Name: killer cell immunoglobulin-like receptor, three domains, short cytoplasmic tail, 1
  ENSP ID: ENSP00000477663
MLLMVVSMACVGNHRKPSLLAHPGPLVKSGERVILQCWSDIMFEHFFLHKEWISKDPSRLVGQIHDGVSKANFSIGSMMRALAGTYRCYGSVTHTPYQLSAPSDPLDIVVTGLYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNLRHLHILIGTSVVKIPFTILLFFLLHRWCSNKKKCCCNGPRACREQK

SEQ ID NO: 43791 - protein, 387 aa, Homo sapiens
  Payload ID: 8974
  Gene Symbol: KIR3DS1
  Gene Name: killer cell immunoglobulin-like receptor, three domains, short cytoplasmic tail, 1
  Uniprot ID: Q14943
  ENSP ID: ENSP00000477733
MSLMVVSMACVGLFLVQRAGPHMGGQDKPFLSAWPSAVVPRGGHVTLRCHYRHRFNNFMLYKEDRIHVPIFHGRIFQEGFNMSPVTTAHAGNYTCRGSHPHSPTGWSAPSNPMVIMVTGNHRKPSLLAHPGPLVKSGERVILQCWSDIMFEHFFLHKEWISKDPSRLVGQIHDGVSKANFSIGSMMRALAGTYRCYGSVTHTPYQLSAPSDPLDIVVTGLYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNLRHLHILIGTSVVKIPFTILLFFLLHRWCSNKKNAAVMDQEPAGNRSEQRGF

SEQ ID NO: 43792 - protein, 455 aa, Homo sapiens
  Payload ID: 8974
  Gene Symbol: KIR3DS1
  Gene Name: killer cell immunoglobulin-like receptor, three domains, short cytoplasmic tail, 1
  ENSP ID: ENSP00000477797
MSLMVVSMACVGFFLDQSVWAHVGGQDKPFLSAWPSAVVPRGGHVTLRCHYRHRFNNFMLYKEDRIHVPIFHGRIFQEGFNMSPVTTAHAGNYTCRGSHPHSPTGWSAPSNPMVIMVTGNHRKPSLLAHPGPLVKSGERVILQCWSDIMFEHFFLHREWISKDPSRLVGQIHDGVSKANFSIGSMMRALAGTYRCYGSVTHTPYQLSAPSDPLDIVVTGLYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGIRRHLHILIGTSVAIILFIILFFFLLHCCCSNKKNAAVMDQEPAGDRTVNREDSDDQDPQEVTYAQLDHCVFTQRKITPPSQRPKTPPTDTSMYIELPNAESRSKAVFCPRAPQSGLEGIF

SEQ ID NO: 43793 - protein, 382 aa, Homo sapiens
  Payload ID: 8974
  Gene Symbol: KIR3DS1
  Gene Name: killer cell immunoglobulin-like receptor, three domains, short cytoplasmic tail, 1
  ENSP ID: ENSP00000477819
MLLMVVSMACVGLFLVQRAGPHMGGQDKPFLSAWPSAVVPRGGHVTLRCHYRHRFNNFMLYKEDRIHVPIFHGRIFQEGFNMSPVTTAHAGNYTCRGSHPHSPTGWSAPSNPMVIMVTGNHRKPSLLAHPGPLVKSGERVILQCWSDIMFEHFFLHKEWISKDPSRLVGQIHDGVSKANFSIGSMMRALAGTYRCYGSVTHTPYQLSAPSDPLDIVVTGLYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNLRHLHILIGTSVVKIPFTILLFFLLHRWCSNKKKCCCNGPRACREQK

SEQ ID NO: 43794 - protein, 387 aa, Homo sapiens; identical to SEQ ID NO: 43791
  Payload ID: 8974
  Gene Symbol: KIR3DS1
  Gene Name: killer cell immunoglobulin-like receptor, three domains, short cytoplasmic tail, 1
  Uniprot ID: Q14943
  ENSP ID: ENSP00000477859

SEQ ID NO: 43795 - protein, 382 aa, Homo sapiens; identical to SEQ ID NO: 43793
  Payload ID: 8974
  Gene Symbol: KIR3DS1
  Gene Name: killer cell immunoglobulin-like receptor, three domains, short cytoplasmic tail, 1
  ENSP ID: ENSP00000478122

SEQ ID NO: 43796 - protein, 388 aa, Homo sapiens
  Payload ID: 8974
  Gene Symbol: KIR3DS1
  Gene Name: killer cell immunoglobulin-like receptor, three domains, short cytoplasmic tail, 1
  ENSP ID: ENSP00000479610
MLLMVVSMACVGLFLVQRAGPHMGGQDKPFLSAWPSAVVPRGGHVTLRCHYRHRFNNFMLYKEDRIHVPIFHGRIFQEGFNMSPVTTAHAGNYTCRGSHPHSPTGWSAPSNPMVIMVTGNHRKPSLLAHPGPLVKSGERVILQCWSDIMFEHFFLHKEWISKDPSRLVGQIHDGVSKANFSIGSMMRALAGTYRCYGSVTHTPYQLSAPSDPLDIVVTGLYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNLRHLHILIGTSVVKIPFTILLFFLLHRWCSNKKKNAAVMDQEPAGNRSEQRGF

SEQ ID NO: 43797 - protein, 388 aa, Homo sapiens; identical to SEQ ID NO: 43796
  Payload ID: 8974
  Gene Symbol: KIR3DS1
  Gene Name: killer cell immunoglobulin-like receptor, three domains, short cytoplasmic tail, 1
  ENSP ID: ENSP00000480070

SEQ ID NO: 43798 - protein, 387 aa, Homo sapiens; identical to SEQ ID NO: 43791
  Payload ID: 8974
  Gene Symbol: KIR3DS1
  Gene Name: killer cell immunoglobulin-like receptor, three domains, short cytoplasmic tail, 1
  Uniprot ID: Q14943
  ENSP ID: ENSP00000480199

SEQ ID NO: 43799 - protein, 382 aa, Homo sapiens; identical to SEQ ID NO: 43793
  Payload ID: 8974
  Gene Symbol: KIR3DS1
  Gene Name: killer cell immunoglobulin-like receptor, three domains, short cytoplasmic tail, 1
  ENSP ID: ENSP00000480225

SEQ ID NO: 43800 - protein, 287 aa, Homo sapiens
  Payload ID: 8974
  Gene Symbol: KIR3DS1
  Gene Name: killer cell immunoglobulin-like receptor, three domains, short cytoplasmic tail, 1
  ENSP ID: ENSP00000480346
MLLMVVSMACVGLFLVQRAGPHMGNHRKPSLLAHPGPLVKSGERVILQCWSDIMFEHFFLHKEWISKDPSRLVGQIHDGVSKANFSIGSMMRALAGTYRCYGSVTHTPYQLSAPSDPLDIVVTGLYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNLRHLHILIGTSVVKIPFTILLFFLLHRWCSNKKKCCCNGPRACREQK

SEQ ID NO: 43801 - protein, 388 aa, Homo sapiens; identical to SEQ ID NO: 43796
  Payload ID: 8974
  Gene Symbol: KIR3DS1
  Gene Name: killer cell immunoglobulin-like receptor, three domains, short cytoplasmic tail, 1
  ENSP ID: ENSP00000481739

SEQ ID NO: 43802 - protein, 382 aa, Homo sapiens
  Payload ID: 8974
  Gene Symbol: KIR3DS1
  Gene Name: killer cell immunoglobulin-like receptor, three domains, short cytoplasmic tail, 1
  ENSP ID: ENSP00000481772
MLLMVVSMACVGLFLVQRAGPHMGGQDKPFLSAWPSAVVPRGGHVTLRCHYRHRFNNFMLYKEDRIHVPIFHGRIFQEGFNMSPVTTAHAGNYTCRGSHPHSPTGWSAPSNPMVIMVTGNHRKPSLLAHPGPLVKSGERVILQCWSDIMFEHFFLHREWISKDPSRLVGQIHDGVSKANFSIGSMMRALAGTYRCYGSVTHTPYQLSAPSDPLDIVVTGLYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNLRHLHILIGTSVVKIPFTILLFFLLHRWCSNKKKCCCNGPRACREQK

SEQ ID NO: 43803 - protein, 387 aa, Homo sapiens; identical to SEQ ID NO: 43791
  Payload ID: 8974
  Gene Symbol: KIR3DS1
  Gene Name: killer cell immunoglobulin-like receptor, three domains, short cytoplasmic tail, 1
  Uniprot ID: Q14943
  ENSP ID: ENSP00000481993

SEQ ID NO: 43804 - protein, 382 aa, Homo sapiens; identical to SEQ ID NO: 43793
  Payload ID: 8974
  Gene Symbol: KIR3DS1
  Gene Name: killer cell immunoglobulin-like receptor, three domains, short cytoplasmic tail, 1
  ENSP ID: ENSP00000482441

SEQ ID NO: 43805 - protein, 382 aa, Homo sapiens; identical to SEQ ID NO: 43793
  Payload ID: 8974
  Gene Symbol: KIR3DS1
  Gene Name: killer cell immunoglobulin-like receptor, three domains, short cytoplasmic tail, 1
  ENSP ID: ENSP00000482507

SEQ ID NO: 43806 - protein, 388 aa, Homo sapiens; identical to SEQ ID NO: 43796
  Payload ID: 8974
  Gene Symbol: KIR3DS1
  Gene Name: killer cell immunoglobulin-like receptor, three domains, short cytoplasmic tail, 1
  ENSP ID: ENSP00000483082

SEQ ID NO: 43807 - protein, 387 aa, Homo sapiens; identical to SEQ ID NO: 43791
  Payload ID: 8974
  Gene Symbol: KIR3DS1
  Gene Name: killer cell immunoglobulin-like receptor, three domains, short cytoplasmic tail, 1
  Uniprot ID: Q14943
  ENSP ID: ENSP00000483460

SEQ ID NO: 43808 - protein, 387 aa, Homo sapiens; identical to SEQ ID NO: 43791
  Payload ID: 8974
  Gene Symbol: KIR3DS1
  Gene Name: killer cell immunoglobulin-like receptor, three domains, short cytoplasmic tail, 1
  Uniprot ID: Q14943
  ENSP ID: ENSP00000484010

SEQ ID NO: 43809 - protein, 387 aa, Homo sapiens
  Payload ID: 8974
  Gene Symbol: KIR3DS1
  Gene Name: killer cell immunoglobulin-like receptor, three domains, short cytoplasmic tail, 1
  ENSP ID: ENSP00000484756
MSLMVVSMACVGLFLVQRAGPHMGGQDKPFLSAWPSAVVPRGGHVTLRCHYRHRFNNFMLYKEDRIHVPIFHGRIFQEGFNMSPVTTAHAGNYTCRGSHPHSPTGWSAPSNPMVIMVTGNHRKPSLLAHPGPLVKSGERVILQCWSDIMFEHFFLHREWISKDPSRLVGQIHDGVSKANFSIGSMMRALAGTYRCYGSVTHTPYQLSAPSDPLDIVVTGLYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNLRHLHILIGTSVVKIPFTILLFFLLHRWCSNKKNAAVMDQEPAGNRSEQRGF

SEQ ID NO: 43810 - protein, 382 aa, Homo sapiens; identical to SEQ ID NO: 43793
  Payload ID: 8974
  Gene Symbol: KIR3DS1
  Gene Name: killer cell immunoglobulin-like receptor, three domains, short cytoplasmic tail, 1
  ENSP ID: ENSP00000484872

SEQ ID NO: 43811 - protein, 219 aa, Homo sapiens
  Payload ID: 8974
  Gene Symbol: KIR3DS1
  Gene Name: killer cell immunoglobulin-like receptor, three domains, short cytoplasmic tail, 1
  ENSP ID: ENSP00000484895
MLLMVVSMACVGFFLVQRAGPHMGGQDKPFLSAWPSAVVPRGGHVTLRCHYRHRFNNFMLYKEDRIHVPIFHGRIFQEGFNMSPVTTAHAGNYTCRGSHPHSPTGWSAPSNPMVIMVTGNHRKPSLLAHPGPLVKSGERVILQCWSDIMFEHFFLHKEGISKDPSRLVGQIHDGVSKANFSIGSMMRALAGTYRCYGSVTHTPYQLSAPSDPLDIVVTG

SEQ ID NO: 43812 - protein, 388 aa, Homo sapiens; identical to SEQ ID NO: 43796
  Payload ID: 8974
  Gene Symbol: KIR3DS1
  Gene Name: killer cell immunoglobulin-like receptor, three domains, short cytoplasmic tail, 1
  ENSP ID: ENSP00000485016

SEQ ID NO: 43813 - protein, 352 aa, Homo sapiens
  Payload ID: 8975
  Gene Symbol: KIR3DX1
  Gene Name: killer cell immunoglobulin-like receptor, three domains, X1
  Uniprot ID: Q9H7L2
  ENSP ID: ENSP00000221567
MAPKLITVLCLGFCLNQKICPHAGAQDKFSLSAWPSPVVPLGGRVTLSCHSHLRFVIWTIFQTTGTRSHELHTGLSNNITISPVTPEHAGTYRCVGIYKHASKWSAESNSLKIIVTGLFTKPSISAHPSSLVHAGARVSLRCHSELAFDEFILYKEGHIQHSQQLDQGMEAGIHYVEAVFSMGPVTPAHAGAYRCCGCFSHSRYEWSAPSDPLDIVITGKYKKPSLSTQVDPMMRLGEKLTLFCSSEISFDQYHLFRHGVAHGQWLSGGQRHREAFQANFSVGRATPVPGGTYRCYGSFNDSPYKPPVTRCNFTPQETLRVLLCHSQNPPLNLTHLALKDSPATCICSLDSQ

SEQ ID NO: 43814 - protein, 139 aa, Homo sapiens
  Payload ID: 8975
  Gene Symbol: KIR3DX1
  Gene Name: killer cell immunoglobulin-like receptor, three domains, X1
  ENSP ID: ENSP00000395115
MAPKLITVLCLGFCLNQKICPHAGAQDKFSLSAWPSPVVPLGGRVTLSCHSHLRFVIWTIFQTTGTRSHELHTGLSNNITISPVTPEHAGTYRCVGIYKHASKWSAESNSLKIIVTAFSLHPGGPHDEAGREVDPLLQL

SEQ ID NO: 43815 - protein, 133 aa, Homo sapiens
  Payload ID: 8975
  Gene Symbol: KIR3DX1
  Gene Name: killer cell immunoglobulin-like receptor, three domains, X1
  ENSP ID: ENSP00000396692
MAPKLITVLCLGFCLNQKICPHAGAQDKFSLSAWPSPVVPLGGRVTLSCHSHLRFVIWTIFQTTGTRSHELHTGLSNNITISPVTPEHAGTYRCVGIYKHASKWSAESNSLKIIVTGGPHDEAGREVDPLLQL

SEQ ID NO: 43816 - protein, 133 aa, Homo sapiens; identical to SEQ ID NO: 43815
  Payload ID: 8975
  Gene Symbol: KIR3DX1
  Gene Name: killer cell immunoglobulin-like receptor, three domains, X1
  ENSP ID: ENSP00000401224

SEQ ID NO: 43817 - protein, 139 aa, Homo sapiens; identical to SEQ ID NO: 43814
  Payload ID: 8975
  Gene Symbol: KIR3DX1
  Gene Name: killer cell immunoglobulin-like receptor, three domains, X1
  ENSP ID: ENSP00000477576

SEQ ID NO: 43818 - protein, 120 aa, Homo sapiens
  Payload ID: 8975
  Gene Symbol: KIR3DX1
  Gene Name: killer cell immunoglobulin-like receptor, three domains, X1
  ENSP ID: ENSP00000479045
  MOD_RES (1)..(1): Any amino acid
XEISFDQYHLFRHGVAHGQWLSGGQRHREAFQANFSVGRATPVPGGTYRCYGSFNDSPYKPPVTRCNFTPQETLRVLLCHSQNPPLNLTPPWQTQSPRKANGRMKRSLQQKRHRRSYMPS

SEQ ID NO: 43819 - protein, 352 aa, Homo sapiens; identical to SEQ ID NO: 43813
  Payload ID: 8975
  Gene Symbol: KIR3DX1
  Gene Name: killer cell immunoglobulin-like receptor, three domains, X1
  Uniprot ID: Q9H7L2
  ENSP ID: ENSP00000479122

SEQ ID NO: 43820 - protein, 365 aa, Homo sapiens
  Payload ID: 8975
  Gene Symbol: KIR3DX1
  Gene Name: killer cell immunoglobulin-like receptor, three domains, X1
  ENSP ID: ENSP00000479466
MAPKLITVLCLGFCLNQKICPHAGAQDKFSLSAWPSPVVPLGGRVTLSCHSHLRFVIWTIFQTTGTRSHELHTGLSNNITISPVTPEHAGTYRCVGIYKHASKWSAESNSLKIIVTGLFTKPSISAHPSSLVHAGARVSLRCHSELAFDEFILYKEGHIQHSQQLDQGMEAGIHYVEAVFSMGPVTPAHAGAYRCCGCFSHSRYEWSAPSDPLDIVITGKYKKPSLSTQVDPMMRLGEKLTLFCSSEISFDQYHLFRHGVAHGQWLSGGQRHREAFQANFSVGRATPVPGGTYRCYGSFNDSPYKPPVTRCNFTPQETLRVLLCHSQNPPLNLTPPWQTQSPRKANGRMKRSLQQKRHRRSYMPS

SEQ ID NO: 43821 - protein, 133 aa, Homo sapiens; identical to SEQ ID NO: 43815
  Payload ID: 8975
  Gene Symbol: KIR3DX1
  Gene Name: killer cell immunoglobulin-like receptor, three domains, X1
  ENSP ID: ENSP00000481832

SEQ ID NO: 43822 - protein, 352 aa, Homo sapiens; identical to SEQ ID NO: 43813
  Payload ID: 8975
  Gene Symbol: KIR3DX1
  Gene Name: killer cell immunoglobulin-like receptor, three domains, X1
  Uniprot ID: Q9H7L2
  ENSP ID: ENSP00000481872

SEQ ID NO: 43823 - protein, 365 aa, Homo sapiens; identical to SEQ ID NO: 43820
  Payload ID: 8975
  Gene Symbol: KIR3DX1
  Gene Name: killer cell immunoglobulin-like receptor, three domains, X1
  ENSP ID: ENSP00000482591

SEQ ID NO: 43824 - protein, 133 aa, Homo sapiens; identical to SEQ ID NO: 43815
  Payload ID: 8975
  Gene Symbol: KIR3DX1
  Gene Name: killer cell immunoglobulin-like receptor, three domains, X1
  ENSP ID: ENSP00000483894

SEQ ID NO: 43825 - protein, 352 aa, Homo sapiens; identical to SEQ ID NO: 43813
  Payload ID: 8975
  Gene Symbol: KIR3DX1
  Gene Name: killer cell immunoglobulin-like receptor, three domains, X1
  Uniprot ID: Q9H7L2
  ENSP ID: ENSP00000484242

SEQ ID NO: 43826 - protein, 120 aa, Homo sapiens; identical to SEQ ID NO: 43818
  Payload ID: 8975
  Gene Symbol: KIR3DX1
  Gene Name: killer cell immunoglobulin-like receptor, three domains, X1
  ENSP ID: ENSP00000484982
  MOD_RES (1)..(1): Any amino acid

SEQ ID NO: 43827 - protein, 374 aa, Homo sapiens
  Payload ID: 8976
  Gene Symbol: KIR2DL1
  Gene Name: killer cell immunoglobulin-like receptor, two domains, long cytoplasmic tail, 1
  Uniprot ID: P43626
  ENSP ID: ENSP00000291633
MSLLVVSMACVGFFLLQGAWPHEGVHRKPSLLAHPGRLVKSEETVILQCWSDVMFEHFLLHREGMFNDTLRLIGEHHDGVSKANFSISRMTQDLAGTYRCYGSVTHSPYQVSAPSDPLDIVIIGLYEKPSLSAQLGPTVLAGENVTLSCSSRSSYDMYHLSREGEAHERRLPAGPKVNGTFQADFPLGPATHGGTYRCFGSFHDSPYEWSKSSDPLLVSVTGNPSNSWPSPTEPSSKTERMFHHVGQACLKLPTSSDPTVSACQSNPRHLHILIGTSVVIILFILLFFLLHRWCSNKKNAAVMDQESAGNRTANSEDSDEQDPQEVTYTQLNHCVFTQRKITRPSQRPKTPPTDIIVYTELPNAESRSKVVSCP

SEQ ID NO: 43828 - protein, 348 aa, Homo sapiens
  Payload ID: 8976
  Gene Symbol: KIR2DL1
  Gene Name: killer cell immunoglobulin-like receptor, two domains, long cytoplasmic tail, 1
  ENSP ID: ENSP00000336769
MSLLVVSMACVGFFLLQGAWPHEGVHRKPSLLAHPGRLVKSEETVILQCWSDVMFEHFLLHREGMFNDTLRLIGEHHDGVSKANFSISRMTQDLAGTYRCYGSVTHSPYQVSAPSDPLDIVIIGLYEKPSLSAQLGPTVLAGENVTLSCSSRSSYDMYHLSREGEAHERRLPAGPKVNGTFQADFPLGPATHGGTYRCFGSFHDSPYEWSKSSDPLLVSVTGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYTELPNAESRSKVVSCP

SEQ ID NO: 43829 - protein, 348 aa, Homo sapiens; identical to SEQ ID NO: 43828
  Payload ID: 8976
  Gene Symbol: KIR2DL1
  Gene Name: killer cell immunoglobulin-like receptor, two domains, long cytoplasmic tail, 1
  ENSP ID: ENSP00000477690

SEQ ID NO: 43830 - protein, 348 aa, Homo sapiens; identical to SEQ ID NO: 43828
  Payload ID: 8976
  Gene Symbol: KIR2DL1
  Gene Name: killer cell immunoglobulin-like receptor, two domains, long cytoplasmic tail, 1
  ENSP ID: ENSP00000478054

SEQ ID NO: 43831 - protein, 348 aa, Homo sapiens; identical to SEQ ID NO: 43828
  Payload ID: 8976
  Gene Symbol: KIR2DL1
  Gene Name: killer cell immunoglobulin-like receptor, two domains, long cytoplasmic tail, 1
  ENSP ID: ENSP00000478202

SEQ ID NO: 43832 - protein, 348 aa, Homo sapiens
  Payload ID: 8976
  Gene Symbol: KIR2DL1
  Gene Name: killer cell immunoglobulin-like receptor, two domains, long cytoplasmic tail, 1
  Uniprot ID: P43626
  ENSP ID: ENSP00000478232
MSLLFVSMACVGFFLLQGAWPHEGVHRKPSLLAHPGPLVKSEETVILQCWSDVMFEHFLLHREGMFNDTLRLIGEHHDGVSKANFSISRMTQDLAGTYRCYGSVTHSPYQVSAPSDPLDIVIIGLYEKPSLSAQPGPTVLAGENVTLSCSSRSSYDMYHLSREGEAHERRLPAGPKVNGTFQADFPLGPATHGGTYRCFGSFHDSPYEWSKSSDPLLVSVTGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYTELPNAESRSKVVSCP

SEQ ID NO: 43833 - protein, 374 aa, Homo sapiens; identical to SEQ ID NO: 43827
  Payload ID: 8976
  Gene Symbol: KIR2DL1
  Gene Name: killer cell immunoglobulin-like receptor, two domains, long cytoplasmic tail, 1
  Uniprot ID: P43626
  ENSP ID: ENSP00000478263

SEQ ID NO: 43834 - protein, 348 aa, Homo sapiens; identical to SEQ ID NO: 43828
  Payload ID: 8976
  Gene Symbol: KIR2DL1
  Gene Name: killer cell immunoglobulin-like receptor, two domains, long cytoplasmic tail, 1
  ENSP ID: ENSP00000478567

SEQ ID NO: 43835 - protein, 348 aa, Homo sapiens; identical to SEQ ID NO: 43828
  Payload ID: 8976
  Gene Symbol: KIR2DL1
  Gene Name: killer cell immunoglobulin-like receptor, two domains, long cytoplasmic tail, 1
  ENSP ID: ENSP00000478604

SEQ ID NO: 43836 - protein, 348 aa, Homo sapiens; identical to SEQ ID NO: 43828
  Payload ID: 8976
  Gene Symbol: KIR2DL1
  Gene Name: killer cell immunoglobulin-like receptor, two domains, long cytoplasmic tail, 1
  ENSP ID: ENSP00000478633

SEQ ID NO: 43837 - protein, 348 aa, Homo sapiens
  Payload ID: 8976
  Gene Symbol: KIR2DL1
  Gene Name: killer cell immunoglobulin-like receptor, two domains, long cytoplasmic tail, 1
  ENSP ID: ENSP00000478895
MSLLVVSMACVGFFLLQGAWPHEGVHRKPSLLAHPGRLVKSEETVILQCWSDVMFEHFLLHREGMFNDTLRLIGEHHDGVSKANFSISRMTQDLAGTYRCYGSVTHSPYQVSAPSDPLDIVIIGLYEKPSLSAQPGPTVLAGENVTLSCSSRSSYDMYHLSREGEAHERRLPAGTKVNGTFQANFPLGPATHGGTYRCFGSFRDSPYEWSKSSDPLLVSVTGNPSNSWPSPTEPSSETGNPRHLHILIGTSVVIILFILLFFLLHCWCSNKKNAAVMDQESAGNRTANSEDSDEQDPQEVTYTQLNHCVFTQRKITRPSQRPKTPPTDIIVYTELPNAESRSKVVSCP

SEQ ID NO: 43838 - protein, 348 aa, Homo sapiens
  Payload ID: 8976
  Gene Symbol: KIR2DL1
  Gene Name: killer cell immunoglobulin-like receptor, two domains, long cytoplasmic tail, 1
  ENSP ID: ENSP00000478988
MSLMVVSMACVGFFLLQGAWPHEGVHRKPSLRAHPGPLVKSEETVILQCWSDVRFEHFLLHREGKFKDTLRLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYTELPNAESRSKVVSCP

SEQ ID NO: 43839 - protein, 348 aa, Homo sapiens; identical to SEQ ID NO: 43832
  Payload ID: 8976
  Gene Symbol: KIR2DL1
  Gene Name: killer cell immunoglobulin-like receptor, two domains, long cytoplasmic tail, 1
  Uniprot ID: P43626
  ENSP ID: ENSP00000479363

SEQ ID NO: 43840 - protein, 348 aa, Homo sapiens
  Payload ID: 8976
  Gene Symbol: KIR2DL1
  Gene Name: killer cell immunoglobulin-like receptor, two domains, long cytoplasmic tail, 1
  ENSP ID: ENSP00000479574
MSLLVVSMACVGFFLLQGAWPHEGVHRKPSLLAHPGRLVKSEETVILQCWSDVMFEHFLLHREGMFNDTLRLIGEHHDGVSKANFSISRMTQDLAGTYRCYGSVTHSPYQVSAPSDPLDIVIIGLYEKPSLSAQPGPTVLAGENVTLSCSSRSSYDMYHLSREGEAHERRLPAGPKVNGTFQADFPLGPATHGGTYRCFGSFHDSPYEWSKSSDPLLVSVTGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYTELPNAESRSKVVSCP

SEQ ID NO: 43841 - protein, 348 aa, Homo sapiens; identical to SEQ ID NO: 43828
  Payload ID: 8976
  Gene Symbol: KIR2DL1
  Gene Name: killer cell immunoglobulin-like receptor, two domains, long cytoplasmic tail, 1
  ENSP ID: ENSP00000479644

SEQ ID NO: 43842 - protein, 374 aa, Homo sapiens
  Payload ID: 8976
  Gene Symbol: KIR2DL1
  Gene Name: killer cell immunoglobulin-like receptor, two domains, long cytoplasmic tail, 1
  ENSP ID: ENSP00000479941
MSLLFVSMACVGFFLLQGAWPHEGVHRKPSLLAHPGPLVKSEETVILQCWSDVMFEHFLLHREGMFNDTLRLIGEHHDGVSKANFSISRMTQDLAGTYRCYGSVTHSPYQVSAPSDPLDIVIIGLYEKPSLSAQPGPTVLAGENVTLSCSSRSSYDMYHLSREGEAHERRLPAGPKVNGTFQADFPLGPATHGGTYRCFGSFHDSPYEWSKSSDPLLVSVTGNPSNSWPSPTEPSSKTERMFHHVGQACLKLPTSSDPTVSACQSNPRHLHILIGTSVVIILFILLFFLLHRWCSNKKNAAVMDQESAGNRTANSEDSDEQDPQEVTYTQLNHCVFTQRKITRPSQRPKTPPTDIIVYTELPNAESRSKVVSCP

SEQ ID NO: 43843 - protein, 348 aa, Homo sapiens; identical to SEQ ID NO: 43828
  Payload ID: 8976
  Gene Symbol: KIR2DL1
  Gene Name: killer cell immunoglobulin-like receptor, two domains, long cytoplasmic tail, 1
  ENSP ID: ENSP00000480247

SEQ ID NO: 43844 - protein, 348 aa, Homo sapiens; identical to SEQ ID NO: 43828
  Payload ID: 8976
  Gene Symbol: KIR2DL1
  Gene Name: killer cell immunoglobulin-like receptor, two domains, long cytoplasmic tail, 1
  ENSP ID: ENSP00000480989

SEQ ID NO: 43845 - protein, 348 aa, Homo sapiens; identical to SEQ ID NO: 43837
  Payload ID: 8976
  Gene Symbol: KIR2DL1
  Gene Name: killer cell immunoglobulin-like receptor, two domains, long cytoplasmic tail, 1
  ENSP ID: ENSP00000481123

SEQ ID NO: 43846 - protein, 374 aa, Homo sapiens
  Payload ID: 8976
  Gene Symbol: KIR2DL1
  Gene Name: killer cell immunoglobulin-like receptor, two domains, long cytoplasmic tail, 1
  ENSP ID: ENSP00000481187
MSLLVVSMACVGFFLLQGAWPHEGVHRKPSLLAHPGRLVKSEETVILQCWSDVMFEHFLLHREGMFNDTLRLIGEHHDGVSKANFSISRMTQDLAGTYRCYGSVTHSPYQVSAPSDPLDIVIIGLYEKPSLSAQPGPTVLAGENVTLSCSSRSSYDMYHLSREGEAHERRLPAGTKVNGTFQANFPLGPATHGGTYRCFGSFRDSPYEWSKSSDPLLVSVTGNPSNSWPSPTEPSSETERMFHHVGQACLKLPTSSDPTVSACQSNPRHLHILIGTSVVIILFILLFFLLHCWCSNKKNAAVMDQESAGNRTANSEDSDEQDPQEVTYTQLNHCVFTQRKITRPSQRPKTPPTDIIVYTELPNAESRSKVVSCP

SEQ ID NO: 43847 - protein, 116 aa, Homo sapiens
  Payload ID: 8976
  Gene Symbol: KIR2DL1
  Gene Name: killer cell immunoglobulin-like receptor, two domains, long cytoplasmic tail, 1
  ENSP ID: ENSP00000481722
  MOD_RES (1)..(1): Any amino acid
XSHLLPGNPRHLHILIGTSVVIILFILLFFLLHRWCSNKKNAAVMDQESAGNRTANSEDSDEQDPQEVTYTQLNHCVFTQRKITRPSQRPKTPPTDIIVYTELPNAESRSKVVSCP

SEQ ID NO: 43848 - protein, 348 aa, Homo sapiens; identical to SEQ ID NO: 43832
  Payload ID: 8976
  Gene Symbol: KIR2DL1
  Gene Name: killer cell immunoglobulin-like receptor, two domains, long cytoplasmic tail, 1
  Uniprot ID: P43626
  ENSP ID: ENSP00000482120

SEQ ID NO: 43849 - protein, 348 aa, Homo sapiens; identical to SEQ ID NO: 43828
  Payload ID: 8976
  Gene Symbol: KIR2DL1
  Gene Name: killer cell immunoglobulin-like receptor, two domains, long cytoplasmic tail, 1
  ENSP ID: ENSP00000482449

SEQ ID NO: 43850 - protein, 348 aa, Homo sapiens; identical to SEQ ID NO: 43837
  Payload ID: 8976
  Gene Symbol: KIR2DL1
  Gene Name: killer cell immunoglobulin-like receptor, two domains, long cytoplasmic tail, 1
  ENSP ID: ENSP00000482456

SEQ ID NO: 43851 - protein, 348 aa, Homo sapiens; identical to SEQ ID NO: 43828
  Payload ID: 8976
  Gene Symbol: KIR2DL1
  Gene Name: killer cell immunoglobulin-like receptor, two domains, long cytoplasmic tail, 1
  ENSP ID: ENSP00000482501

SEQ ID NO: 43852 - protein, 348 aa, Homo sapiens; identical to SEQ ID NO: 43828
  Payload ID: 8976
  Gene Symbol: KIR2DL1
  Gene Name: killer cell immunoglobulin-like receptor, two domains, long cytoplasmic tail, 1
  ENSP ID: ENSP00000482506

SEQ ID NO: 43853 - protein, 348 aa, Homo sapiens
  Payload ID: 8976
  Gene Symbol: KIR2DL1
  Gene Name: killer cell immunoglobulin-like receptor, two domains, long cytoplasmic tail, 1
  ENSP ID: ENSP00000483378
MSLMVVSMVCVGFFLLQGAWPHEGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYTELPNAESRSKVVSCP

SEQ ID NO: 43854 - protein, 348 aa, Homo sapiens; identical to SEQ ID NO: 43828
  Payload ID: 8976
  Gene Symbol: KIR2DL1
  Gene Name: killer cell immunoglobulin-like receptor, two domains, long cytoplasmic tail, 1
  ENSP ID: ENSP00000483525

SEQ ID NO: 43855 - protein, 374 aa, Homo sapiens; identical to SEQ ID NO: 43827
  Payload ID: 8976
  Gene Symbol: KIR2DL1
  Gene Name: killer cell immunoglobulin-like receptor, two domains, long cytoplasmic tail, 1
  Uniprot ID: P43626
  ENSP ID: ENSP00000484361

SEQ ID NO: 43856 - protein, 374 aa, Homo sapiens; identical to SEQ ID NO: 43827
  Payload ID: 8976
  Gene Symbol: KIR2DL1
  Gene Name: killer cell immunoglobulin-like receptor, two domains, long cytoplasmic tail, 1
  Uniprot ID: P43626
  ENSP ID: ENSP00000484559

SEQ ID NO: 43857 - protein, 348 aa, Homo sapiens
  Payload ID: 8976
  Gene Symbol: KIR2DL1
  Gene Name: killer cell immunoglobulin-like receptor, two domains, long cytoplasmic tail, 1
  ENSP ID: ENSP00000484582
MSLLVVSMACVGFFLLQGAWPHEGVHRKPSLLAHPGRLVKSEETVILQCWSDVMFEHFLLHREGMFNDTLRLIGEHHDGVSKANFSISRMTQDLAGTYRCYGSVTHSPYQVSAPSDPLDIVIIGLYEKPSLSAQPGPTVLAGENVTLSCSSRSSYDMYHLSREGEAHERRLPAGTKVNGTFQANFPLGPATHGGTYRCFGSFRDSPYEWSKSSDPLLVSVTGNPSNSWPSPTEPSSETGNPRHLHILIGTSVVIILFILLFFLLHRWCSNKKNAAVMDQESAGNRTANSEDSDEQDPQEVTYTQLNHCVFTQRKITRPSQRPKTPPTDIIVYTELPNAESRSKVVSCP

SEQ ID NO: 43858 - protein, 374 aa, Homo sapiens; identical to SEQ ID NO: 43842
  Payload ID: 8976
  Gene Symbol: KIR2DL1
  Gene Name: killer cell immunoglobulin-like receptor, two domains, long cytoplasmic tail, 1
  ENSP ID: ENSP00000484700

SEQ ID NO: 43859 - protein, 348 aa, Homo sapiens
  Payload ID: 8976
  Gene Symbol: KIR2DL1
  Gene Name: killer cell immunoglobulin-like receptor, two domains, long cytoplasmic tail, 1
  ENSP ID: ENSP00000484701
MSLLVVSMACVGFFLLQGAWPHEGVHRKPSLLAHPGRLVKSEETVILQCWSDVMFEHFLLHREGMFNDTLRLIGEHHDGVSKANFSISRMTQDLAGTYRCYGSVTHSPYQVSAPSDPLDIVIIGLYEKPSLSAQLGPTVLAGENVTLSCSSWSSYDMYHLSREGEAHERRLPAGPKVNGTFQADFPLGPATHGGTYRCFGSFHDSPYEWSKSSDPLLVSVTGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYTELPNAESRSKVVSCP

SEQ ID NO: 43860 - protein, 348 aa, Homo sapiens
  Payload ID: 8976
  Gene Symbol: KIR2DL1
  Gene Name: killer cell immunoglobulin-like receptor, two domains, long cytoplasmic tail, 1
  ENSP ID: ENSP00000484871
MSLLVVSMACVGFFLLQGAWPHEGVHRKPSLLAHPGRLVKSEETVILQCWSDVMFEHFLLHREGMFNDTLRLIGEHHDGVSKANFSISRMTQDLAGTYRCYGSVTHSPYQVSAPSDPLDVVIIGLYEKPSLSAQPGPTVLAGENVTLSCSSRSSYDMYHLSREGEAHERRLPAGTKVNGTFQANFPLGPATHGGTYRCFGSFRDSPYEWSKSSDPLLVSVTGNPSNSWPSPTEPSSETGNPRHLHILIGTSVVIILFILLFFLLHCWCSNKKNAAVMDQESAGNRTANSEDSDEQDPQEVTYTQLNHCVFTQRKITRPSQRPKTPPTDIIVYTELPNAESRSKVVSCP

SEQ ID NO: 43861 - protein, 348 aa, Homo sapiens
  Payload ID: 8977
  Gene Symbol: KIR2DL2
  Gene Name: killer cell immunoglobulin-like receptor, two domains, long cytoplasmic tail, 2
  ENSP ID: ENSP00000478169
MSLMVVSMACVGFFLLQGAWPHEGVHRKPSLLAHPGRLVKSEETVILQCWSDVRFEHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHECRFSAGPKVNGTFQADFPLGPATHGGTYRCFGSFRDSPYEWSNSSDPLLVSVTGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYTELPNAESRSKVVSCP

SEQ ID NO: 43862 - protein, 348 aa, Homo sapiens
  Payload ID: 8977
  Gene Symbol: KIR2DL2
  Gene Name: killer cell immunoglobulin-like receptor, two domains, long cytoplasmic tail, 2
  ENSP ID: ENSP00000478464
MSLMVVSMACVGFFLLQGAWPHEGVHRKPSLLAHPGPLVKSEETVILQCWSDVRFEHFLLHREGKYKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYAELPNAESRSKVVSCP

SEQ ID NO: 43863 - protein, 331 aa, Homo sapiens
  Payload ID: 8977
  Gene Symbol: KIR2DL2
  Gene Name: killer cell immunoglobulin-like receptor, two domains, long cytoplasmic tail, 2
  ENSP ID: ENSP00000479514
MSLMVVSMACVGFFLLQGAWPHEGVHRKPSLLAHPGRLVKSEETVILQCWSDVRFEHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHECRFSAGPKVNGTFQADFPLGPATHGGTYRCFGSFRDSPYEWSNSSDPLLVSVTGNPRHLHILIGTSVVIILFILLFFLLHRWCSNKKNAAVMDQESAGNRTANSEDSDEQDPQEVTYTQLNHCVFTQRKITRPSQRPKTPPTDIIVYTELPNAESRSKVVSCP

SEQ ID NO: 43864 - protein, 348 aa, Homo sapiens
  Payload ID: 8977
  Gene Symbol: KIR2DL2
  Gene Name: killer cell immunoglobulin-like receptor, two domains, long cytoplasmic tail, 2
  Uniprot ID: P43627
  ENSP ID: ENSP00000480161
MSLMVVSMACVGFFLLQGAWPHEGVHRKPSLLAHPGRLVKSEETVILQCWSDVRFEHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHECRFSAGPKVNGTFQADFPLGPATHGGTYRCFGSFRDSPYEWSNSSDPLLVSVIGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYAELPNAESRSKVVSCP

SEQ ID NO: 43865 - protein, 348 aa, Homo sapiens; identical to SEQ ID NO: 43861
  Payload ID: 8977
  Gene Symbol: KIR2DL2
  Gene Name: killer cell immunoglobulin-like receptor, two domains, long cytoplasmic tail, 2
  ENSP ID: ENSP00000480495

SEQ ID NO: 43866 - protein, 348 aa, Homo sapiens; identical to SEQ ID NO: 43862
  Payload ID: 8977
  Gene Symbol: KIR2DL2
  Gene Name: killer cell immunoglobulin-like receptor, two domains, long cytoplasmic tail, 2
  ENSP ID: ENSP00000480924

SEQ ID NO: 43867 - protein, 348 aa, Homo sapiens; identical to SEQ ID NO: 43861
  Payload ID: 8977
  Gene Symbol: KIR2DL2
  Gene Name: killer cell immunoglobulin-like receptor, two domains, long cytoplasmic tail, 2
  ENSP ID: ENSP00000481124

SEQ ID NO: 43868 - protein, 348 aa, Homo sapiens; identical to SEQ ID NO: 43861
  Payload ID: 8977
  Gene Symbol: KIR2DL2
  Gene Name: killer cell immunoglobulin-like receptor, two domains, long cytoplasmic tail, 2
  ENSP ID: ENSP00000481696

SEQ ID NO: 43869 - protein, 304 aa, Homo sapiens
  Payload ID: 8977
  Gene Symbol: KIR2DL2
  Gene Name: killer cell immunoglobulin-like receptor, two domains, long cytoplasmic tail, 2
  ENSP ID: ENSP00000481757
MSLMVVSMACVGFFLLQGAWPHEGVHRKPSLLAHPGRLVKSEETVILQCWSDVRFEHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHECRFSAGPKVNGTFQADFPLGPATHGGTYRCFGSFRDSPYEWSNSSDPLLVSVTGNPSNSWPSPTEPSSKTGNPRHLHVLIGTSVVKIPFTILLFFLLHRWCSDKKNAAVMDQEPAGNRTVNSEDSDEQDHQEVSYA

SEQ ID NO: 43870 - protein, 348 aa, Homo sapiens; identical to SEQ ID NO: 43864
  Payload ID: 8977
  Gene Symbol: KIR2DL2
  Gene Name: killer cell immunoglobulin-like receptor, two domains, long cytoplasmic tail, 2
  Uniprot ID: P43627
  ENSP ID: ENSP00000481907

SEQ ID NO: 43871 - protein, 348 aa, Homo sapiens; identical to SEQ ID NO: 43864
  Payload ID: 8977
  Gene Symbol: KIR2DL2
  Gene Name: killer cell immunoglobulin-like receptor, two domains, long cytoplasmic tail, 2
  Uniprot ID: P43627
  ENSP ID: ENSP00000482201

SEQ ID NO: 43872 - protein, 348 aa, Homo sapiens; identical to SEQ ID NO: 43861
  Payload ID: 8977
  Gene Symbol: KIR2DL2
  Gene Name: killer cell immunoglobulin-like receptor, two domains, long cytoplasmic tail, 2
  ENSP ID: ENSP00000482387

SEQ ID NO: 43873 - protein, 348 aa, Homo sapiens; identical to SEQ ID NO: 43864
  Payload ID: 8977
  Gene Symbol: KIR2DL2
  Gene Name: killer cell immunoglobulin-like receptor, two domains, long cytoplasmic tail, 2
  Uniprot ID: P43627
  ENSP ID: ENSP00000482519

SEQ ID NO: 43874 - protein, 348 aa, Homo sapiens; identical to SEQ ID NO: 43861
  Payload ID: 8977
  Gene Symbol: KIR2DL2
  Gene Name: killer cell immunoglobulin-like receptor, two domains, long cytoplasmic tail, 2
  ENSP ID: ENSP00000482672

SEQ ID NO: 43875 - protein, 348 aa, Homo sapiens; identical to SEQ ID NO: 43864
  Payload ID: 8977
  Gene Symbol: KIR2DL2
  Gene Name: killer cell immunoglobulin-like receptor, two domains, long cytoplasmic tail, 2
  Uniprot ID: P43627
  ENSP ID: ENSP00000483052

SEQ ID NO: 43876 - protein, 348 aa, Homo sapiens; identical to SEQ ID NO: 43861
  Payload ID: 8977
  Gene Symbol: KIR2DL2
  Gene Name: killer cell immunoglobulin-like receptor, two domains, long cytoplasmic tail, 2
  ENSP ID: ENSP00000483233

SEQ ID NO: 43877 - protein, 348 aa, Homo sapiens; identical to SEQ ID NO: 43864
  Payload ID: 8977
  Gene Symbol: KIR2DL2
  Gene Name: killer cell immunoglobulin-like receptor, two domains, long cytoplasmic tail, 2
  Uniprot ID: P43627
  ENSP ID: ENSP00000483373

SEQ ID NO: 43878 - protein, 248 aa, Homo sapiens
  Payload ID: 8977
  Gene Symbol: KIR2DL2
  Gene Name: killer cell immunoglobulin-like receptor, two domains, long cytoplasmic tail, 2
  ENSP ID: ENSP00000483572
MSLMVVSMACVGFFLLQGAWPHEGLYEKPSLSAQPGPTVLAGESVTLSCSSRSSYDMYHLSREGEAHECRFSAGPKVNGTFQADFPLGPATHGGTYRCFGSFRDSPYEWSNSSDPLLVSVTGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYTELPNAESRSKVVSCP

SEQ ID NO: 43879 - protein, 348 aa, Homo sapiens; identical to SEQ ID NO: 43861
  Payload ID: 8977
  Gene Symbol: KIR2DL2
  Gene Name: killer cell immunoglobulin-like receptor, two domains, long cytoplasmic tail, 2
  ENSP ID: ENSP00000483945

SEQ ID NO: 43880 - protein, 348 aa, Homo sapiens; identical to SEQ ID NO: 43861
  Payload ID: 8977
  Gene Symbol: KIR2DL2
  Gene Name: killer cell immunoglobulin-like receptor, two domains, long cytoplasmic tail, 2
  ENSP ID: ENSP00000484145

SEQ ID NO: 43881 - protein, 348 aa, Homo sapiens; identical to SEQ ID NO: 43861
  Payload ID: 8977
  Gene Symbol: KIR2DL2
  Gene Name: killer cell immunoglobulin-like receptor, two domains, long cytoplasmic tail, 2
  ENSP ID: ENSP00000484319

SEQ ID NO: 43882 - protein, 348 aa, Homo sapiens; identical to SEQ ID NO: 43861
  Payload ID: 8977
  Gene Symbol: KIR2DL2
  Gene Name: killer cell immunoglobulin-like receptor, two domains, long cytoplasmic tail, 2
  ENSP ID: ENSP00000484349

SEQ ID NO: 43883 - protein, 348 aa, Homo sapiens; identical to SEQ ID NO: 43862
  Payload ID: 8977
  Gene Symbol: KIR2DL2
  Gene Name: killer cell immunoglobulin-like receptor, two domains, long cytoplasmic tail, 2
  ENSP ID: ENSP00000484563

SEQ ID NO: 43884 - protein, 348 aa, Homo sapiens; identical to SEQ ID NO: 43861
  Payload ID: 8977
  Gene Symbol: KIR2DL2
  Gene Name: killer cell immunoglobulin-like receptor, two domains, long cytoplasmic tail, 2
  ENSP ID: ENSP00000484717

SEQ ID NO: 43885 - protein, 341 aa, Homo sapiens
  Payload ID: 8978
  Gene Symbol: KIR2DL3
  Gene Name: killer cell immunoglobulin-like receptor, two domains, long cytoplasmic tail, 3
  Uniprot ID: P43628
  ENSP ID: ENSP00000342215
MSLMVVSMVCVGFFLLQGAWPHEGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSETGNPRHLHVLIGTSVVIILFILLLFFLLHRWCCNKKNAVVMDQEPAGNRTVNREDSDEQDPQEVTYAQLNHCVFTQRKITRPSQRPKTPPTDIIVYTELPNAEP

SEQ ID NO: 43886 - protein, 349 aa, Homo sapiens
  Payload ID: 8978
  Gene Symbol: KIR2DL3
  Gene Name: killer cell immunoglobulin-like receptor, two domains, long cytoplasmic tail, 3
  ENSP ID: ENSP00000477890
MSLMVVSMACVGFFLLQGAWPHEGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLHVLIGTSVVIILFILLLFFLLHRWCSNKKNAAVMDQEPAGNRTANSEDSDEQDPQEVTYVQLDHCVFTQRKITRPSQRPKTPPTDTRVYTELPNAESRSKVVSCP

SEQ ID NO: 43887 - protein, 349 aa, Homo sapiens
  Payload ID: 8978
  Gene Symbol: KIR2DL3
  Gene Name: killer cell immunoglobulin-like receptor, two domains, long cytoplasmic tail, 3
  ENSP ID: ENSP00000477942
MSLMVVSMACVGFFLLQGAWPHEGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSETGNPRHLHVLIGTSVVIILFILLLFFLLHRWCSNKKNAAVMDQEPAGNRTANSEDSDEQDPQEVTYVQLDHCVFTQRKITRPSQRPKTPPTDTRVYTELPNAESRSKVVSCP

SEQ ID NO: 43888 - protein, 341 aa, Homo sapiens
  Payload ID: 8978
  Gene Symbol: KIR2DL3
  Gene Name: killer cell immunoglobulin-like receptor, two domains, long cytoplasmic tail, 3
  Uniprot ID: P43628
  ENSP ID: ENSP00000478136
MSLMVVSMVCVGFFLLQGAWPHEGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWLSPTEPSSETGNPRHLHVLIGTSVVIILFILLLFFLLHRWCCNKKNAVVMDQEPAGNRTVNREDSDEQDPQEVTYAQLNHCVFTQRKITHPSQRPKTPPTDIIVYTELPNAEP

SEQ ID NO: 43889 - protein, 349 aa, Homo sapiens; identical to SEQ ID NO: 43886
  Payload ID: 8978
  Gene Symbol: KIR2DL3
  Gene Name: killer cell immunoglobulin-like receptor, two domains, long cytoplasmic tail, 3
  ENSP ID: ENSP00000478312

SEQ ID NO: 43890 - protein, 341 aa, Homo sapiens; identical to SEQ ID NO: 43885
  Payload ID: 8978
  Gene Symbol: KIR2DL3
  Gene Name: killer cell immunoglobulin-like receptor, two domains, long cytoplasmic tail, 3
  Uniprot ID: P43628
  ENSP ID: ENSP00000478657

SEQ ID NO: 43891 - protein, 341 aa, Homo sapiens; identical to SEQ ID NO: 43888
  Payload ID: 8978
  Gene Symbol: KIR2DL3
  Gene Name: killer cell immunoglobulin-like receptor, two domains, long cytoplasmic tail, 3
  Uniprot ID: P43628
  ENSP ID: ENSP00000478848

SEQ ID NO: 43892 - protein, 349 aa, Homo sapiens
  Payload ID: 8978
  Gene Symbol: KIR2DL3
  Gene Name: killer cell immunoglobulin-like receptor, two domains, long cytoplasmic tail, 3
  ENSP ID: ENSP00000479070
MSLMVVSMACVGFFLLQGAWPHEGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWLSPTEPSSETGNPRHLHVLIGTSVVIILFILLLFFLLHRWCSNKKNAAVMDQEPAGNRTANSEDSDEQDPQEVTYVQLDHCVFTQRKITRPSQRPKTPPTDTRVYTELPNAESRSKVVSCP

SEQ ID NO: 43893 - protein, 341 aa, Homo sapiens; identical to SEQ ID NO: 43885
  Payload ID: 8978
  Gene Symbol: KIR2DL3
  Gene Name: killer cell immunoglobulin-like receptor, two domains, long cytoplasmic tail, 3
  Uniprot ID: P43628
  ENSP ID: ENSP00000479121

SEQ ID NO: 43894 - protein, 349 aa, Homo sapiens; identical to SEQ ID NO: 43886
  Payload ID: 8978
  Gene Symbol: KIR2DL3
  Gene Name: killer cell immunoglobulin-like receptor, two domains, long cytoplasmic tail, 3
  ENSP ID: ENSP00000479952

SEQ ID NO: 43895 - protein, 349 aa, Homo sapiens; identical to SEQ ID NO: 43886
  Payload ID: 8978
  Gene Symbol: KIR2DL3
  Gene Name: killer cell immunoglobulin-like receptor, two domains, long cytoplasmic tail, 3
  ENSP ID: ENSP00000479967

SEQ ID NO: 43896 - protein, 341 aa, Homo sapiens; identical to SEQ ID NO: 43885
  Payload ID: 8978
  Gene Symbol: KIR2DL3
  Gene Name: killer cell immunoglobulin-like receptor, two domains, long cytoplasmic tail, 3
  Uniprot ID: P43628
  ENSP ID: ENSP00000480087

SEQ ID NO: 43897 - protein, 349 aa, Homo sapiens; identical to SEQ ID NO: 43886
  Payload ID: 8978
  Gene Symbol: KIR2DL3
  Gene Name: killer cell immunoglobulin-like receptor, two domains, long cytoplasmic tail, 3
  ENSP ID: ENSP00000480400

SEQ ID NO: 43898 - protein, 341 aa, Homo sapiens; identical to SEQ ID NO: 43885
  Payload ID: 8978
  Gene Symbol: KIR2DL3
  Gene Name: killer cell immunoglobulin-like receptor, two domains, long cytoplasmic tail, 3
  Uniprot ID: P43628
  ENSP ID: ENSP00000480464

SEQ ID NO: 43899 - protein, 349 aa, Homo sapiens; identical to SEQ ID NO: 43886
  Payload ID: 8978
  Gene Symbol: KIR2DL3
  Gene Name: killer cell immunoglobulin-like receptor, two domains, long cytoplasmic tail, 3
  ENSP ID: ENSP00000480911

SEQ ID NO: 43900 - protein, 341 aa, Homo sapiens; identical to SEQ ID NO: 43888
  Payload ID: 8978
  Gene Symbol: KIR2DL3
  Gene Name: killer cell immunoglobulin-like receptor, two domains, long cytoplasmic tail, 3
  Uniprot ID: P43628
  ENSP ID: ENSP00000481159

SEQ ID NO: 43901 - protein, 341 aa, Homo sapiens; identical to SEQ ID NO: 43885
  Payload ID: 8978
  Gene Symbol: KIR2DL3
  Gene Name: killer cell immunoglobulin-like receptor, two domains, long cytoplasmic tail, 3
  Uniprot ID: P43628
  ENSP ID: ENSP00000481237

SEQ ID NO: 43902 - protein, 349 aa, Homo sapiens
  Payload ID: 8978
  Gene Symbol: KIR2DL3
  Gene Name: killer cell immunoglobulin-like receptor, two domains, long cytoplasmic tail, 3
  ENSP ID: ENSP00000481267
MSLMVVSMVCVGFFLLQGAWPHEGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLHVLIGTSVVIILFILLLFFLLHRWCSNKKNAAVMDQEPAGNRTANSEDSDEQDPQEVTYVQLDHCVFTQRKITRPSQRPKTPPTDTRVYTELPNAESRSKVVSCP

SEQ ID NO: 43903 - protein, 341 aa, Homo sapiens; identical to SEQ ID NO: 43885
  Payload ID: 8978
  Gene Symbol: KIR2DL3
  Gene Name: killer cell immunoglobulin-like receptor, two domains, long cytoplasmic tail, 3
  Uniprot ID: P43628
  ENSP ID: ENSP00000481355

SEQ ID NO: 43904 - protein, 349 aa, Homo sapiens; identical to SEQ ID NO: 43886
  Payload ID: 8978
  Gene Symbol: KIR2DL3
  Gene Name: killer cell immunoglobulin-like receptor, two domains, long cytoplasmic tail, 3
  ENSP ID: ENSP00000481437

SEQ ID NO: 43905 - protein, 341 aa, Homo sapiens; identical to SEQ ID NO: 43885
  Payload ID: 8978
  Gene Symbol: KIR2DL3
  Gene Name: killer cell immunoglobulin-like receptor, two domains, long cytoplasmic tail, 3
  Uniprot ID: P43628
  ENSP ID: ENSP00000481478

SEQ ID NO: 43906 - protein, 341 aa, Homo sapiens
  Payload ID: 8978
  Gene Symbol: KIR2DL3
  Gene Name: killer cell immunoglobulin-like receptor, two domains, long cytoplasmic tail, 3
  ENSP ID: ENSP00000482248
MSLMVVSMVCVGFFLLQGAWPHEGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSETGNPRHLHVLIGTSVVIILFILLLFFLLHRWCCNKKNAVVMDQEPAGNRTVNREDSDEQDPQEVTYAQLNHCVFTQRKITHPSQRPKTPPTDIIVYTELPNAEP

SEQ ID NO: 43907 - protein, 349 aa, Homo sapiens; identical to SEQ ID NO: 43886
  Payload ID: 8978
  Gene Symbol: KIR2DL3
  Gene Name: killer cell immunoglobulin-like receptor, two domains, long cytoplasmic tail, 3
  ENSP ID: ENSP00000482509

SEQ ID NO: 43908 - protein, 349 aa, Homo sapiens; identical to SEQ ID NO: 43886
  Payload ID: 8978
  Gene Symbol: KIR2DL3
  Gene Name: killer cell immunoglobulin-like receptor, two domains, long cytoplasmic tail, 3
  ENSP ID: ENSP00000482813

SEQ ID NO: 43909 - protein, 341 aa, Homo sapiens; identical to SEQ ID NO: 43885
  Payload ID: 8978
  Gene Symbol: KIR2DL3
  Gene Name: killer cell immunoglobulin-like receptor, two domains, long cytoplasmic tail, 3
  Uniprot ID: P43628
  ENSP ID: ENSP00000482830

SEQ ID NO: 43910 - protein, 348 aa, Homo sapiens; identical to SEQ ID NO: 43853
  Payload ID: 8978
  Gene Symbol: KIR2DL3
  Gene Name: killer cell immunoglobulin-like receptor, two domains, long cytoplasmic tail, 3
  ENSP ID: ENSP00000482936

SEQ ID NO: 43911 - protein, 341 aa, Homo sapiens; identical to SEQ ID NO: 43885
  Payload ID: 8978
  Gene Symbol: KIR2DL3
  Gene Name: killer cell immunoglobulin-like receptor, two domains, long cytoplasmic tail, 3
  Uniprot ID: P43628
  ENSP ID: ENSP00000483192

SEQ ID NO: 43912 - protein, 349 aa, Homo sapiens; identical to SEQ ID NO: 43886
  Payload ID: 8978
  Gene Symbol: KIR2DL3
  Gene Name: killer cell immunoglobulin-like receptor, two domains, long cytoplasmic tail, 3
  ENSP ID: ENSP00000483242

SEQ ID NO: 43913 - protein, 341 aa, Homo sapiens; identical to SEQ ID NO: 43885
  Payload ID: 8978
  Gene Symbol: KIR2DL3
  Gene Name: killer cell immunoglobulin-like receptor, two domains, long cytoplasmic tail, 3
  Uniprot ID: P43628
  ENSP ID: ENSP00000483419

SEQ ID NO: 43914 - protein, 349 aa, Homo sapiens; identical to SEQ ID NO: 43886
  Payload ID: 8978
  Gene Symbol: KIR2DL3
  Gene Name: killer cell immunoglobulin-like receptor, two domains, long cytoplasmic tail, 3
  ENSP ID: ENSP00000483442

SEQ ID NO: 43915 - protein, 349 aa, Homo sapiens; identical to SEQ ID NO: 43886
  Payload ID: 8978
  Gene Symbol: KIR2DL3
  Gene Name: killer cell immunoglobulin-like receptor, two domains, long cytoplasmic tail, 3
  ENSP ID: ENSP00000483447

SEQ ID NO: 43916 - protein, 349 aa, Homo sapiens; identical to SEQ ID NO: 43886
  Payload ID: 8978
  Gene Symbol: KIR2DL3
  Gene Name: killer cell immunoglobulin-like receptor, two domains, long cytoplasmic tail, 3
  ENSP ID: ENSP00000483475

SEQ ID NO: 43917 - protein, 341 aa, Homo sapiens; identical to SEQ ID NO: 43885
  Payload ID: 8978
  Gene Symbol: KIR2DL3
  Gene Name: killer cell immunoglobulin-like receptor, two domains, long cytoplasmic tail, 3
  Uniprot ID: P43628
  ENSP ID: ENSP00000483551

SEQ ID NO: 43918 - protein, 349 aa, Homo sapiens; identical to SEQ ID NO: 43886
  Payload ID: 8978
  Gene Symbol: KIR2DL3
  Gene Name: killer cell immunoglobulin-like receptor, two domains, long cytoplasmic tail, 3
  ENSP ID: ENSP00000483582

SEQ ID NO: 43919 - protein, 341 aa, Homo sapiens; identical to SEQ ID NO: 43885
  Payload ID: 8978
  Gene Symbol: KIR2DL3
  Gene Name: killer cell immunoglobulin-like receptor, two domains, long cytoplasmic tail, 3
  Uniprot ID: P43628
  ENSP ID: ENSP00000483883

SEQ ID NO: 43920 - protein, 341 aa, Homo sapiens; identical to SEQ ID NO: 43885
  Payload ID: 8978
  Gene Symbol: KIR2DL3
  Gene Name: killer cell immunoglobulin-like receptor, two domains, long cytoplasmic tail, 3
  Uniprot ID: P43628
  ENSP ID: ENSP00000483975

SEQ ID NO: 43921 - protein, 349 aa, Homo sapiens
  Payload ID: 8978
  Gene Symbol: KIR2DL3
  Gene Name: killer cell immunoglobulin-like receptor, two domains, long cytoplasmic tail, 3
  ENSP ID: ENSP00000484051
MSLMVVSMACVGFFLLQGAWPHEGVHRKPSLRAHPGPLVKSEETVILQCWSDVRFEHFLLHREGKFKDTLRLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLHVLIGTSVVIILFVLLLFFLLHRWCSNKKNAVVMDQEPAGNRTVNREDSDEQDPQEVTYAQLNHCVFTQRKITRPSQRPKTPPTDIIVYTELPNAEPRSKVVSCP

SEQ ID NO: 43922 - protein, 349 aa, Homo sapiens; identical to SEQ ID NO: 43887
  Payload ID: 8978
  Gene Symbol: KIR2DL3
  Gene Name: killer cell immunoglobulin-like receptor, two domains, long cytoplasmic tail, 3
  ENSP ID: ENSP00000484126

SEQ ID NO: 43923 - protein, 341 aa, Homo sapiens; identical to SEQ ID NO: 43885
  Payload ID: 8978
  Gene Symbol: KIR2DL3
  Gene Name: killer cell immunoglobulin-like receptor, two domains, long cytoplasmic tail, 3
  Uniprot ID: P43628
  ENSP ID: ENSP00000484459

SEQ ID NO: 43924 - protein, 349 aa, Homo sapiens
  Payload ID: 8978
  Gene Symbol: KIR2DL3
  Gene Name: killer cell immunoglobulin-like receptor, two domains, long cytoplasmic tail, 3
  ENSP ID: ENSP00000484947
MSLMVVSMVCVGFFLLQGAWPHEGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGSPRHLHVLIGTSVVIILFILLLFFLLHRWCSNKKNAAVMDQEPAGNRTANSEDSDEQDPQEVTYVQLDHCVFTQRKITRPSQRPKTPPTDTRVYTELPNAESRSKVVSCP

SEQ ID NO: 43925 - protein, 342 aa, Homo sapiens
  Payload ID: 8979
  Gene Symbol: KIR2DL4
  Gene Name: killer cell immunoglobulin-like receptor, two domains, long cytoplasmic tail, 4
  Uniprot ID: Q99706
  ENSP ID: ENSP00000339634
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43926 - protein, 247 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000345331
MSMSPTVIILACLGFFLDQSVWAHVGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43927 - protein, 325 aa, Homo sapiens
  Payload ID: 8979
  Gene Symbol: KIR2DL4
  Gene Name: killer cell immunoglobulin-like receptor, two domains, long cytoplasmic tail, 4
  Uniprot ID: Q99706
  ENSP ID: ENSP00000350088
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43928 - protein, 273 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000351988
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKMLL

SEQ ID NO: 43929 - protein, 416 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000379580
MSPSHVVVNVSTARSGPLTTSSAPVSRAESLRPGSRSCTMSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43930 - protein, 398 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000379584
  MOD_RES (1)..(1): Any amino acid
XMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKVSLTKQRPENSGPCAEAGWEHADAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43931 - protein, 230 aa, Homo sapiens
  Payload ID: 8979
  Gene Symbol: KIR2DL4
  Gene Name: killer cell immunoglobulin-like receptor, two domains, long cytoplasmic tail, 4
  Uniprot ID: Q99706
  ENSP ID: ENSP00000379588
MSMSPTVIILACLGFFLDQSVWAHVGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43932 - protein, 312 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000477505
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRTGENVTLSCSSQSSFDIYHLSREGEAHELRLPAVPSINGTFQADFPLGPATHGETYRCFGSFHGSPYEWSDASDPLPVSVTGNPSSSWPSPTEPSFKTGIARHLHAVIRYSVAIILFTILPFFLLHRWCSKKKSKPHEAEARELRALCGSRMGARRCCCNEPRACGTQNSEQGGL

SEQ ID NO: 43933 - protein, 245 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000477525
MSPTVIILACLGFFLDQSVWAHVGLYEKPSLTARPGPTVRTGENVTLSCSSQSSFDIYHLSREGEAHELRLPAVPSINGTFQADFPLGPATHGETYRCFGSFHGSPYEWSDASDPLPVSVTGNPSSSWPSPTEPSFKTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43934 - protein, 230 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000477552
MSMSPTVIILACLGFFLDQSVWAHVGLYEKPSLTARPGPTVRTGENVTLSCSSQSSFDIYHLSREGEAHELRLPAVPSINGTFQADFPLGPATHGETYRCFGSFHGSPYEWSDASDPLPVSVTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43935 - protein, 245 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000477560
MSPTVIILACLGFFLDQSVWAHVGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43936 - protein, 377 aa, Homo sapiens
  Payload ID: 8979
  Gene Symbol: KIR2DL4
  Gene Name: killer cell immunoglobulin-like receptor, two domains, long cytoplasmic tail, 4
  Uniprot ID: Q99706
  ENSP ID: ENSP00000477601
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRTGENVTLSCSSQSSFDIYHLSREGEAHELRLPAVPSINGTFQADFPLGPATHGETYRCFGSFHGSPYEWSDASDPLPVSVTGNPSSSWPSPTEPSFKTGIARHLHAVIRYSVAIILFTILPFFLLHRWCSKKKNAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43937 - protein, 397 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000477790
MSLMVVSMACVGFFLDQSVWAHVGGQDKPFCSAWPSAVVPQGGHVTLRCHCRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKVSLTKQRPENSGPCAEAGWEHADAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43938 - protein, 416 aa, Homo sapiens; identical to SEQ ID NO: 43929
  Payload ID: 8979
  Gene Symbol: KIR2DL4
  Gene Name: killer cell immunoglobulin-like receptor, two domains, long cytoplasmic tail, 4
  ENSP ID: ENSP00000477834

SEQ ID NO: 43939 - protein, 377 aa, Homo sapiens; identical to SEQ ID NO: 43936
  Payload ID: 8979
  Gene Symbol: KIR2DL4
  Gene Name: killer cell immunoglobulin-like receptor, two domains, long cytoplasmic tail, 4
  Uniprot ID: Q99706
  ENSP ID: ENSP00000477886

SEQ ID NO: 43940 - protein, 377 aa, Homo sapiens; identical to SEQ ID NO: 43936
  Payload ID: 8979
  Gene Symbol: KIR2DL4
  Gene Name: killer cell immunoglobulin-like receptor, two domains, long cytoplasmic tail, 4
  Uniprot ID: Q99706
  ENSP ID: ENSP00000477887

SEQ ID NO: 43941 - protein, 342 aa, Homo sapiens; identical to SEQ ID NO: 43925
  Payload ID: 8979
  Gene Symbol: KIR2DL4
  Gene Name: killer cell immunoglobulin-like receptor, two domains, long cytoplasmic tail, 4
  Uniprot ID: Q99706
  ENSP ID: ENSP00000477984

SEQ ID NO: 43942 - protein, 342 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000478048
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRTGENVTLSCSSQSSFDIYHLSREGEAHELRLPAVPSINGTFQADFPLGPATHGETYRCFGSFHGSPYEWSDASDPLPVSVTGNPSSSWPSPTEPSFKTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43943 - protein, 273 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000478144
MSMSPTVIILACLGFFLDQSVWAHVGGQDKPFCSAWPSAVVPQGGHVTLRCHCRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKMLL

SEQ ID NO: 43944 - protein, 246 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000478275
  MOD_RES (1)..(1): Any amino acid
XMSPTVIILACLGFFLDQSVWAHVGLYEKPSLTARPGPTVRTGENVTLSCSSQSSFDIYHLSREGEAHELRLPAVPSINGTFQADFPLGPATHGETYRCFGSFHGSPYEWSDASDPLPVSVTGNPSSSWPSPTEPSFKTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43945 - protein, 377 aa, Homo sapiens; identical to SEQ ID NO: 43936
  Payload ID: 8979
  Gene Symbol: KIR2DL4
  Gene Name: killer cell immunoglobulin-like receptor, two domains, long cytoplasmic tail, 4
  Uniprot ID: Q99706
  ENSP ID: ENSP00000478362

SEQ ID NO: 43946 - protein, 377 aa, Homo sapiens; identical to SEQ ID NO: 43936
  Payload ID: 8979
  Gene Symbol: KIR2DL4
  Gene Name: killer cell immunoglobulin-like receptor, two domains, long cytoplasmic tail, 4
  Uniprot ID: Q99706
  ENSP ID: ENSP00000478491

SEQ ID NO: 43947 - protein, 377 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000478497
MSMSPTVIILACLGFFLDQSVWAHVGGQDKPFCSAWPSAVVPQGGHVTLRCHCRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKNAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43948 - protein, 377 aa, Homo sapiens; identical to SEQ ID NO: 43947
  Payload ID: 8979
  Gene Symbol: KIR2DL4
  Gene Name: killer cell immunoglobulin-like receptor, two domains, long cytoplasmic tail, 4
  ENSP ID: ENSP00000478694

SEQ ID NO: 43949 - protein, 342 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000478881
MSMSPTVIILACLGFFLDQSVWAHVGGQDKPFCSAWPSAVVPQGGHVTLRCHCRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43950 - protein, 399 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000479000
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKVSLTKQRPENSGPCAEAGWEHADAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43951 - protein, 273 aa, Homo sapiens; identical to SEQ ID NO: 43928
  Payload ID: 8979
  Gene Symbol: KIR2DL4
  Gene Name: killer cell immunoglobulin-like receptor, two domains, long cytoplasmic tail, 4
  ENSP ID: ENSP00000479014

SEQ ID NO: 43952 - protein, 312 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000479131
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARLGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKSKPHEAEARELRALCGSRMGARRCCCNEPRACGTQNSEQGGL

SEQ ID NO: 43953 - protein, 342 aa, Homo sapiens; identical to SEQ ID NO: 43925
  Payload ID: 8979
  Gene Symbol: KIR2DL4
  Gene Name: killer cell immunoglobulin-like receptor, two domains, long cytoplasmic tail, 4
  Uniprot ID: Q99706
  ENSP ID: ENSP00000479175

SEQ ID NO: 43954 - protein, 360 aa, Homo sapiens
  Payload ID: 8979
  Gene Symbol: KIR2DL4
  Gene Name: killer cell immunoglobulin-like receptor, two domains, long cytoplasmic tail, 4
  Uniprot ID: Q99706
  ENSP ID: ENSP00000479179
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRTGENVTLSCSSQSSFDIYHLSREGEAHELRLPAVPSINGTFQADFPLGPATHGETYRCFGSFHGSPYEWSDASDPLPVSVTGIARHLHAVIRYSVAIILFTILPFFLLHRWCSKKKNAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43955 - protein, 377 aa, Homo sapiens; identical to SEQ ID NO: 43947
  Payload ID: 8979
  Gene Symbol: KIR2DL4
  Gene Name: killer cell immunoglobulin-like receptor, two domains, long cytoplasmic tail, 4
  ENSP ID: ENSP00000479278

SEQ ID NO: 43956 - protein, 342 aa, Homo sapiens; identical to SEQ ID NO: 43949
  Payload ID: 8979
  Gene Symbol: KIR2DL4
  Gene Name: killer cell immunoglobulin-like receptor, two domains, long cytoplasmic tail, 4
  ENSP ID: ENSP00000479331

SEQ ID NO: 43957 - protein, 342 aa, Homo sapiens; identical to SEQ ID NO: 43925
  Payload ID: 8979
  Gene Symbol: KIR2DL4
  Gene Name: killer cell immunoglobulin-like receptor, two domains, long cytoplasmic tail, 4
  Uniprot ID: Q99706
  ENSP ID: ENSP00000479347

SEQ ID NO: 43958 - protein, 325 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000479780
MSMSPTVIILACLGFFLDQSVWAHVGGQDKPFCSAWPSAVVPQGGHVTLRCHCRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43959 - protein, 230 aa, Homo sapiens; identical to SEQ ID NO: 43931
  Payload ID: 8979
  Gene Symbol: KIR2DL4
  Gene Name: killer cell immunoglobulin-like receptor, two domains, long cytoplasmic tail, 4
  Uniprot ID: Q99706
  ENSP ID: ENSP00000479874

SEQ ID NO: 43960 - protein, 342 aa, Homo sapiens; identical to SEQ ID NO: 43949
  Payload ID: 8979
  Gene Symbol: KIR2DL4
  Gene Name: killer cell immunoglobulin-like receptor, two domains, long cytoplasmic tail, 4
  ENSP ID: ENSP00000479925

SEQ ID NO: 43961 - protein, 273 aa, Homo sapiens; identical to SEQ ID NO: 43928
  Payload ID: 8979
  Gene Symbol: KIR2DL4
  Gene Name: killer cell immunoglobulin-like receptor, two domains, long cytoplasmic tail, 4
  ENSP ID: ENSP00000479993

SEQ ID NO: 43962 - protein, 360 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000480075
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARLGPTVRAGENVTLSCSSQSSFDIYHLSREGEAHELRLPAVPSINGTFQADFPLGPATHGETYRCFGSFHGSPYEWSDPSDPLPVSVTGIARHLHAVIRYSVAIILFTILPFFLLHRWCSKKKNAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43963 - protein, 416 aa, Homo sapiens; identical to SEQ ID NO: 43929
  Payload ID: 8979
  Gene Symbol: KIR2DL4
  Gene Name: killer cell immunoglobulin-like receptor, two domains, long cytoplasmic tail, 4
  ENSP ID: ENSP00000480197

SEQ ID NO: 43964 - protein, 342 aa, Homo sapiens; identical to SEQ ID NO: 43949
  Payload ID: 8979
  Gene Symbol: KIR2DL4
  Gene Name: killer cell immunoglobulin-like receptor, two domains, long cytoplasmic tail, 4
  ENSP ID: ENSP00000480253

SEQ ID NO: 43965 - protein, 416 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000480775
MSPSHVVVNVSTARSGPLTTSSAPVSRAESLRPGSRSCTMSMSPTVIILACLGFFLDQSVWAHVGGQDKPFCSAWPSAVVPQGGHVTLRCHCRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43966 - protein, 377 aa, Homo sapiens; identical to SEQ ID NO: 43936
  Payload ID: 8979
  Gene Symbol: KIR2DL4
  Gene Name: killer cell immunoglobulin-like receptor, two domains, long cytoplasmic tail, 4
  Uniprot ID: Q99706
  ENSP ID: ENSP00000480801

SEQ ID NO: 43967 - protein, 377 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000480838
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARLGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKNAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43968 - protein, 273 aa, Homo sapiens; identical to SEQ ID NO: 43943
  Payload ID: 8979
  Gene Symbol: KIR2DL4
  Gene Name: killer cell immunoglobulin-like receptor, two domains, long cytoplasmic tail, 4
  ENSP ID: ENSP00000480840

SEQ ID NO: 43969 - protein, 342 aa, Homo sapiens; identical to SEQ ID NO: 43942
  Payload ID: 8979
  Gene Symbol: KIR2DL4
  Gene Name: killer cell immunoglobulin-like receptor, two domains, long cytoplasmic tail, 4
  ENSP ID: ENSP00000481043

SEQ ID NO: 43970 - protein, 377 aa, Homo sapiens; identical to SEQ ID NO: 43936
  Payload ID: 8979
  Gene Symbol: KIR2DL4
  Gene Name: killer cell immunoglobulin-like receptor, two domains, long cytoplasmic tail, 4
  ENSP ID: ENSP00000481210

SEQ ID NO: 43971 - protein, 342 aa, Homo sapiens; identical to SEQ ID NO: 43949
  Payload ID: 8979
  Gene Symbol: KIR2DL4
  Gene Name: killer cell immunoglobulin-like receptor, two domains, long cytoplasmic tail, 4
  ENSP ID: ENSP00000481229

SEQ ID NO: 43972 - protein, 310 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000481333
MSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRTGENVTLSCSSQSSFDIYHLSREGEAHELRLPAVPSINGTFQADFPLGPATHGETYRCFGSFHGSPYEWSDASDPLPVSVTGNPSSSWPSPTEPSFKTGIARHLHAVIRYSVAIILFTILPFFLLHRWCSKKKSKPHEAEARELRALCGSRMGARRCCCNEPRACGTQNSEQGGL

SEQ ID NO: 43973 - protein, 399 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000481431
MSMSPTVIILACLGFFLDQSVWAHVGGQDKPFCSAWPSAVVPQGGHVTLRCHCRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKVSLTKQRPENSGPCAEAGWEHADAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43974 - protein, 312 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000481574
MSMSPTVIILACLGFFLDQSVWAHVGGQDKPFCSAWPSAVVPQGGHVTLRCHCRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKSKPHEAEARELRALCGSRMGARRCCCNEPRACGTQNSEQGGL

SEQ ID NO: 43975 - protein, 416 aa, Homo sapiens; identical to SEQ ID NO: 43965
  Payload ID: 8979
  Gene Symbol: KIR2DL4
  Gene Name: killer cell immunoglobulin-like receptor, two domains, long cytoplasmic tail, 4
  ENSP ID: ENSP00000481866

SEQ ID NO: 43976 - protein, 416 aa, Homo sapiens; identical to SEQ ID NO: 43965
  Payload ID: 8979
  Gene Symbol: KIR2DL4
  Gene Name: killer cell immunoglobulin-like receptor, two domains, long cytoplasmic tail, 4
  ENSP ID: ENSP00000481870

SEQ ID NO: 43977 - protein, 245 aa, Homo sapiens; identical to SEQ ID NO: 43935
  Payload ID: 8979
  Gene Symbol: KIR2DL4
  Gene Name: killer cell immunoglobulin-like receptor, two domains, long cytoplasmic tail, 4
  ENSP ID: ENSP00000481942

SEQ ID NO: 43978 - protein, 342 aa, Homo sapiens; identical to SEQ ID NO: 43949
  Payload ID: 8979
  Gene Symbol: KIR2DL4
  Gene Name: killer cell immunoglobulin-like receptor, two domains, long cytoplasmic tail, 4
  ENSP ID: ENSP00000482186

SEQ ID NO: 43979 - protein, 377 aa, Homo sapiens; identical to SEQ ID NO: 43936
  Payload ID: 8979
  Gene Symbol: KIR2DL4
  Gene Name: killer cell immunoglobulin-like receptor, two domains, long cytoplasmic tail, 4
  Uniprot ID: Q99706
  ENSP ID: ENSP00000482206

SEQ ID NO: 43980 - protein, 342 aa, Homo sapiens; identical to SEQ ID NO: 43949
  Payload ID: 8979
  Gene Symbol: KIR2DL4
  Gene Name: killer cell immunoglobulin-like receptor, two domains, long cytoplasmic tail, 4
  ENSP ID: ENSP00000482217

SEQ ID NO: 43981 - protein, 377 aa, Homo sapiens; identical to SEQ ID NO: 43936
  Payload ID: 8979
  Gene Symbol: KIR2DL4
  Gene Name: killer cell immunoglobulin-like receptor, two domains, long cytoplasmic tail, 4
  Uniprot ID: Q99706
  ENSP ID: ENSP00000482383

SEQ ID NO: 43982 - protein, 325 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000482420
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRTGENVTLSCSSQSSFDIYHLSREGEAHELRLPAVPSINGTFQADFPLGPATHGETYRCFGSFHGSPYEWSDASDPLPVSVTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43983 - protein, 360 aa, Homo sapiens; identical to SEQ ID NO: 43954
  Payload ID: 8979
  Gene Symbol: KIR2DL4
  Gene Name: killer cell immunoglobulin-like receptor, two domains, long cytoplasmic tail, 4
  Uniprot ID: Q99706
  ENSP ID: ENSP00000482452

SEQ ID NO: 43984 - protein, 325 aa, Homo sapiens; identical to SEQ ID NO: 43927
  Payload ID: 8979
  Gene Symbol: KIR2DL4
  Gene Name: killer cell immunoglobulin-like receptor, two domains, long cytoplasmic tail, 4
  Uniprot ID: Q99706
  ENSP ID: ENSP00000482454

SEQ ID NO: 43985 - protein, 273 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000482730
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRTGENVTLSCSSQSSFDIYHLSREGEAHELRLPAVPSINGTFQADFPLGPATHGETYRCFGSFHGSPYEWSDASDPLPVSVTGNPSSSWPSPTEPSFKTGIARHLHAVIRYSVAIILFTILPFFLLHRWCSKKKMLL

SEQ ID NO: 43986 - protein, 377 aa, Homo sapiens; identical to SEQ ID NO: 43947
  Payload ID: 8979
  Gene Symbol: KIR2DL4
  Gene Name: killer cell immunoglobulin-like receptor, two domains, long cytoplasmic tail, 4
  ENSP ID: ENSP00000482918

SEQ ID NO: 43987 - protein, 325 aa, Homo sapiens; identical to SEQ ID NO: 43958
  Payload ID: 8979
  Gene Symbol: KIR2DL4
  Gene Name: killer cell immunoglobulin-like receptor, two domains, long cytoplasmic tail, 4
  ENSP ID: ENSP00000482972

SEQ ID NO: 43988 - protein, 377 aa, Homo sapiens; identical to SEQ ID NO: 43936
  Payload ID: 8979
  Gene Symbol: KIR2DL4
  Gene Name: killer cell immunoglobulin-like receptor, two domains, long cytoplasmic tail, 4
  Uniprot ID: Q99706
  ENSP ID: ENSP00000483101

SEQ ID NO: 43989 - protein, 377 aa, Homo sapiens; identical to SEQ ID NO: 43947
  Payload ID: 8979
  Gene Symbol: KIR2DL4
  Gene Name: killer cell immunoglobulin-like receptor, two domains, long cytoplasmic tail, 4
  ENSP ID: ENSP00000483336

SEQ ID NO: 43990 - protein, 342 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000483440
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARLGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43991 - protein, 416 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000483583
MSPSHVVVNVSTARSGPLTTSSAPVSRAESLRPGSRSCTMSMSPTVIILACLGFFLDQSVWAHVGGQDKPFCSAWPSAVVPQGGHVTLRCHCRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKNAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43992 - protein, 377 aa, Homo sapiens; identical to SEQ ID NO: 43936
  Payload ID: 8979
  Gene Symbol: KIR2DL4
  Gene Name: killer cell immunoglobulin-like receptor, two domains, long cytoplasmic tail, 4
  Uniprot ID: Q99706
  ENSP ID: ENSP00000483782

SEQ ID NO: 43993 - protein, 342 aa, Homo sapiens; identical to SEQ ID NO: 43949
  Payload ID: 8979
  Gene Symbol: KIR2DL4
  Gene Name: killer cell immunoglobulin-like receptor, two domains, long cytoplasmic tail, 4
  ENSP ID: ENSP00000483788

SEQ ID NO: 43994 - protein, 416 aa, Homo sapiens; identical to SEQ ID NO: 43929
  Payload ID: 8979
  Gene Symbol: KIR2DL4
  Gene Name: killer cell immunoglobulin-like receptor, two domains, long cytoplasmic tail, 4
  ENSP ID: ENSP00000483924

SEQ ID NO: 43995 - protein, 273 aa, Homo sapiens; identical to SEQ ID NO: 43943
  Payload ID: 8979
  Gene Symbol: KIR2DL4
  Gene Name: killer cell immunoglobulin-like receptor, two domains, long cytoplasmic tail, 4
  ENSP ID: ENSP00000483940

SEQ ID NO: 43996 - protein, 325 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000484002
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARLGPTVRAGENVTLSCSSQSSFDIYHLSREGEAHELRLPAVPSINGTFQADFPLGPATHGETYRCFGSFHGSPYEWSDPSDPLPVSVTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 43997 - protein, 273 aa, Homo sapiens; identical to SEQ ID NO: 43928
  Payload ID: 8979
  Gene Symbol: KIR2DL4
  Gene Name: killer cell immunoglobulin-like receptor, two domains, long cytoplasmic tail, 4
  ENSP ID: ENSP00000484019

SEQ ID NO: 43998 - protein, 416 aa, Homo sapiens; identical to SEQ ID NO: 43929
  Payload ID: 8979
  Gene Symbol: KIR2DL4
  Gene Name: killer cell immunoglobulin-like receptor, two domains, long cytoplasmic tail, 4
  ENSP ID: ENSP00000484114

SEQ ID NO: 43999 - protein, 377 aa, Homo sapiens; identical to SEQ ID NO: 43967
  Payload ID: 8979
  Gene Symbol: KIR2DL4
  Gene Name: killer cell immunoglobulin-like receptor, two domains, long cytoplasmic tail, 4
  ENSP ID: ENSP00000484152

SEQ ID NO: 44000 - protein, 377 aa, Homo sapiens; identical to SEQ ID NO: 43947
  Payload ID: 8979
  Gene Symbol: KIR2DL4
  Gene Name: killer cell immunoglobulin-like receptor, two domains, long cytoplasmic tail, 4
  ENSP ID: ENSP00000484171

SEQ ID NO: 44001 - protein, 342 aa, Homo sapiens; identical to SEQ ID NO: 43942
  Payload ID: 8979
  Gene Symbol: KIR2DL4
  Gene Name: killer cell immunoglobulin-like receptor, two domains, long cytoplasmic tail, 4
  ENSP ID: ENSP00000484194

SEQ ID NO: 44002 - protein, 273 aa, Homo sapiens; identical to SEQ ID NO: 43928
  Payload ID: 8979
  Gene Symbol: KIR2DL4
  Gene Name: killer cell immunoglobulin-like receptor, two domains, long cytoplasmic tail, 4
  ENSP ID: ENSP00000484307

SEQ ID NO: 44003 - protein, 399 aa, Homo sapiens; identical to SEQ ID NO: 43973
  Payload ID: 8979
  Gene Symbol: KIR2DL4
  Gene Name: killer cell immunoglobulin-like receptor, two domains, long cytoplasmic tail, 4
  ENSP ID: ENSP00000484328

SEQ ID NO: 44004 - protein, 273 aa, Homo sapiens; identical to SEQ ID NO: 43928
  Payload ID: 8979
  Gene Symbol: KIR2DL4
  Gene Name: killer cell immunoglobulin-like receptor, two domains, long cytoplasmic tail, 4
  ENSP ID: ENSP00000484336

SEQ ID NO: 44005 - protein, 377 aa, Homo sapiens; identical to SEQ ID NO: 43936
  Payload ID: 8979
  Gene Symbol: KIR2DL4
  Gene Name: killer cell immunoglobulin-like receptor, two domains, long cytoplasmic tail, 4
  Uniprot ID: Q99706
  ENSP ID: ENSP00000484389

SEQ ID NO: 44006 - protein, 342 aa, Homo sapiens; identical to SEQ ID NO: 43925
  Payload ID: 8979
  Gene Symbol: KIR2DL4
  Gene Name: killer cell immunoglobulin-like receptor, two domains, long cytoplasmic tail, 4
  Uniprot ID: Q99706
  ENSP ID: ENSP00000484469

SEQ ID NO: 44007 - protein, 230 aa, Homo sapiens; identical to SEQ ID NO: 43934
  Payload ID: 8979
  Gene Symbol: KIR2DL4
  Gene Name: killer cell immunoglobulin-like receptor, two domains, long cytoplasmic tail, 4
  ENSP ID: ENSP00000484737

SEQ ID NO: 44008 - protein, 416 aa, Homo sapiens; identical to SEQ ID NO: 43929
  Payload ID: 8979
  Gene Symbol: KIR2DL4
  Gene Name: killer cell immunoglobulin-like receptor, two domains, long cytoplasmic tail, 4
  ENSP ID: ENSP00000484815

SEQ ID NO: 44009 - protein, 256 aa, Homo sapiens
  Payload ID: 8979
  Gene Symbol: KIR2DL4
  Gene Name: killer cell immunoglobulin-like receptor, two domains, long cytoplasmic tail, 4
  ENSP ID: ENSP00000484890
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGIARHLHAVIRYSVAIILFTILPFFLLHRWCSKKKMLL

SEQ ID NO: 44010 - protein, 375 aa, Homo sapiens
  Payload ID: 8980
  Gene Symbol: KIR2DL5A
  Gene Name: killer cell immunoglobulin-like receptor, two domains, long cytoplasmic tail, 5A
  ENSP ID: ENSP00000478053
MSLMVVSMACVGFFLLQGAWTHEGGQDKPLLSAWPSAVVPRGGHVTLLCRSRLGFTIFSLYKEDGVPVPELYNKIFWKSILMGPVTPAHAGTYRCRGSHPRSPIEWSAPSNPLVIVVTGLFGKPSLSAQPGPTVRTGENVTLSCSSRSSFDMYHLSREGRAHEPRLPAVPSVDGTFQADFPLGPATHGGTYTCFSSLHDSPYEWSDPSDPLLVSVTGNSSSSSSSPTEPSSKTGIRRHLHILIGTSVAIILFIILFFFLLHCCCSNKKNAAVMDQEPAGDRTVNREDSDDQDPQEVTYAQLDHCVFTQTKITSPSQRPKTPPTDTTMYMELPNAKPRSLSPAHKHHSQALRGSSRETTALSQNRVASSHVPAAGI

SEQ ID NO: 44011 - protein, 375 aa, Homo sapiens
  Payload ID: 8980
  Gene Symbol: KIR2DL5A
  Gene Name: killer cell immunoglobulin-like receptor, two domains, long cytoplasmic tail, 5A
  Uniprot ID: Q8N109
  ENSP ID: ENSP00000479384
MSLMVISMACVGFFLLQGAWTHEGGQDKPLLSAWPSAVVPRGGHVTLLCRSRLGFTIFSLYKEDGVPVPELYNKIFWKSILMGPVTPAHAGTYRCRGSHPRSPIEWSAPSNPLVIVVTGLFGKPSLSAQPGPTVRTGENVTLSCSSRSSFDMYHLSREGRAHEPRLPAVPSVNGTFQADFPLGPATHGGTYTCFGSLHDSPYEWSDPSDPLLVSVTGNSSSSSSSPTEPSSKTGIRRHLHILIGTSVAIILFIILFFFLLHCCCSNKKNAAVMDQEPAGDRTVNREDSDDQDPQEVTYAQLDHCVFTQTKITSPSQRPKTPPTDTTMYMELPNAKPRSLSPAHKHHSQALRGSSRETTALSQNRVASSHVPAAGI

SEQ ID NO: 44012 - protein, 375 aa, Homo sapiens
  Payload ID: 8980
  Gene Symbol: KIR2DL5A
  Gene Name: killer cell immunoglobulin-like receptor, two domains, long cytoplasmic tail, 5A
  ENSP ID: ENSP00000480340
MSLMVISMACVGFFLLQGAWTHEGGQDKPLLSAWPSAVVPRGGHVTLLCRSRLGFTIFSLYKEDGVPVPELYNKIFWKSILMGPVTPAHAGTYRCRGSHPRSPIEWSAPSNPLVIVVTGLFGKPSLSAQPGPTVRTGENVTLSCSSRSSFDMYHLSREGRAHEPRLPAVPSVDGTFQADFPLGPATHGGTYTCFSSLHDSPYEWSDPSDPLLVSVTGNSSSSSSSPTEPSSKTGIRRHLHILIGTSVAIILFIILFFFLLHCCCSNKKNAAVMDQEPAGDRTVNREDSDDQDPQEVTYAQLDHCVFTQTKITSPSQRPKTPPTDTTMYMELPNAKPRSLSPAHKHHSQALRGSSRETTALSQNRVASSHVPAAGI

SEQ ID NO: 44013 - protein, 375 aa, Homo sapiens; identical to SEQ ID NO: 44011
  Payload ID: 8980
  Gene Symbol: KIR2DL5A
  Gene Name: killer cell immunoglobulin-like receptor, two domains, long cytoplasmic tail, 5A
  Uniprot ID: Q8N109
  ENSP ID: ENSP00000483324

SEQ ID NO: 44014 - protein, 375 aa, Homo sapiens; identical to SEQ ID NO: 44012
  Payload ID: 8980
  Gene Symbol: KIR2DL5A
  Gene Name: killer cell immunoglobulin-like receptor, two domains, long cytoplasmic tail, 5A
  ENSP ID: ENSP00000483518

SEQ ID NO: 44015 - protein, 375 aa, Homo sapiens; identical to SEQ ID NO: 44012
  Payload ID: 8980
  Gene Symbol: KIR2DL5A
  Gene Name: killer cell immunoglobulin-like receptor, two domains, long cytoplasmic tail, 5A
  ENSP ID: ENSP00000484057

SEQ ID NO: 44016 - protein, 375 aa, Homo sapiens; identical to SEQ ID NO: 44010
  Payload ID: 8980
  Gene Symbol: KIR2DL5A
  Gene Name: killer cell immunoglobulin-like receptor, two domains, long cytoplasmic tail, 5A
  ENSP ID: ENSP00000484203

SEQ ID NO: 44017 - protein, 375 aa, Homo sapiens; identical to SEQ ID NO: 44011
  Payload ID: 8980
  Gene Symbol: KIR2DL5A
  Gene Name: killer cell immunoglobulin-like receptor, two domains, long cytoplasmic tail, 5A
  Uniprot ID: Q8N109
  ENSP ID: ENSP00000484296

SEQ ID NO: 44018 - protein, 375 aa, Homo sapiens; identical to SEQ ID NO: 44012
  Payload ID: 8980
  Gene Symbol: KIR2DL5A
  Gene Name: killer cell immunoglobulin-like receptor, two domains, long cytoplasmic tail, 5A
  ENSP ID: ENSP00000484937

SEQ ID NO: 44019 - protein, 375 aa, Homo sapiens
  Payload ID: 8981
  Gene Symbol: KIR2DL5B
  Gene Name: killer cell immunoglobulin-like receptor, two domains, long cytoplasmic tail, 5B
  ENSP ID: ENSP00000478635
MSLMVVSMACVGFFLLQGAWPHEGGQDKPLLSAWPSAVVPRGGHVTLLCRSRLGFTIFSLYKEDGVPVPELYNKIFWKSILMGPVTPAHAGTYRCRGSHPRSPIEWSAPSNPLVIVVTGLFGKPSLSAQPGPTVRTGENVTLSCSSRSSFDMYHLSREGRAHEPRLPAVPSVNGTFQADFPLGPATHGGTYTCFGSLHDSPYEWSDPSDPLLVSVTGNSSSSSSSPTEPSSKTGIRRHLHILIGTSVAIILFIILFFFLLHCCCSNKKNAAVMDQEPAGDRTVNREDSDDQDPQEVTYAQLDHCVFTQTKITSPSQRPKTPPTDTTMYMELPNAKPRSLSPAHKHHSQALRGSSRETTALSQNRVASSHVPAAGI

SEQ ID NO: 44020 - protein, 375 aa, Homo sapiens; identical to SEQ ID NO: 44010
  Payload ID: 8981
  Gene Symbol: KIR2DL5B
  Gene Name: killer cell immunoglobulin-like receptor, two domains, long cytoplasmic tail, 5B
  ENSP ID: ENSP00000479965

SEQ ID NO: 44021 - protein, 375 aa, Homo sapiens
  Payload ID: 8981
  Gene Symbol: KIR2DL5B
  Gene Name: killer cell immunoglobulin-like receptor, two domains, long cytoplasmic tail, 5B
  ENSP ID: ENSP00000480770
MSLMVVSMACVGFFLLQGAWTHEGGQDKPLLSAWPSTVVPRGGHVTLLCRSRLGFTIFSLYKEDGVPVPELYNKIFWKSILMGPVTPAHAGTYRCRGSHPRSPIEWSAPSNPLVIVVTGLFGKPSLSAQPGPTVRTGENVTLSCSSRSSFDMYHLSREGRAHEPRLPAVPSVNGTFQADFPLGPATHGGTYTCFGSLHDSPYEWSDPSDPLLVSVTGNSSSSSSSPTEPSSKTGIRRHLHILIGTSVAIILFIILFFFLLHCCCSNKKNAAVMDQEPAGDRTVNREDSDDQDPQEVTYAQLDHCVFTQTKITSPSQRPKTPPTDTTMYMELPNAKPRSLSPAHKHHSQALRGSSRETTALSQNRVASSHVPAAGI

SEQ ID NO: 44022 - protein, 375 aa, Homo sapiens; identical to SEQ ID NO: 44010
  Payload ID: 8981
  Gene Symbol: KIR2DL5B
  Gene Name: killer cell immunoglobulin-like receptor, two domains, long cytoplasmic tail, 5B
  ENSP ID: ENSP00000480935

SEQ ID NO: 44023 - protein, 375 aa, Homo sapiens
  Payload ID: 8981
  Gene Symbol: KIR2DL5B
  Gene Name: killer cell immunoglobulin-like receptor, two domains, long cytoplasmic tail, 5B
  ENSP ID: ENSP00000482904
MSLMVVSMACVGFFLLQGAWTHEGGQDKPLLSAWPSAVVPRGGHVTLLCRSRLGFTIFSLYKEDGVPVPELYNKIFWKSILMGPVTPAHAGTYRCRGSHPRSPIEWSAPSNPLVIVVTGLFGKPSLSAQPGPTVRTGENVTLSCSSRSSFDMYHLSREGRAHEPRLPAVPSVNGTFQADFPLGPATHGGTYTCFGSLHDSPYEWSDPSDPLLVSVTGNSSSSSSSPTEPSSKTGIRRHLHILIGTSVAIILFIILFFFLLHCCCSNKKNAAVMDQEPAGDRTVNREDSDDQDPQEVTYAQLDHCVFTQTKITSPSQRPKTPPTDTTMYMELPNAKPRSLSPAHKHHSQALRGSSRETTALSQNRVASSHVPAAGI

SEQ ID NO: 44024 - protein, 375 aa, Homo sapiens; identical to SEQ ID NO: 44019
  Payload ID: 8981
  Gene Symbol: KIR2DL5B
  Gene Name: killer cell immunoglobulin-like receptor, two domains, long cytoplasmic tail, 5B
  ENSP ID: ENSP00000483362

SEQ ID NO: 44025 - protein, 375 aa, Homo sapiens; identical to SEQ ID NO: 44021
  Payload ID: 8981
  Gene Symbol: KIR2DL5B
  Gene Name: killer cell immunoglobulin-like receptor, two domains, long cytoplasmic tail, 5B
  ENSP ID: ENSP00000483776

SEQ ID NO: 44026 - protein, 375 aa, Homo sapiens; identical to SEQ ID NO: 44023
  Payload ID: 8981
  Gene Symbol: KIR2DL5B
  Gene Name: killer cell immunoglobulin-like receptor, two domains, long cytoplasmic tail, 5B
  ENSP ID: ENSP00000484782

SEQ ID NO: 44027 - protein, 304 aa, Homo sapiens
  Payload ID: 8982
  Gene Symbol: KIR2DP1
  Gene Name: killer cell immunoglobulin-like receptor, two domains, pseudogene 1
  ENSP ID: ENSP00000477761
MSLMVVSMACVGFFLLQGAWPHEGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLHVLIGTSVVIILFILLLFFLLHRWCSNKKNAAVMDQEPAGNRTVNSEDSDEQDHQEVSYA

SEQ ID NO: 44028 - protein, 454 aa, Homo sapiens
  Payload ID: 8982
  Gene Symbol: KIR2DP1
  Gene Name: killer cell immunoglobulin-like receptor, two domains, pseudogene 1
  ENSP ID: ENSP00000478427
MSLMVVSMACVGFFLLEGPWPHVGGQDKPFLSAWPGTVVSEGQHVTLQCRSRLGFKEFSLSKEDGMPVPELYNRIFRNSFLMGPVTPAHAGTYRCCSSHPHSPTGWSAPSNPVVIMVTGVHRKPSLLAHPGPLVKSGETVILQCWSDVSFERFLLHREGITEDPLRLVGQLHDAGSQVNYSMGPMTPALAGTYRCFGSVTHLPYELSAPSDPLDIVVVGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLHVLIGTSVVIILFILLLFFLLHRWCSNKKNAAVMDQEPAGNRTANSEDSDEQDPQEVTYVQLDHCVFTQRKITRPSQRPKTPPTDTRVYTELPNAESRSKVVSCPAPQSGLEGIF

SEQ ID NO: 44029 - protein, 304 aa, Homo sapiens
  Payload ID: 8982
  Gene Symbol: KIR2DP1
  Gene Name: killer cell immunoglobulin-like receptor, two domains, pseudogene 1
  ENSP ID: ENSP00000481463
MSLMVVSMACVGFFLLQGAWPHEGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLHVLIGTSVVKIPFTILLFFLLHRWCSDKKNAAVMDQEPAGNRTVNSEDSDEQDHQEVSYA

SEQ ID NO: 44030 - protein, 349 aa, Homo sapiens; identical to SEQ ID NO: 43886
  Payload ID: 8982
  Gene Symbol: KIR2DP1
  Gene Name: killer cell immunoglobulin-like receptor, two domains, pseudogene 1
  ENSP ID: ENSP00000482055

SEQ ID NO: 44031 - protein, 455 aa, Homo sapiens
  Payload ID: 8982
  Gene Symbol: KIR2DP1
  Gene Name: killer cell immunoglobulin-like receptor, two domains, pseudogene 1
  ENSP ID: ENSP00000482505
MSLMVVSMACVGFFLLEGPWPHVGGQDKPFLSAWPGTVVSEGQHVTLQCRSRLGFKEFSLSKEDGMPVPELYNRIFRNSFLMGPVTPAHAGTYRCCSSHPHSPTGWSAPSNPVVIMVTGVHRKPSLLAHPGPLVKSGETVILQCWSDVSFERFLLHREGITEDPLRLVGQLHDAGSQVNYSMGPMTPALAGTYRCFGSVTHLPYELSAPSDPLDIVVVGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLHVLIGTSVVIILFILLLFFLLHRWCSNKKNAAVMDQEPAGNRTANSEDSDEQDPQEVTYVQLDHCVFTQRKITRPSQRPKTPPTDTRVYTELPNAESRSKVVSCPRAPQSGLEGIF

SEQ ID NO: 44032 - protein, 349 aa, Homo sapiens; identical to SEQ ID NO: 43902
  Payload ID: 8982
  Gene Symbol: KIR2DP1
  Gene Name: killer cell immunoglobulin-like receptor, two domains, pseudogene 1
  ENSP ID: ENSP00000484356

SEQ ID NO: 44033 - protein, 338 aa, Homo sapiens
  Payload ID: 8982
  Gene Symbol: KIR2DP1
  Gene Name: killer cell immunoglobulin-like receptor, two domains, pseudogene 1
  ENSP ID: ENSP00000484374
MSLMVVSMACVGFFLLQGAWPHEGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLHVLIGTSVVKIPFTILLFFLLHRWCSDKKNAAVMDQEPAGNRTVNSERKITRPSERPKTPPTDTSMYIELPNAEPRSKVVFCPRAPQSGLEGIF

SEQ ID NO: 44034 - protein, 304 aa, Homo sapiens
  Payload ID: 8983
  Gene Symbol: KIR2DS1
  Gene Name: killer cell immunoglobulin-like receptor, two domains, short cytoplasmic tail, 1
  ENSP ID: ENSP00000478711
MSLTVVSMACVGFFLLQGAWPHEGVHRKPSLLAHPGRLVKSEETVILQCWSDVMFEHFLLHREGMFNDTLRLIGEHHDGVSKANFSISRMKQDLAGTYRCYGSVTHSPYQLSAPSDPLDIVIIGLYEKPSLSAQPGPTVLAGENVTLSCSSRSSYDMYHLSREGEAHERRLPAGTKVNGTFQANFPLGPATHGGTYRCFGSFRDSPYEWSKSSDPLLVSVTGNPSNSWPSPTEPSSETGNPRHLHVLIGTSVVKIPFTILLFFLLHRWCSDKKNAAVMDQEPAGNRTVNSEDSDEQDHQEVSYA

SEQ ID NO: 44035 - protein, 304 aa, Homo sapiens [sequence omitted]

SEQ ID NO: 44036 - protein, 304 aa, Homo sapiens
  Payload ID: 8983
  Gene Symbol: KIR2DS1
  Gene Name: killer cell immunoglobulin-like receptor, two domains, short cytoplasmic tail, 1
  ENSP ID: ENSP00000479102
MSLLVVSMACVGFFLLQGAWPHEGVHRKPSLLAHPGRLVKSEETVILQCWSDVMFEHFLLHREGMFNDTLRLIGEHHDGVSKANFSISRMKQDLAGTYRCYGSVTHSPYQLSAPSDPLDIVIIGLYEKPSLSAQPGPTVLAGENVTLSCSSRSSYDMYHLSREGEAHERRLPAGTKVNGTFQANFPLGPATHGGTYRCFGSFRDSPYEWSKSSDPLLVSVTGNPSNSWPSPTEPSSETGNPRHLHVLIGTSVVKIPFTILLFFLLHRWCSDKKNAAVMDQEPAGNRTVNSEDSDEQDHQEVSYA

SEQ ID NO: 44037 - protein, 304 aa, Homo sapiens; identical to SEQ ID NO: 44036
  Payload ID: 8983
  Gene Symbol: KIR2DS1
  Gene Name: killer cell immunoglobulin-like receptor, two domains, short cytoplasmic tail, 1
  ENSP ID: ENSP00000480228

SEQ ID NO: 44038 - protein, 349 aa, Homo sapiens
  Payload ID: 8983
  Gene Symbol: KIR2DS1
  Gene Name: killer cell immunoglobulin-like receptor, two domains, short cytoplasmic tail, 1
  ENSP ID: ENSP00000481519
MSLLVVSMACVGFFLLQGAWPHEGVHRKPSLLAHPGRLVKSEETVILQCWSDVMFEHFLLHREGMFNDTLRLIGEHHDGVSKANFSISRMKQDLAGTYRCYGSVTHSPYQLSAPSDPLDIVIIGLYEKPSLSAQPGPTVLAGENVTLSCSSRSSYDMYHLSREGEAHERRLPAGTKVNGTFQANFPLGPATHGGTYRCFGSFRDSPYEWSKSSDPLLVSVTGNPSNSWPSPTEPSSETGNPRHLHVLIGTSVVKIPFTILLFFLLHRWCSDKKNAAVMDQEPAGNRTVNSEDSDEQDHQEVSYALDHCVFTQRKITRPSERPKTPPTDTSMYIELPNAEPRSKVVFCPR

SEQ ID NO: 44039 - protein, 304 aa, Homo sapiens; identical to SEQ ID NO: 44034
  Payload ID: 8983
  Gene Symbol: KIR2DS1
  Gene Name: killer cell immunoglobulin-like receptor, two domains, short cytoplasmic tail, 1
  ENSP ID: ENSP00000481628

SEQ ID NO: 44040 - protein, 304 aa, Homo sapiens; identical to SEQ ID NO: 44034
  Payload ID: 8983
  Gene Symbol: KIR2DS1
  Gene Name: killer cell immunoglobulin-like receptor, two domains, short cytoplasmic tail, 1
  ENSP ID: ENSP00000482060

SEQ ID NO: 44041 - protein, 304 aa, Homo sapiens; identical to SEQ ID NO: 44034
  Payload ID: 8983
  Gene Symbol: KIR2DS1
  Gene Name: killer cell immunoglobulin-like receptor, two domains, short cytoplasmic tail, 1
  ENSP ID: ENSP00000482170

SEQ ID NO: 44042 - protein, 304 aa, Homo sapiens; identical to SEQ ID NO: 44034
  Payload ID: 8983
  Gene Symbol: KIR2DS1
  Gene Name: killer cell immunoglobulin-like receptor, two domains, short cytoplasmic tail, 1
  ENSP ID: ENSP00000482900

SEQ ID NO: 44043 - protein, 304 aa, Homo sapiens; identical to SEQ ID NO: 44034
  Payload ID: 8983
  Gene Symbol: KIR2DS1
  Gene Name: killer cell immunoglobulin-like receptor, two domains, short cytoplasmic tail, 1
  ENSP ID: ENSP00000483434

SEQ ID NO: 44044 - protein, 297 aa, Homo sapiens
  Payload ID: 8983
  Gene Symbol: KIR2DS1
  Gene Name: killer cell immunoglobulin-like receptor, two domains, short cytoplasmic tail, 1
  ENSP ID: ENSP00000484939
MACVGFFLLQGAWPHEGVHRKPSLLAHPGRLVKSEETVILQCWSDVMFEHFLLHREGMFNDTLRLIGEHHDGVSKANFSISRMKQDLAGTYRCYGSVTHSPYQLSAPSDPLDIVIIGLYEKPSLSAQPGPTVLAGENVTLSCSSRSSYDMYHLSREGEAHERRLPAGTKVNGTFQANFPLGPATHGGTYRCFGSFRDSPYEWSKSSDPLLVSVTGNPSNSWPSPTEPSSETGNPRHLHVLIGTSVVKIPFTILLFFLLHRWCSDKKNAAVMDQEPAGNRTVNSEDSDEQDHQEVSYA

SEQ ID NO: 44045 - protein, 287 aa, Homo sapiens
  Payload ID: 8984
  Gene Symbol: KIR2DS2
  Gene Name: killer cell immunoglobulin-like receptor, two domains, short cytoplasmic tail, 2
  ENSP ID: ENSP00000477585
MSLMVVSMACVGFFLLQGAWPHEGVHRKPSLLAHPGPLVKSEETVILQCWSDVRFEHFLLHREGKYKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPRHLHVLIGTSVVKIPFTILLFFLLHRWCSNKKNAAVMDQEPAGNRTVNSEDSDEQDHQEVSYA

SEQ ID NO: 44046 - protein, 304 aa, Homo sapiens
  Payload ID: 8984
  Gene Symbol: KIR2DS2
  Gene Name: killer cell immunoglobulin-like receptor, two domains, short cytoplasmic tail, 2
  Uniprot ID: P43631
  ENSP ID: ENSP00000477892
MSLMVVSMACVGFFLLQGAWPHEGVHRKPSLLAHPGPLVKSEETVILQCWSDVRFEHFLLHREGKYKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLHVLIGTSVVKIPFTILLFFLLHRWCSNKKNAAVMDQEPAGNRTVNSEDSDEQDHQEVSYA

SEQ ID NO: 44047 - protein, 304 aa, Homo sapiens; identical to SEQ ID NO: 44046
  Payload ID: 8984
  Gene Symbol: KIR2DS2
  Gene Name: killer cell immunoglobulin-like receptor, two domains, short cytoplasmic tail, 2
  Uniprot ID: P43631
  ENSP ID: ENSP00000478014

SEQ ID NO: 44048 - protein, 304 aa, Homo sapiens; identical to SEQ ID NO: 44046
  Payload ID: 8984
  Gene Symbol: KIR2DS2
  Gene Name: killer cell immunoglobulin-like receptor, two domains, short cytoplasmic tail, 2
  Uniprot ID: P43631
  ENSP ID: ENSP00000478509

SEQ ID NO: 44049 - protein, 304 aa, Homo sapiens; identical to SEQ ID NO: 44046
  Payload ID: 8984
  Gene Symbol: KIR2DS2
  Gene Name: killer cell immunoglobulin-like receptor, two domains, short cytoplasmic tail, 2
  Uniprot ID: P43631
  ENSP ID: ENSP00000479565

SEQ ID NO: 44050 - protein, 304 aa, Homo sapiens; identical to SEQ ID NO: 44046
  Payload ID: 8984
  Gene Symbol: KIR2DS2
  Gene Name: killer cell immunoglobulin-like receptor, two domains, short cytoplasmic tail, 2
  Uniprot ID: P43631
  ENSP ID: ENSP00000479980

SEQ ID NO: 44051 - protein, 287 aa, Homo sapiens; identical to SEQ ID NO: 44045
  Payload ID: 8984
  Gene Symbol: KIR2DS2
  Gene Name: killer cell immunoglobulin-like receptor, two domains, short cytoplasmic tail, 2
  ENSP ID: ENSP00000481218

SEQ ID NO: 44052 - protein, 304 aa, Homo sapiens; identical to SEQ ID NO: 44046
  Payload ID: 8984
  Gene Symbol: KIR2DS2
  Gene Name: killer cell immunoglobulin-like receptor, two domains, short cytoplasmic tail, 2
  Uniprot ID: P43631
  ENSP ID: ENSP00000481307

SEQ ID NO: 44053 - protein, 304 aa, Homo sapiens; identical to SEQ ID NO: 44046
  Payload ID: 8984
  Gene Symbol: KIR2DS2
  Gene Name: killer cell immunoglobulin-like receptor, two domains, short cytoplasmic tail, 2
  Uniprot ID: P43631
  ENSP ID: ENSP00000482637

SEQ ID NO: 44054 - protein, 304 aa, Homo sapiens; identical to SEQ ID NO: 44046
  Payload ID: 8984
  Gene Symbol: KIR2DS2
  Gene Name: killer cell immunoglobulin-like receptor, two domains, short cytoplasmic tail, 2
  Uniprot ID: P43631
  ENSP ID: ENSP00000482725

SEQ ID NO: 44055 - protein, 304 aa, Homo sapiens; identical to SEQ ID NO: 44046
  Payload ID: 8984
  Gene Symbol: KIR2DS2
  Gene Name: killer cell immunoglobulin-like receptor, two domains, short cytoplasmic tail, 2
  Uniprot ID: P43631
  ENSP ID: ENSP00000482770

SEQ ID NO: 44056 - protein, 304 aa, Homo sapiens; identical to SEQ ID NO: 44046
  Payload ID: 8984
  Gene Symbol: KIR2DS2
  Gene Name: killer cell immunoglobulin-like receptor, two domains, short cytoplasmic tail, 2
  Uniprot ID: P43631
  ENSP ID: ENSP00000483792

SEQ ID NO: 44057 - protein, 304 aa, Homo sapiens; identical to SEQ ID NO: 44046
  Payload ID: 8984
  Gene Symbol: KIR2DS2
  Gene Name: killer cell immunoglobulin-like receptor, two domains, short cytoplasmic tail, 2
  Uniprot ID: P43631
  ENSP ID: ENSP00000483804

SEQ ID NO: 44058 - protein, 204 aa, Homo sapiens
  Payload ID: 8984
  Gene Symbol: KIR2DS2
  Gene Name: killer cell immunoglobulin-like receptor, two domains, short cytoplasmic tail, 2
  ENSP ID: ENSP00000483805
MSLMVVSMACVGFFLLQGAWPHEGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLHVLIGTSVVKIPFTILLFFLLHRWCSNKKNAAVMDQEPAGNRTVNSEDSDEQDHQEVSYA

SEQ ID NO: 44059 - protein, 304 aa, Homo sapiens; identical to SEQ ID NO: 44046
  Payload ID: 8984
  Gene Symbol: KIR2DS2
  Gene Name: killer cell immunoglobulin-like receptor, two domains, short cytoplasmic tail, 2
  Uniprot ID: P43631
  ENSP ID: ENSP00000484082

SEQ ID NO: 44060 - protein, 287 aa, Homo sapiens; identical to SEQ ID NO: 44045
  Payload ID: 8984
  Gene Symbol: KIR2DS2
  Gene Name: killer cell immunoglobulin-like receptor, two domains, short cytoplasmic tail, 2
  ENSP ID: ENSP00000484133

SEQ ID NO: 44061 - protein, 304 aa, Homo sapiens; identical to SEQ ID NO: 44046
  Payload ID: 8984
  Gene Symbol: KIR2DS2
  Gene Name: killer cell immunoglobulin-like receptor, two domains, short cytoplasmic tail, 2
  Uniprot ID: P43631
  ENSP ID: ENSP00000484281

SEQ ID NO: 44062 - protein, 304 aa, Homo sapiens; identical to SEQ ID NO: 44046
  Payload ID: 8984
  Gene Symbol: KIR2DS2
  Gene Name: killer cell immunoglobulin-like receptor, two domains, short cytoplasmic tail, 2
  Uniprot ID: P43631
  ENSP ID: ENSP00000484400

SEQ ID NO: 44063 - protein, 304 aa, Homo sapiens; identical to SEQ ID NO: 44046
  Payload ID: 8984
  Gene Symbol: KIR2DS2
  Gene Name: killer cell immunoglobulin-like receptor, two domains, short cytoplasmic tail, 2
  Uniprot ID: P43631
  ENSP ID: ENSP00000484771

SEQ ID NO: 44064 - protein, 304 aa, Homo sapiens
  Payload ID: 8985
  Gene Symbol: KIR2DS3
  Gene Name: killer cell immunoglobulin-like receptor, two domains, short cytoplasmic tail, 3
  Uniprot ID: Q14952
  ENSP ID: ENSP00000479108
MSLMVISMACVGFFWLQGAWPHEGFRRKPSLLAHPGRLVKSEETVILQCWSDVMFEHFLLHREGTFNDTLRLIGEHIDGVSKANFSIGRMRQDLAGTYRCYGSVPHSPYQFSAPSDPLDIVITGLYEKPSLSAQPGPTVLAGESVTLSCSSWSSYDMYHLSTEGEAHERRFSAGPKVNGTFQADFPLGPATQGGTYRCFGSFHDSPYEWSKSSDPLLVSVTGNPSNSWPSPTEPSSKTGNPRHLHVLIGTSVVKLPFTILLFFLLHRWCSDKKNASVMDQGPAGNRTVNREDSDEQDHQEVSYA

SEQ ID NO: 44065 - protein, 304 aa, Homo sapiens; identical to SEQ ID NO: 36731
  Payload ID: 8985
  Gene Symbol: KIR2DS3
  Gene Name: killer cell immunoglobulin-like receptor, two domains, short cytoplasmic tail, 3
  ENSP ID: ENSP00000479929

SEQ ID NO: 44066 - protein, 304 aa, Homo sapiens; identical to SEQ ID NO: 44064
  Payload ID: 8985
  Gene Symbol: KIR2DS3
  Gene Name: killer cell immunoglobulin-like receptor, two domains, short cytoplasmic tail, 3
  Uniprot ID: Q14952
  ENSP ID: ENSP00000480969

SEQ ID NO: 44067 - protein, 304 aa, Homo sapiens; identical to SEQ ID NO: 36731
  Payload ID: 8985
  Gene Symbol: KIR2DS3
  Gene Name: killer cell immunoglobulin-like receptor, two domains, short cytoplasmic tail, 3
  ENSP ID: ENSP00000482047

SEQ ID NO: 44068 - protein, 304 aa, Homo sapiens; identical to SEQ ID NO: 44064
  Payload ID: 8985
  Gene Symbol: KIR2DS3
  Gene Name: killer cell immunoglobulin-like receptor, two domains, short cytoplasmic tail, 3
  Uniprot ID: Q14952
  ENSP ID: ENSP00000483315

SEQ ID NO: 44069 - protein, 294 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000340011
MSLMVIIMACVGFFLLQGAWPQEGVHRKPSFLALPGHLVKSEETVILQCWSDVMFEHFLLHREGKFNNTLHLIGEHHDGVSKANFSIGPMMPVLAGTYRCYGSVPHSPYQLSAPSDPLDMVIIGLYEKPSLSAQPGPTVQAGENVTLSCSSIYPGKGRPMNVGSLQCAASTEHSRPTFLWALPPTEGPTDASALSVTLPTSGQTRVIHCLFPSQETLQIVGLHPLNQAPKPVTPDTYMFLGPQWSKSLSPSSSSFSFIAGAPTKKMLLWTKSLQGTEQTARILMNKTIRRCHTH

SEQ ID NO: 44070 - protein, 224 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000375609
MSLMVIIMACVGFFLLQGAWPQEGVHRKPSFLALPGHLVKSEETVILQCWSDVMFEHFLLHREGKFNNTLHLIGEHHDGVSKANFSIGPMMPVLAGTYRCYGSVPHSPYQLSAPSDPLDMVIIGLYEKPSLSAQPGPTVQAGENVTLSCSSIYPGKGRPMNVGSLQCAASTEHSRPTFLWALPPTEGPTDASALSVTLPTSGQTRVIHCLFPSQVTPDTYMFLG

SEQ ID NO: 44071 - protein, 304 aa, Homo sapiens
  Payload ID: 8986
  Gene Symbol: KIR2DS4
  Gene Name: killer cell immunoglobulin-like receptor, two domains, short cytoplasmic tail, 4
  Uniprot ID: P43632
  ENSP ID: ENSP00000477744
MSLMVIIMACVGFFLLQGAWPQEGVHRKPSFLALPGHLVKSEETVILQCWSDVMFEHFLLHREGKFNNTLHLIGEHHDGVSKANFSIGPMMPVLAGTYRCYGSVPHSPYQLSAPSDPLDMVIIGLYEKPSLSAQPGPTVQAGENVTLSCSSRSSYDMYHLSREGEAHERRLPAVRSINGTFQADFPLGPATHGGTYRCFGSFRDAPYEWSNSSDPLLVSVTGNPSNSWPSPTEPSSKTGNPRHLHVLIGTSVVKIPFTILLFFLLHRWCSDKKNAAVMDQEPAGNRTVNSEDSDEQDHQEVSYA

SEQ ID NO: 44072 - protein, 304 aa, Homo sapiens; identical to SEQ ID NO: 44071
  Payload ID: 8986
  Gene Symbol: KIR2DS4
  Gene Name: killer cell immunoglobulin-like receptor, two domains, short cytoplasmic tail, 4
  Uniprot ID: P43632
  ENSP ID: ENSP00000478241

SEQ ID NO: 44073 - protein, 294 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000478383
MSLMVIIMACVGFFLLQGAWPQEEVHRKPSFLALPGHLVKSEETVILQCWSDVMFEHFLLHREGKFNNTLHLIGEHHDGVSKANFSIGPMMPVLAGTYRCYGSVTHSPYQLSAPSDPLDMVIIGLYEKPSLSAQPGPTVQAGENVTLSCSSIYPGKGRPMNVGSLQCAASTEHSRPTFLWALPPTEGPTDASALSVTLPTSGQTRVIHCLFPSQETLQIVGLHPLNQAPKPVTPDTYMFLGPQWSKSLSPSSSSFSFIAGAPTKKMLLWTKSLQGTEQTARILMNKTIRRCHTH

SEQ ID NO: 44074 - protein, 294 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000478998
MSLMVIIMACVGFFLLQGAWPQEGVHRKPSFLALPGHLVKSEETVILQCWSDVMFEHFLLHREGKFNNTLHLIGEHHDGVSKANFSIGPMMPVLAGTYRCYGSVPHSPYQLSAPSDPLDMVIIGLYEKPSLSAQPGPTVQAGENVTLSCSSIYPGRGRPMNVGSLQCAASTEHSRPTFLWALPPTEGPTDASALSVTLPTSGQTRVIHCLFPSQETLQIVGLHPLNQAPKPVTPDTYMFLGPQWSKSLSPSSSSFSFIAGAPTKKMLLWTKSLQGTEQTARILMNKTIRRCHTH

SEQ ID NO: 44075 - protein, 224 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000479129
MSLMVIIMACVGFFLLQGAWPQEGVHRKPSFLALPGHLVKSEETVILQCWSDVMFEHFLLHREGKFNNTLHLIGEHHDGVSKANFSIGPMMPVLAGTYRCYGSVPHSPYQLSAPSDPLDMVIIGLYEKPSLSAQPGPTVQAGENVTLSCSSIYPGRGRPMNVGSLQCAASTEHSRPTFLWALPPTEGPTDASALSVTLPTSGQTRVIHCLFPSQVTPDTYMFLG

SEQ ID NO: 44076 - protein, 294 aa, Homo sapiens; identical to SEQ ID NO: 44073
  Payload ID: 8986
  Gene Symbol: KIR2DS4
  Gene Name: killer cell immunoglobulin-like receptor, two domains, short cytoplasmic tail, 4
  ENSP ID: ENSP00000479356

SEQ ID NO: 44077 - protein, 294 aa, Homo sapiens; identical to SEQ ID NO: 44069
  Payload ID: 8986
  Gene Symbol: KIR2DS4
  Gene Name: killer cell immunoglobulin-like receptor, two domains, short cytoplasmic tail, 4
  ENSP ID: ENSP00000479369

SEQ ID NO: 44078 - protein, 370 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000479404
MSLMVIIMACVGFFLLQGAWPQEGVHRKPSFLALPGHLVKSEETVILQCWSDVMFEHFLLHREGKFNNTLHLIGEHHDGVSKANFSIGPMMPVLAGTYRCYGSVPHSPYQLSAPSDPLDMVIIGLYEKPSLSAQPGPTVQAGENVTLSCSSIYPGRGRPMNVGSLQCAASTEHSRPTFLWALPPTEGPTDASALSVTLPTSGQTRVIHCLFPSQETLQIVGLHPLNQAPKPVTPDTYMFLGPQWSKSLSPSSSSFSFIAGAPTKKMLLWTKSLQGTEQTARILMNKTIRRCHTHNWITVFSHREKSLALLRGPRHPQQIPACTNFQMLSPDPKLSSVHEHHSQALRGSSRETTALSQNRVASSHVPAAGI

SEQ ID NO: 44079 - protein, 239 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000479749
MSLMVIIMACVGFFLLQGAWPQEGVHRKPSFLALPGHLVKSEETVILQCWSDVMFEHFLLHREGKFNNTLHLIGEHHDGVSKANFSIGPMMPVLAGTYRCYGSVPHSPYQLSAPSDPLDMVIIGLYEKPSLSAQPGPTVQAGENVTLSCSSIYPGKGRPMNVGSLQCAASTEHSRPTFLWALPPTEGPTDASALSVTLPTSGQTRVIHCLFPSQETLQIVGLHPLNQAPKPVTPDTYMF

SEQ ID NO: 44080 - protein, 304 aa, Homo sapiens; identical to SEQ ID NO: 44071
  Payload ID: 8986
  Gene Symbol: KIR2DS4
  Gene Name: killer cell immunoglobulin-like receptor, two domains, short cytoplasmic tail, 4
  Uniprot ID: P43632
  ENSP ID: ENSP00000479843

SEQ ID NO: 44081 - protein, 304 aa, Homo sapiens; identical to SEQ ID NO: 44071
  Payload ID: 8986
  Gene Symbol: KIR2DS4
  Gene Name: killer cell immunoglobulin-like receptor, two domains, short cytoplasmic tail, 4
  Uniprot ID: P43632
  ENSP ID: ENSP00000480062

SEQ ID NO: 44082 - protein, 171 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000480110
TLHLIGEHHDGVSKANFSIGPMMPVLAGTYRCYGSVTHSPYQLSAPSDPLDMVIIGLYEKPSLSAQPGPTVQAGENVTLSCSSIYPGKGRPMNVGSLQCAASTEHSRPTFLWALPPTEGPTDASALSVTLPTSGQTRVIHCLFPSQETLQIVGLHPLNQAPKPVTPDTYMF

SEQ ID NO: 44083 - protein, 294 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000481139
MSLMVIIMACVGFFLLQGAWPQEGVHRKPSFLALPGHLVKSEETVILQCWSDVMFEHFLLHREGKFNNTLHLIGEHHDGVSKANFSIGPMMPVLAGTYRCYSSVPHSPYQLSAPSDPLDMVIIGLYEKPSLSAQPGPTVQAGENVSLSCSSIYPGRGRPMNVGSLQCAASTEHSRPTFLWALPPTEGPTDASALSVTLPTSGQTRVIHCLFPSQETLQIVGLHPLNQAPKPVTPDTYMFLGPQWSKSLSPSSSSFSFIAGAPTKKMLLWTKSLQGTEQTARILMNKTIRRCHTH

SEQ ID NO: 44084 - protein, 398 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000481214
MSLMVIIMACVGFFLLQGAWPQEGGQDKPLLSTWPSLVVPPEHVTLQCHSNLGFNNFSLYKDDGVPVPELYNRIFWKSLFMGPVTPSHAGTYRCRGSHTHSPSGWSAPSNPLVIMVTGVHRKPSFLALPGHLVKSEETVILQCWSDVMFEHFLLHREGKFNNTLHLIGEHHDGVSKANFSIGPMMPVLAGTYRCYGSVPHSPYQLSAPSDPLDMVIIGLYEKPSLSAQPGPTVQAGENVTLSCSSRSSYDMYHLSREGEAHERRLPAVRSINGTFQADFPLGPATHGGTYRCFGSFRDAPYEWSNSSDPLLVSVTGNPSNSWPSPTEPSSKTGNPRHLHVLIGTSVVKIPFTILLFFLLHRWCSDKKNAAVMDQEPAGNRTVNSEDSDEQDHQEVSYA

SEQ ID NO: 44085 - protein, 370 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000481279
MSLMVIIMACVGFFLLQGAWPQEEVHRKPSFLALPGHLVKSEETVILQCWSDVMFEHFLLHREGKFNNTLHLIGEHHDGVSKANFSIGPMMPVLAGTYRCYGSVTHSPYQLSAPSDPLDMVIIGLYEKPSLSAQPGPTVQAGENVTLSCSSIYPGKGRPMNVGSLQCAASTEHSRPTFLWALPPTEGPTDASALSVTLPTSGQTRVIHCLFPSQETLQIVGLHPLNQAPKPVTPDTYMFLGPQWSKSLSPSSSSFSFIAGAPTKKMLLWTKSLQGTEQTARILMNKTIRRCHTHNWITVFSHREKSLALLRGPRHPQQIPACTNFQMLSPDPKLSSVHEHHSQALRGSSRETTALSQNRVASSHVPAAGI

SEQ ID NO: 44086 - protein, 301 aa, Homo sapiens
  Payload ID: 8986
  Gene Symbol: KIR2DS4
  Gene Name: killer cell immunoglobulin-like receptor, two domains, short cytoplasmic tail, 4
  Uniprot ID: P43632
  ENSP ID: ENSP00000481319
MVIIMACVGFFLLQGAWPQEGVHRKPSFLALPGHLVKSEETVILQCWSDVMFEHFLLHREGKFNNTLHLIGEHHDGVSKANFSIGPMMPVLAGTYRCYGSVPHSPYQLSAPSDPLDMVIIGLYEKPSLSAQPGPTVQAGENVTLSCSSRSSYDMYHLSREGEAHERRLPAVRSINGTFQADFPLGPATHGGTYRCFGSFRDAPYEWSNSSDPLLVSVTGNPSNSWPSPTEPSSKTGNPRHLHVLIGTSVVKIPFTILLFFLLHRWCSDKKNAAVMDQEPAGNRTVNSEDSDEQDHQEVSYA

SEQ ID NO: 44087 - protein, 294 aa, Homo sapiens; identical to SEQ ID NO: 44069
  Payload ID: 8986
  Gene Symbol: KIR2DS4
  Gene Name: killer cell immunoglobulin-like receptor, two domains, short cytoplasmic tail, 4
  ENSP ID: ENSP00000481428

SEQ ID NO: 44088 - protein, 304 aa, Homo sapiens; identical to SEQ ID NO: 44071
  Payload ID: 8986
  Gene Symbol: KIR2DS4
  Gene Name: killer cell immunoglobulin-like receptor, two domains, short cytoplasmic tail, 4
  Uniprot ID: P43632
  ENSP ID: ENSP00000481753

SEQ ID NO: 44089 - protein, 304 aa, Homo sapiens; identical to SEQ ID NO: 44071
  Payload ID: 8986
  Gene Symbol: KIR2DS4
  Gene Name: killer cell immunoglobulin-like receptor, two domains, short cytoplasmic tail, 4
  Uniprot ID: P43632
  ENSP ID: ENSP00000483112

SEQ ID NO: 44090 - protein, 304 aa, Homo sapiens; identical to SEQ ID NO: 44071
  Payload ID: 8986
  Gene Symbol: KIR2DS4
  Gene Name: killer cell immunoglobulin-like receptor, two domains, short cytoplasmic tail, 4
  Uniprot ID: P43632
  ENSP ID: ENSP00000483274

SEQ ID NO: 44091 - protein, 222 aa, Homo sapiens
  Payload ID: 8986
  Gene Symbol: KIR2DS4
  Gene Name: killer cell immunoglobulin-like receptor, two domains, short cytoplasmic tail, 4
  ENSP ID: ENSP00000483571
MSLMVIIMACVGFFLLQGAWPQEGVHRKPSFLALPGHLVKSEETVILQCWSDVMFEHFLLHREGKFNNTLHLIGEHHDGVSKANFSIGPMMPVLAGTYRCYSSVPHSPYQLSAPSDPLDMVIIGLYEKPSLSAQPGPTVQAGENVSLSCSSIYPGRGRPMNVGSLQCAASTEHSRPTFLWALPPTEGPTDASALSVTLPTSGQTRVIHCLFPSQVTPDTYMF

SEQ ID NO: 44092 - protein, 294 aa, Homo sapiens; identical to SEQ ID NO: 44069
  Payload ID: 8986
  Gene Symbol: KIR2DS4
  Gene Name: killer cell immunoglobulin-like receptor, two domains, short cytoplasmic tail, 4
  ENSP ID: ENSP00000483620

SEQ ID NO: 44093 - protein, 304 aa, Homo sapiens; identical to SEQ ID NO: 44071
  Payload ID: 8986
  Gene Symbol: KIR2DS4
  Gene Name: killer cell immunoglobulin-like receptor, two domains, short cytoplasmic tail, 4
  Uniprot ID: P43632
  ENSP ID: ENSP00000484123

SEQ ID NO: 44094 - protein, 304 aa, Homo sapiens
  Payload ID: 8987
  Gene Symbol: KIR2DS5
  Gene Name: killer cell immunoglobulin-like receptor, two domains, short cytoplasmic tail, 5
  ENSP ID: ENSP00000477721
MSLMVISMACVAFFLLQGAWPHEGFRRKPSLLAHPGPLVKSEETVILQCWSDVMFEHFLLHREGTFNHTLRLIGEHIDGVSKGNFSIGRMTQDLAGTYRCYGSVTHSPYQLSAPSDPLDIVITGLYEKPSLSAQPGPTVLAGESVTLSCSSRSSYDMYHLSREGEAHERRLPAGPKVNGTFQADFPLDPATHGGTYRCFGSFRDSPYEWSKSSDPLLVSVTGNSSNSWPSPTEPSSKTGNPRHLHVLIGTSVVKLPFTILLFFLLHRWCSNKKNASVMDQGPAGNRTVNREDSDEQDHQEVSYA

SEQ ID NO: 44095 - protein, 304 aa, Homo sapiens
  Payload ID: 8987
  Gene Symbol: KIR2DS5
  Gene Name: killer cell immunoglobulin-like receptor, two domains, short cytoplasmic tail, 5
  ENSP ID: ENSP00000481293
MSLMVISMACVAFFLLQGAWPHEGFRRKPSLLAHPGPLVKSEETVILQCWSDVMFEHFLLHREGTFNHTLRLIGEHIDGVSKGNFSIGRMTQDLAGTYRCYGSVTHSPYQLSAPSDPLDIVITGLYEKPSLSAQPGPTVLAGESVTLFCSSRSSYDMYHLSREGEAHERRLPAGPKVNGTFQADFPLDPATHGGTYRCFGSFHDSPYEWSKSSDPLLVSVTGNSSNSWPSPTEPSSETGNPRHLHVLIGTSVVKLPFTILLFFLLHRWCSNKKNASVMDQGPAGNRTVNREDSDEQDHQEVSYA

SEQ ID NO: 44096 - protein, 304 aa, Homo sapiens
  Payload ID: 8987
  Gene Symbol: KIR2DS5
  Gene Name: killer cell immunoglobulin-like receptor, two domains, short cytoplasmic tail, 5
  ENSP ID: ENSP00000482547
MSLMVISMACVAFFLLQGAWPHEGFRRKPSLLAHPGPLVKSEETVILQCWSDVMFEHFLLHREGTFNHTLRLIGEHIDGVSKGNFSIGRMTQDLAGTYRCYGSVTHSPYQLSAPSDPLDIVITGLYEKPSLSAQPGPTVLAGESVTLSCSSRSSYDMYHLSREGEAHERRLPAGPKVNRTFQADFPLDPATHGGTYRCFGSFRDSPYEWSKSSDPLLVSVTGNSSNSWPSPTEPSSETGNPRHLHVLIGTSVVKLPFTILLFFLLHRWCSNKKNASVMDQGPAGNRTVNREDSDEQDHQEVSYA

SEQ ID NO: 44097 - protein, 304 aa, Homo sapiens; identical to SEQ ID NO: 44096
  Payload ID: 8987
  Gene Symbol: KIR2DS5
  Gene Name: killer cell immunoglobulin-like receptor, two domains, short cytoplasmic tail, 5
  ENSP ID: ENSP00000483733

SEQ ID NO: 44098 - protein, 349 aa, Homo sapiens
  Payload ID: 8987
  Gene Symbol: KIR2DS5
  Gene Name: killer cell immunoglobulin-like receptor, two domains, short cytoplasmic tail, 5
  ENSP ID: ENSP00000483901
MSLMVVSMACVGFFLLQGAWTHEGFRRKPSLLAHPGPLVKSEETVILQCWSDVMFEHFLLHREGTFNHTLRLIGEHIDGVSKGNFSIGRMTQDLAGTYRCYGSVTHSPYQLSAPSDPLDIVITGLYEKPSLSAQPGPTVLAGESVTLSCSSRSSYDMYHLSREGEAHERRLPAGPKVNGTFQADFPLDPATHGGTYRCFGSFRDSPYEWSKSSDPLLVSVTGNPSNSWPSPTEPSSKTGNPRHLHVLIGTSVVIILFILLLFFLLHRWCSNKKNAAVMDQEPAGNRTANSEDSDEQDPQEVTYVQLDHCVFTQRKITRPSQRPKTPPTDTRVYTELPNAESRSNVVSCP

SEQ ID NO: 44099 - protein, 304 aa, Homo sapiens; identical to SEQ ID NO: 44096
  Payload ID: 8987
  Gene Symbol: KIR2DS5
  Gene Name: killer cell immunoglobulin-like receptor, two domains, short cytoplasmic tail, 5
  ENSP ID: ENSP00000484843

SEQ ID NO: 44100 - protein, 225 aa, Homo sapiens
  Payload ID: 8988
  Gene Symbol: KLRB1
  Gene Name: killer cell lectin-like receptor subfamily B, member 1
  Uniprot ID: Q12918
  ENSP ID: ENSP00000229402
MDQQAIYAELNLPTDSGPESSSPSSLPRDVCQGSPWHQFALKLSCAGIILLVLVVTGLSVSVTSLIQKSSIEKCSVDIQQSRNKTTERPGLLNCPIYWQQLREKCLLFSHTVNPWNNSLADCSTKESSLLLIRDKDELIHTQNLIRDKAILFWIGLNFSLSEKNWKWINGSFLNSNDLEIRGDAKENSCISISQTSVYSEYCSTEIRWICQKELTPVRNKVYPDS

SEQ ID NO: 44101 - protein, 215 aa, Homo sapiens
  Payload ID: 8989
  Gene Symbol: KLRC1
  Gene Name: killer cell lectin-like receptor subfamily C, member 1
  Uniprot ID: P26715
  ENSP ID: ENSP00000256965
MDNQGVIYSDLNLPPNPKRQQRKPKGNKNSILATEQEITYAELNLQKASQDFQGNDKTYHCKDLPSAPEKLIVGILGIICLILMASVVTIVVIPSRHCGHCPEEWITYSNSCYYIGKERRTWEESLLACTSKNSSLLSIDNEEEMKFLSIISPSSWIGVFRNSSHHPWVTMNGLAFKHEIKDSDNAELNCAVLQVNRLKSAQCGSSIIYHCKHKL

SEQ ID NO: 44102 - protein, 233 aa, Homo sapiens
  Payload ID: 8989
  Gene Symbol: KLRC1
  Gene Name: killer cell lectin-like receptor subfamily C, member 1
  Uniprot ID: P26715
  ENSP ID: ENSP00000352064
MDNQGVIYSDLNLPPNPKRQQRKPKGNKNSILATEQEITYAELNLQKASQDFQGNDKTYHCKDLPSAPEKLIVGILGIICLILMASVVTIVVIPSTLIQRHNNSSLNTRTQKARHCGHCPEEWITYSNSCYYIGKERRTWEESLLACTSKNSSLLSIDNEEEMKFLSIISPSSWIGVFRNSSHHPWVTMNGLAFKHEIKDSDNAELNCAVLQVNRLKSAQCGSSIIYHCKHKL

SEQ ID NO: 44103 - protein, 215 aa, Homo sapiens; identical to SEQ ID NO: 44101
  Payload ID: 8989
  Gene Symbol: KLRC1
  Gene Name: killer cell lectin-like receptor subfamily C, member 1
  Uniprot ID: P26715
  ENSP ID: ENSP00000385304

SEQ ID NO: 44104 - protein, 233 aa, Homo sapiens; identical to SEQ ID NO: 44102
  Payload ID: 8989
  Gene Symbol: KLRC1
  Gene Name: killer cell lectin-like receptor subfamily C, member 1
  Uniprot ID: P26715
  ENSP ID: ENSP00000438038

SEQ ID NO: 44105 - protein, 228 aa, Homo sapiens
  Payload ID: 8989
  Gene Symbol: KLRC1
  Gene Name: killer cell lectin-like receptor subfamily C, member 1
  ENSP ID: ENSP00000441432
MDNQGVIYSDLNLPPNPKRQQRKPKGNKNSILATEQEITYAELNLQKASQDFQGNDKTYHCKDLPSAPEKLIVGILGIICLILMASVVTIVVIPSTLIQRHNNSSLNTRTQKARHCGHCPEEWITYSNSCYYIGKERRTWEESLLACTSKNSSLLSIDNEEEMKFLSIISPSSWIGVFRNSSHHPWVTMNGLAFKHEIKDSDNAELNCAVLQVNRLKSAQCGSSIIYH

SEQ ID NO: 44106 - protein, 77 aa, Homo sapiens
  Payload ID: 8989
  Gene Symbol: KLRC1
  Gene Name: killer cell lectin-like receptor subfamily C, member 1
  ENSP ID: ENSP00000442545
  MOD_RES (1)..(1): Any amino acid
XEWITYSNSCYYIGKERRTWEESLLACTSKNSSLLSIDNEEEMKFLSIISPSSWIGVFRNSSHHPWVTMNGLAFKHE

SEQ ID NO: 44107 - protein, 231 aa, Homo sapiens
  Payload ID: 8990
  Gene Symbol: KLRC2
  Gene Name: killer cell lectin-like receptor subfamily C, member 2
  ENSP ID: ENSP00000371326
MNKQRGTFSEVSLAQDPKRQQRKPKGNKSSISGTEQEIFQVELNLQNPSLNHQGIDKIYDCQGLLPPPEKLTAEVLGIICIVLMATVLKTIVLIPFLEQNNSSPNTRTQKTRHCGHCPEEWITYSNSCYYIGKERRTWEESLLACTSKNSSLLSIDNEEEMKFLASILPSSWIGVFRNSSHHPWVTINGLAFKHKIKDSDNAELNCAVLQVNRLKSAQCGSSMIYHCKHKL

SEQ ID NO: 44108 - protein, 231 aa, Homo sapiens
  Payload ID: 8990
  Gene Symbol: KLRC2
  Gene Name: killer cell lectin-like receptor subfamily C, member 2
  Uniprot ID: P26717
  ENSP ID: ENSP00000371327
MNKQRGTFSEVSLAQDPKRQQRKPKGNKSSISGTEQEIFQVELNLQNPSLNHQGIDKIYDCQGLLPPPEKLTAEVLGIICIVLMATVLKTIVLIPFLEQNNFSPNTRTQKARHCGHCPEEWITYSNSCYYIGKERRTWEESLLACTSKNSSLLSIDNEEEMKFLASILPSSWIGVFRNSSHHPWVTINGLAFKHKIKDSDNAELNCAVLQVNRLKSAQCGSSMIYHCKHKL

SEQ ID NO: 44109 - protein, 103 aa, Homo sapiens
  Payload ID: 8990
  Gene Symbol: KLRC2
  Gene Name: killer cell lectin-like receptor subfamily C, member 2
  ENSP ID: ENSP00000438983
KSSISGTEQEIFQVELNLQNPSLNHQGIDKIYDCQGLLPPPEKLTAEVLGIICIVLMATVLKTIVLIPFLEQNNFSPNTRTQKEELGKRVCWPVLRRTPVCFL

SEQ ID NO: 44110 - protein, 172 aa, Homo sapiens
  Payload ID: 8990
  Gene Symbol: KLRC2
  Gene Name: killer cell lectin-like receptor subfamily C, member 2
  ENSP ID: ENSP00000444754
MTVGLLPPPEKLTAEVLGIICIVLMATVLKTIVLIPFLEQNNFSPNTRTQKARHCGHCPEEWITYSNSCYYIGKERRTWEESLLACTSKNSSLLSIDNEEEMKFLASILPSSWIGVFRNSSHHPWVTINGLAFKHKIKDSDNAELNCAVLQVNRLKSAQCGSSMIYHCKHKL

SEQ ID NO: 44111 - protein, 85 aa, Homo sapiens
  Payload ID: 8990
  Gene Symbol: KLRC2
  Gene Name: killer cell lectin-like receptor subfamily C, member 2
  ENSP ID: ENSP00000445240
  MOD_RES (1)..(1): Any amino acid
XYSNSCYYIGKERRTWEESLLACTSKNSSLLSIDNEEEMKFLASILPSSWIGVFRNSSHHPWVTINGLAFKHNTWKMLSSHESFA

SEQ ID NO: 44112 - protein, 124 aa, Homo sapiens
  Payload ID: 8990
  Gene Symbol: KLRC2
  Gene Name: killer cell lectin-like receptor subfamily C, member 2
  ENSP ID: ENSP00000479152
MIPTRHCGHCPEEWITYSNSCYYIGKERRTWEESLLACTSKNSSLLSIDNEEEMKFLASILPSSWIGVFRNSSHHPWVTINGLAFKHKIKDSDNAELNCAVLQVNRLKSAQCGSSMIYHCKHKL

SEQ ID NO: 44113 - protein, 257 aa, Homo sapiens
  Payload ID: 8991
  Gene Symbol: KLRC3
  Gene Name: killer cell lectin-like receptor subfamily C, member 3
  Uniprot ID: Q07444
  ENSP ID: ENSP00000371328
MSKQRGTFSEVSLAQDPKWQQRKPKGNKSSISGTEQEIFQVELNLQNASLNHQGIDKIYDCQGLLPPPEKLTAEVLGIICIVLMATVLKTIVLIPFLEQNNSSPNARTQKARHCGHCPEEWITYSNSCYYIGKERRTWEESLQACASKNSSSLLCIDNEEEMKFLASILPSSWIGVFRNSSHHPWVTINGLAFKHEIKDSDHAERNCAMLHVRGLISDQCGSSRIIVSISFRIKALELAVHQIKFYICSNRNDIMIA

SEQ ID NO: 44114 - protein, 240 aa, Homo sapiens
  Payload ID: 8991
  Gene Symbol: KLRC3
  Gene Name: killer cell lectin-like receptor subfamily C, member 3
  Uniprot ID: Q07444
  ENSP ID: ENSP00000379716
MSKQRGTFSEVSLAQDPKWQQRKPKGNKSSISGTEQEIFQVELNLQNASLNHQGIDKIYDCQGLLPPPEKLTAEVLGIICIVLMATVLKTIVLIPFLEQNNSSPNARTQKARHCGHCPEEWITYSNSCYYIGKERRTWEESLQACASKNSSSLLCIDNEEEMKFLASILPSSWIGVFRNSSHHPWVTINGLAFKHEIKDSDHAERNCAMLHVRGLISDQCGSSRIIRRGFIMLTRLVLNS

SEQ ID NO: 44115 - protein, 158 aa, Homo sapiens
  Payload ID: 8992
  Gene Symbol: KLRC4
  Gene Name: killer cell lectin-like receptor subfamily C, member 4
  Uniprot ID: O43908
  ENSP ID: ENSP00000310216
MNKQRGTYSEVSLAQDPKRQQRKLKGNKISISGTKQEIFQVELNLQNASSDHQGNDKTYHCKGLLPPPEKLTAEVLGIICIVLMATVLKTIVLIPCIGVLEQNNFSLNRRMQKARHCGHCPEEWITYSNSCYYIGKERRTWEERVCWPVLRRTLICFL

SEQ ID NO: 44116 - protein, 148 aa, Homo sapiens
  Payload ID: 8993
  Gene Symbol: KLRD1
  Gene Name: killer cell lectin-like receptor subfamily D, member 1
  Uniprot ID: Q13241
  ENSP ID: ENSP00000310929
MAAFTKLSIEPAFTPGPNIELQKDSDCCSCQEKWVGYRCNCYFISSEQKTWNESRHLCASQKSSLLQLQNTDELDFMSSSQQFYWIGLSYSEEHTAWLWENGSALSQYLFPSFETFNTKNCIAYNPNGNALDESCEDKNRYICKQQLI

SEQ ID NO: 44117 - protein, 179 aa, Homo sapiens
  Payload ID: 8993
  Gene Symbol: KLRD1
  Gene Name: killer cell lectin-like receptor subfamily D, member 1
  Uniprot ID: Q13241
  ENSP ID: ENSP00000338130
MAVFKTTLWRLISGTLGIICLSLMSTLGILLKNSFTKLSIEPAFTPGPNIELQKDSDCCSCQEKWVGYRCNCYFISSEQKTWNESRHLCASQKSSLLQLQNTDELDFMSSSQQFYWIGLSYSEEHTAWLWENGSALSQYLFPSFETFNTKNCIAYNPNGNALDESCEDKNRYICKQQLI

SEQ ID NO: 44118 - protein, 72 aa, Homo sapiens
  Payload ID: 8993
  Gene Symbol: KLRD1
  Gene Name: killer cell lectin-like receptor subfamily D, member 1
  ENSP ID: ENSP00000344858
MAVFKTTLWRLISGTLGIICLSLMSTLGILLKNSFTKLSIEPAFTPGPNIELQKAGFYELQSTILLDWTLLQ

SEQ ID NO: 44119 - protein, 179 aa, Homo sapiens; identical to SEQ ID NO: 44117
  Payload ID: 8993
  Gene Symbol: KLRD1
  Gene Name: killer cell lectin-like receptor subfamily D, member 1
  Uniprot ID: Q13241
  ENSP ID: ENSP00000371333

SEQ ID NO: 44120 - protein, 51 aa, Homo sapiens
  Payload ID: 8993
  Gene Symbol: KLRD1
  Gene Name: killer cell lectin-like receptor subfamily D, member 1
  ENSP ID: ENSP00000437880
SALSQYLFPSFETFNTKNCIAYNPNGNALDESCEDKNRYIYKVLLCCPGWS

SEQ ID NO: 44121 - protein, 106 aa, Homo sapiens
  Payload ID: 8993
  Gene Symbol: KLRD1
  Gene Name: killer cell lectin-like receptor subfamily D, member 1
  ENSP ID: ENSP00000438514
MAVFKTTLWRLISGTLGIICLSLMSTLGILLKNSFTKLSIEPAFTPGPNIELQKDSDCCSCQEKWVGYRCNCYFISSEQKTWNESRHLCASQKSSLLQLQNTDELA

SEQ ID NO: 44122 - protein, 139 aa, Homo sapiens
  Payload ID: 8993
  Gene Symbol: KLRD1
  Gene Name: killer cell lectin-like receptor subfamily D, member 1
  ENSP ID: ENSP00000438669
MAAFTKLSIEPAFTPGPNIELQKDSDCCSCQEKWVGYRCNCYFISSEQKTWNESRHLCASQKSSLLQLQNTDELDFMSSSQQFYWIGLSYSEEHTAWLWENGSALSQYLFPSFETFNTKNCIAYNPNGNALDESCEDKN

SEQ ID NO: 44123 - protein, 106 aa, Homo sapiens; identical to SEQ ID NO: 44121
  Payload ID: 8993
  Gene Symbol: KLRD1
  Gene Name: killer cell lectin-like receptor subfamily D, member 1
  ENSP ID: ENSP00000441074

SEQ ID NO: 44124 - protein, 158 aa, Homo sapiens
  Payload ID: 8993
  Gene Symbol: KLRD1
  Gene Name: killer cell lectin-like receptor subfamily D, member 1
  ENSP ID: ENSP00000443584
MAVFKTTLWRLISGTLGIICLSLMSTLGILLKNYSDCCSCQEKWVGYRCNCYFISSEQKTWNESRHLCASQKSSLLQLQNTDELDFMSSSQQFYWIGLSYSEEHTAWLWENGSALSQYLFPSFETFNTKNCIAYNPNGNALDESCEDKNRYICKQQLI

SEQ ID NO: 44125 - protein, 181 aa, Homo sapiens
  Payload ID: 8994
  Gene Symbol: KLRF1
  Gene Name: killer cell lectin-like receptor subfamily F, member 1
  ENSP ID: ENSP00000279545
MQDEERYMTLNVQSKKRSSAQTSQLTFKDYSVTLHWYKILLGISGTVNGILTLTLISLILLVLCQSEWLKYQGKCYWFSNEMKSWSDSYVYCLERKSHLLIIHDQLEMAFIQKNLRQLNYVWIGLNFTSLKMTWTWVDGSPIDSKIFFIKGPAKENSCAAIKESKIFSETCSSVFKWICQY

SEQ ID NO: 44126 - protein, 64 aa, Homo sapiens
  Payload ID: 8994
  Gene Symbol: KLRF1
  Gene Name: killer cell lectin-like receptor subfamily F, member 1
  Uniprot ID: Q9NZS2
  ENSP ID: ENSP00000346919
MQDEERYMTLNVQSKKRSSAQTSQLTFKDYSVTLHWYKILLGISGTVNGILTLTLISLILLDSS

SEQ ID NO: 44127 - protein, 114 aa, Homo sapiens
  Payload ID: 8994
  Gene Symbol: KLRF1
  Gene Name: killer cell lectin-like receptor subfamily F, member 1
  ENSP ID: ENSP00000443054
MQDEERYMTLNVQSKKRSSAQTSQLTFKDYSVTLHWYKILLGISGTVNGILTLTLISLILLVSQGVLLKCQKGSCSNATQYEDTGDLKVNNGTRRNISNKDLCASRSADQTDSS

SEQ ID NO: 44128 - protein, 124 aa, Homo sapiens
  Payload ID: 8994
  Gene Symbol: KLRF1
  Gene Name: killer cell lectin-like receptor subfamily F, member 1
  ENSP ID: ENSP00000445022
MQDEERYMTLNVQSKKRSSAQTSQLTFKDYSVTLHWYKILLGISGTVNGILTLTLISLILLVSQGVLLKCQKGSCSNATQYEDTGDLKVNNGTRRNISNKDLCASRSADQTVPRPHFRLLYRKT

SEQ ID NO: 44129 - protein, 231 aa, Homo sapiens
  Payload ID: 8994
  Gene Symbol: KLRF1
  Gene Name: killer cell lectin-like receptor subfamily F, member 1
  ENSP ID: ENSP00000483713
MQDEERYMTLNVQSKKRSSAQTSQLTFKDYSVTLHWYKILLGISGTVNGILTLTLISLILLVSQGVLLKCQKGSCSNATQYEDTGDLKVNNGTRRNISNKDLCASRSADQTVLCQSEWLKYQGKCYWFSNEMKSWSDSYVYCLERKSHLLIIHDQLEMAFIQKNLRQLNYVWIGLNFTSLKMTWTWVDGSPIDSKIFFIKGPAKENSCAAIKESKIFSETCSSVFKWICQY

SEQ ID NO: 44130 - protein, 78 aa, Homo sapiens
  Payload ID: 8994
  Gene Symbol: KLRF1
  Gene Name: killer cell lectin-like receptor subfamily F, member 1
  Uniprot ID: Q9NZS2
  ENSP ID: ENSP00000483880
MQDEERYMTLNVQSKKRSSAQTSQLTFKDYSVTLHWYKILLGISGTVNGILTLTLISLILLGFYTEKPKTIKLRMDWA

SEQ ID NO: 44131 - protein, 128 aa, Homo sapiens
  Payload ID: 8994
  Gene Symbol: KLRF1
  Gene Name: killer cell lectin-like receptor subfamily F, member 1
  ENSP ID: ENSP00000484826
MQDEERYMTLNVQSKKRSSAQTSQLTFKDYSVTLHWYKILLGISGTVNGILTLTLISLILLVSQGVLLKCQKGSCSNATQYEDTGDLKVNNGTRRNISNKDLCASRSADQTGFYTEKPKTIKLRMDWA

SEQ ID NO: 44132 - protein, 207 aa, Homo sapiens
  Payload ID: 8995
  Gene Symbol: KLRF2
  Gene Name: killer cell lectin-like receptor subfamily F, member 2
  Uniprot ID: D3W0D1
  ENSP ID: ENSP00000438244
MENEDGYMTLSFKNRCKSKQKSKDFSLYPQYYCLLLIFGCIVILIFIMTGIDLKFWHKKMDFSQNVNVSSLSGHNYLCPNDWLLNEGKCYWFSTSFKTWKESQRDCTQLQAHLLVIQNLDELEFIQNSLKPGHFGWIGLYVTFQGNLWMWIDEHFLVPELFSVIGPTDDRSCAVITGNWVYSEDCSSTFKGICQRDAILTHNGTSGV

SEQ ID NO: 44133 - protein, 195 aa, Homo sapiens
  Payload ID: 8996
  Gene Symbol: KLRG1
  Gene Name: killer cell lectin-like receptor subfamily G, member 1
  Uniprot ID: Q96E93
  ENSP ID: ENSP00000266551
MTDSVIYSMLELPTATQAQNDYGPQQKSSSSRPSCSCLVAIALGLLTAVLLSVLLYQWILCQGSNYSTCASCPSCPDRWMKYGNHCYYFSVEEKDWNSSLEFCLARDSHLLVITDNQEMSLLQVFLSEAFCWIGLRNNSGWRWEDGSPLNFSRISSNSFVQTCGAINKNGLQASSCEVPLHWVCKKCPFADQALF

SEQ ID NO: 44134 - protein, 189 aa, Homo sapiens
  Payload ID: 8996
  Gene Symbol: KLRG1
  Gene Name: killer cell lectin-like receptor subfamily G, member 1
  Uniprot ID: Q96E93
  ENSP ID: ENSP00000349477
MTDSVIYSMLELPTATQAQNDYGPQQKSSSSRPSCSCLVAIALGLLTAVLLSVLLYQWILCQGSNYSTCASCPSCPDRWMKYGNHCYYFSVEEKDWNSSLEFCLARDSHLLVITDNQEMSLLQVFLSEAFCWIGLRNNSGWRWEDGSPLNFSRISSNSFVQTCGAINKNGLQASSCEVPLHWVCKKVRL

SEQ ID NO: 44135 - protein, 80 aa, Homo sapiens
  Payload ID: 8996
  Gene Symbol: KLRG1
  Gene Name: killer cell lectin-like receptor subfamily G, member 1
  ENSP ID: ENSP00000443658
MKYGNHCYYFSVEEKDWNSSLEFCLARDSHLLVITDNQEMSLLQVFLSEAFCWIGLRNNSGWRWEDGSPLNFSRISSNSF

SEQ ID NO: 44136 - protein, 81 aa, Homo sapiens
  Payload ID: 8996
  Gene Symbol: KLRG1
  Gene Name: killer cell lectin-like receptor subfamily G, member 1
  ENSP ID: ENSP00000445627
MKYGNHCYYFSVEEKDWNSSLEFCLARDSHLLVITDNQEMSLLQVFLSEAFCWIGLRNNSGWRWEDGSPLNFSRISSNSFV

SEQ ID NO: 44137 - protein, 409 aa, Homo sapiens
  Payload ID: 8997
  Gene Symbol: KLRG2
  Gene Name: killer cell lectin-like receptor subfamily G, member 2
  Uniprot ID: A4D1S0
  ENSP ID: ENSP00000339356
MEESWEAAPGGQAGAELPMEPVGSLVPTLEQPQVPAKVRQPEGPESSPSPAGAVEKAAGAGLEPSSKKKPPSPRPGSPRVPPLSLGYGVCPEPPSPGPALVKLPRNGEAPGAEPAPSAWAPMELQVDVRVKPVGAAGGSSTPSPRPSTRFLKVPVPESPAFSRHADPAHQLLLRAPSQGGTWGRRSPLAAARTESGCDAEGRASPAEGSAGSPGSPTCCRCKELGLEKEDAALLPRAGLDGDEKLPRAVTLTGLPMYVKSLYWALAFMAVLLAVSGVVIVVLASRAGARCQQCPPGWVLSEEHCYYFSAEAQAWEASQAFCSAYHATLPLLSHTQDFLGRYPVSRHSWVGAWRGPQGWHWIDEAPLPPQLLPEDGEDNLDINCGALEEGTLVAANCSTPRPWVCAKGTQ

SEQ ID NO: 44138 - protein, 314 aa, Homo sapiens
  Payload ID: 8997
  Gene Symbol: KLRG2
  Gene Name: killer cell lectin-like receptor subfamily G, member 2
  Uniprot ID: A4D1S0
  ENSP ID: ENSP00000376759
MEESWEAAPGGQAGAELPMEPVGSLVPTLEQPQVPAKVRQPEGPESSPSPAGAVEKAAGAGLEPSSKKKPPSPRPGSPRVPPLSLGYGVCPEPPSPGPALVKLPRNGEAPGAEPAPSAWAPMELQVDVRVKPVGAAGGSSTPSPRPSTRFLKVPVPESPAFSRHADPAHQLLLRAPSQGGTWGRRSPLAAARTESGCDAEGRASPAEGSAGSPGSPTCCRCKELGLEKEDAALLPRAGLDGDEKLPRAVTLTDSLRTARTIWISTVGPWRKARWWLQTAALQDPGSVPRGPSDLGSAWSSACQADAAPPTGEAS

SEQ ID NO: 44139 - protein, 216 aa, Homo sapiens
  Payload ID: 8998
  Gene Symbol: KLRK1
  Gene Name: killer cell lectin-like receptor subfamily K, member 1
  Uniprot ID: P26718
  ENSP ID: ENSP00000240618
MGWIRGRRSRHSWEMSEFHNYNLDLKKSDFSTRWQKQRCPVVKSKCRENASPFFFCCFIAVAMGIRFIIMVTIWSAVFLNSLFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTV

SEQ ID NO: 44140 - protein, 80 aa, Homo sapiens
  Payload ID: 8998
  Gene Symbol: KLRK1
  Gene Name: killer cell lectin-like receptor subfamily K, member 1
  ENSP ID: ENSP00000379726
MGWIRGRRSRHSWEMSEFHNYNLDLKKSDFSTRWQKQRCPVVKSKCRENASPFFFCCFIAVAMGIRFIIMVTIWSAVFLN

SEQ ID NO: 44141 - protein, 216 aa, Homo sapiens; identical to SEQ ID NO: 44139
  Payload ID: 8998
  Gene Symbol: KLRK1
  Gene Name: killer cell lectin-like receptor subfamily K, member 1
  Uniprot ID: P26718
  ENSP ID: ENSP00000446003

SEQ ID NO: 44142 - protein, 178 aa, Homo sapiens
  Payload ID: 8999
  Gene Symbol: KLLN
  Gene Name: killin, p53-regulated DNA replication inhibitor
  Uniprot ID: B2CW77
  ENSP ID: ENSP00000392204
MDRPGPGSARPGRTVHVWGYRVEWKVRNGRKLQPSEWAGRGDLGGFKRRWKDTRATVGTTFRRRSRVSLVGELSKFPLPSDSSGGKSSSSFARGALAWCRQRNPNPSCAAAETGARTSLPKERCRGWRLGNWLHKHPHPNTCPRLPACWLPPILTERGERVPKLVPLLACYPKSKPKD

SEQ ID NO: 44143 - protein, 178 aa, Homo sapiens; identical to SEQ ID NO: 44142
  Payload ID: 8999
  Gene Symbol: KLLN
  Gene Name: Killin, p53-regulated DNA replication inhibitor
  ENSP ID: ENSP00000489239

SEQ ID NO: 44144 - protein, 757 aa, Homo sapiens
  Payload ID: 9000
  Gene Symbol: KIRREL
  Gene Name: kin of IRRE like (Drosophila)
  Uniprot ID: Q96J84
  ENSP ID: ENSP00000352138
MLSLLVWILTLSDTFSQGTQTRFSQEPADQTVVAGQRAVLPCVLLNYSGIVQWTKDGLALGMGQGLKAWPRYRVVGSADAGQYNLEITDAELSDDASYECQATEAALRSRRAKLTVLIPPEDTRIDGGPVILLQAGTPHNLTCRAFNAKPAATIIWFRDGTQQEGAVASTELLKDGKRETTVSQLLINPTDLDIGRVFTCRSMNEAIPSGKETSIELDVHHPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 44145 - protein, 593 aa, Homo sapiens
  Payload ID: 9000
  Gene Symbol: KIRREL
  Gene Name: kin of IRRE like (Drosophila)
  ENSP ID: ENSP00000353202
MGQGLKAWPRYRVVGSADAGQYNLEITDAELSDDASYECQATEAALRSRRAKLTVLNPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 44146 - protein, 571 aa, Homo sapiens
  Payload ID: 9000
  Gene Symbol: KIRREL
  Gene Name: kin of IRRE like (Drosophila)
  ENSP ID: ENSP00000357154
MNEAIPSGKETSIELDVHHPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMGPRPPGSPPEAALSAQVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 44147 - protein, 657 aa, Homo sapiens
  Payload ID: 9000
  Gene Symbol: KIRREL
  Gene Name: kin of IRRE like (Drosophila)
  ENSP ID: ENSP00000357155
MLSLLVWILTLSDTFSQVPPEDTRIDGGPVILLQAGTPHNLTCRAFNAKPAATIIWFRDGTQQEGAVASTELLKDGKRETTVSQLLINPTDLDIGRVFTCRSMNEAIPSGKETSIELDVHHPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 44148 - protein, 633 aa, Homo sapiens
  Payload ID: 9001
  Gene Symbol: KIRREL2
  Gene Name: kin of IRRE like 2 (Drosophila)
  ENSP ID: ENSP00000262625
MLRMRVPALLVLLFCFRGRAGPSPHFLQQPEDLVVLLGEEARLPCALGAYWGLVQWTKSGLALGGQRDLPGWSRYWISGNAANGQHDLHIRPVELEDEASYECQATQAGLRSRPAQLHVLVPPEAPQVLGGPSVSLVAGVPANLTCRSRGDARPTPELLWFRDGVLLDGATFHQTLLKEGTPGSVESTLTLTPFSHDDGATFVCRARSQALPTGRDTAITLSLQYPPEVTLSASPHTVQEGEKVIFLCQATAQPPVTGYRWAKGGSPVLGARGPRLEVVADASFLTEPVSCEVSNAVGSANRSTALDVLFGPILQAKPEPVSVDVGEDASFSCAWRGNPLPRVTWTRRGGAQVLGSGATLRLPSVGPEDAGDYVCRAEAGLSGLRGGAAEARLTVNAPPVVTALHSAPAFLRGPARLQCLVFASPAPDAVVWSWDEGFLEAGSQGRFLVETFPAPESRGGLGPGLISVLHISGTQESDFSRSFNCSARNRLGEGGAQASLGRRDLLPTVRIVAGVAAATTTLLMVITGVALCCWRHSKASASFSEQKNLMRIPGSSDGSSSRGPEEEETGSREDRGPIVHTDHSDLVLEEEGTLETKDPTNGYYKVRGVSPPASPDSRVTSFQWKSPGISNLP

SEQ ID NO: 44149 - protein, 583 aa, Homo sapiens
  Payload ID: 9001
  Gene Symbol: KIRREL2
  Gene Name: kin of IRRE like 2 (Drosophila)
  ENSP ID: ENSP00000345067
MLRMRVPALLVLLFCFRGRAGWSRYWISGNAANGQHDLHIRPVELEDEASYECQATQAGLRSRPAQLHVLVPPEAPQVLGGPSVSLVAGVPANLTCRSRGDARPTPELLWFRDGVLLDGATFHQTLLKEGTPGSVESTLTLTPFSHDDGATFVCRARSQALPTGRDTAITLSLQYPPEVTLSASPHTVQEGEKVIFLCQATAQPPVTGYRWAKGGSPVLGARGPRLEVVADASFLTEPVSCEVSNAVGSANRSTALDVLFGPILQAKPEPVSVDVGEDASFSCAWRGNPLPRVTWTRRGGAQVLGSGATLRLPSVGPEDAGDYVCRAEAGLSGLRGGAAEARLTVNAPPVVTALHSAPAFLRGPARLQCLVFASPAPDAVVWSWDEGFLEAGSQGRFLVETFPAPESRGGLGPGLISVLHISGTQESDFSRSFNCSARNRLGEGGAQASLGRRDLLPTVRIVAGVAAATTTLLMVITGVALCCWRHSKASASFSEQKNLMRIPGSSDGSSSRGPEEEETGSREDRGPIVHTDHSDLVLEEEGTLETKDPTNGYYKVRGVSPPASPDSRVTSFQWKSPGISNLP

SEQ ID NO: 44150 - protein, 708 aa, Homo sapiens
  Payload ID: 9001
  Gene Symbol: KIRREL2
  Gene Name: kin of IRRE like 2 (Drosophila)
  Uniprot ID: Q6UWL6
  ENSP ID: ENSP00000353331
MLRMRVPALLVLLFCFRGRAGPSPHFLQQPEDLVVLLGEEARLPCALGAYWGLVQWTKSGLALGGQRDLPGWSRYWISGNAANGQHDLHIRPVELEDEASYECQATQAGLRSRPAQLHVLVPPEAPQVLGGPSVSLVAGVPANLTCRSRGDARPTPELLWFRDGVLLDGATFHQTLLKEGTPGSVESTLTLTPFSHDDGATFVCRARSQALPTGRDTAITLSLQYPPEVTLSASPHTVQEGEKVIFLCQATAQPPVTGYRWAKGGSPVLGARGPRLEVVADASFLTEPVSCEVSNAVGSANRSTALDVLFGPILQAKPEPVSVDVGEDASFSCAWRGNPLPRVTWTRRGGAQVLGSGATLRLPSVGPEDAGDYVCRAEAGLSGLRGGAAEARLTVNAPPVVTALHSAPAFLRGPARLQCLVFASPAPDAVVWSWDEGFLEAGSQGRFLVETFPAPESRGGLGPGLISVLHISGTQESDFSRSFNCSARNRLGEGGAQASLGRRDLLPTVRIVAGVAAATTTLLMVITGVALCCWRHSKASASFSEQKNLMRIPGSSDGSSSRGPEEEETGSREDRGPIVHTDHSDLVLEEEGTLETKDPTNGYYKVRGVSVSLSLGEAPGGGLFLPPPSPLGPPGTPTFYDFNPHLGMVPPCRLYRARAGYLTTPHPRAFTSYIKPTSFGPPDLAPGTPPFPYAAFPTPSHPRLQTHV

SEQ ID NO: 44151 - protein, 673 aa, Homo sapiens
  Payload ID: 9001
  Gene Symbol: KIRREL2
  Gene Name: kin of IRRE like 2 (Drosophila)
  ENSP ID: ENSP00000465305
MLRMRVPALLVLLFCFRGRAGPSPHFLQQPEDLVVLLGEEARLPCALGAYWGLVQWTKSGLALGGQRDLPGWSRYWISGNAANGQHDLHIRPVELEDEASYECQATQAGLRSRPAQLHVLVPPEAPQVLGGPSVSLVAGVPANLTCRSRGDARPTPELLWFRDGVLLDGATFHQTLLKEGTPGSVESTLTLTPFSHDDGATFVCRARSQALPTGRDTAITLSLQYPPEVTLSASPHTVQEGEKVIFLCQATAQPPVTGYRWAKGGSPVLGARGPRLEVVADASFLTEPVSCEVSNAVGSANRSTALDVLFGPILQAKPEPVSVDVGEDASFSCAWRGNPLPRVTWTRRGGAQVLGSGATLRLPSVGPEDAGDYVCRAEAGLSGLRGGAAEARLTVNAPPVVTALHSAPAFLRGPARLQCLVFASPAPDAVVWSWDEGFLEAGSQGRFLVETFPAPESRGGLGPGLISVLHISGTQESDFSRSFNCSARNRLGEGGAQASLGRRASASFSEQKNLMRIPGSSDGSSSRGPEEEETGSREDRGPIVHTDHSDLVLEEEGTLETKDPTNGYYKVRGVSVSLSLGEAPGGGLFLPPPSPLGPPGTPTFYDFNPHLGMVPPCRLYRARAGYLTTPHPRAFTSYIKPTSFGPPDLAPGTPPFPYAAFPTPSHPRLQTHV

SEQ ID NO: 44152 - protein, 191 aa, Homo sapiens
  Payload ID: 9001
  Gene Symbol: KIRREL2
  Gene Name: kin of IRRE like 2 (Drosophila)
  ENSP ID: ENSP00000466460
MLRMRVPALLVLLFCFRGRAGPSPHFLQQPEDLVVLLGEEARLPCALGAYWGLVQWTKSGLALGGQRDLPGWSRYWISGNAANGQHDLHIRPVELEDEASYECQATQAGLRSRPAQLHVLVPPEAPQVLGGPSVSLVAGVPANLTCRSRGDARPTPELLWFRDGVLLDGATFHQTLLKEGTPGSVESTLTL

SEQ ID NO: 44153 - protein, 737 aa, Homo sapiens
  Payload ID: 9002
  Gene Symbol: KIRREL3
  Gene Name: kin of IRRE like 3 (Drosophila)
  ENSP ID: ENSP00000408692
MNEGQVYSFSQQPQDQVVVSGQPVTLLCAIPEYDGFVLWIKDGLALGVGRDLSSYPQYLVVGNHLSGEHHLKILRAELQDDAVYECQAIQAAIRSRPARLTVLVPPDDPVILGGPVISLRAGDPLNLTCHADNAKPAASIIWLRKGEVINGATYSKTLLRDGKRESIVSTLFISPGDVENGQSIVCRATNKAIPGGKETSVTIDIQHPPLVNLSVEPQPVLEDNVVTFHCSAKANPAVTQYRWAKRGQIIKEASGEVYRTTVDYTYFSEPVSCEVTNALGSTNLSRTVDVYFGPRMTTEPQSLLVDLGSDAIFSCAWTGNPSLTIVWMKRGSGVVLSNEKTLTLKSVRQEDAGKYVCRAVVPRVGAGEREVTLTVNGPPIISSTQTQHALHGEKGQIKCFIRSTPPPDRIAWSWKENVLESGTSGRYTVETISTEEGVISTLTISNIVRADFQTIYNCTAWNSFGSDTEIIRLKEQGSEMKSGAGLEAESVPMAVIIGVAVGAGVAFLVLMATIVAFCCARSQRNLKGVVSAKNDIRVEIVHKEPASGREGEEHSTIKQLMMDRGEFQQDSVLKQLEVLKEEEKEFQNLKDPTNGYYSVNTFKEHHSTPTISLSSCQPDLRPAGKQRVPTGMSFTNIYSTLSGQGRLYDYGQRFVLGMGSSSIELCEREFQRGSLSDSSSFLDTQCDSSVSSSGKQDGYVQFDKASKASASSSHHSQSSSQNSDPSRPLQRRMQTHV

SEQ ID NO: 44154 - protein, 766 aa, Homo sapiens
  Payload ID: 9002
  Gene Symbol: KIRREL3
  Gene Name: kin of IRRE like 3 (Drosophila)
  ENSP ID: ENSP00000434081
MKPFQLDLLFVCFFLFSQELGLQKRGCCLVLGYMAKDKFRRMNEGQVYSFSQQPQDQVVVSGQPVTLLCAIPEYDGFVLWIKDGLALGVGRDLSSYPQYLVVGNHLSGEHHLKILRAELQDDAVYECQAIQAAIRSRPARLTVLVPPDDPVILGGPVISLRAGDPLNLTCHADNAKPAASIIWLRKGEVINGATYSKTLLRDGKRESIVSTLFISPGDVENGQSIVCRATNKAIPGGKETSVTIDIQHPPLVNLSVEPQPVLEDNVVTFHCSAKANPAVTQYRWAKRGQIIKEASGEVYRTTVDYTYFSEPVSCEVTNALGSTNLSRTVDVYFGPRMTTEPQSLLVDLGSDAIFSCAWTGNPSLTIVWMKRGSGVVLSNEKTLTLKSVRQEDAGKYVCRAVVPRVGAGEREVTLTVNGPPIISSTQTQHALHGEKGQIKCFIRSTPPPDRIAWSWKENVLESGTSGRYTVETISTEEGVISTLTISNIVRADFQTIYNCTAWNSFGSDTEIIRLKEQESVPMAVIIGVAVGAGVAFLVLMATIVAFCCARSQRNLKGVVSAKNDIRVEIVHKEPASGREGEEHSTIKQLMMDRGEFQQDSVLKQLEVLKEEEKEFQNLKDPTNGYYSVNTFKEHHSTPTISLSSCQPDLRPAGKQRVPTGMSFTNIYSTLSGQGRLYDYGQRFVLGMGSSSIELCEREFQRGSLSDSSSFLDTQCDSSVSSSGKQDGYVQFDKASKASASSSHHSQSSSQNSDPSRPLQRRMQTHV

SEQ ID NO: 44155 - protein, 600 aa, Homo sapiens
  Payload ID: 9002
  Gene Symbol: KIRREL3
  Gene Name: kin of IRRE like 3 (Drosophila)
  Uniprot ID: Q8IZU9
  ENSP ID: ENSP00000435094
MKPFQLDLLFVCFFLFSQELGLQKRGCCLVLGYMAKDKFRRMNEGQVYSFSQQPQDQVVVSGQPVTLLCAIPEYDGFVLWIKDGLALGVGRDLSSYPQYLVVGNHLSGEHHLKILRAELQDDAVYECQAIQAAIRSRPARLTVLVPPDDPVILGGPVISLRAGDPLNLTCHADNAKPAASIIWLRKGEVINGATYSKTLLRDGKRESIVSTLFISPGDVENGQSIVCRATNKAIPGGKETSVTIDIQHPPLVNLSVEPQPVLEDNVVTFHCSAKANPAVTQYRWAKRGQIIKEASGEVYRTTVDYTYFSEPVSCEVTNALGSTNLSRTVDVYFGPRMTTEPQSLLVDLGSDAIFSCAWTGNPSLTIVWMKRGSGVVLSNEKTLTLKSVRQEDAGKYVCRAVVPRVGAGEREVTLTVNGPPIISSTQTQHALHGEKGQIKCFIRSTPPPDRIAWSWKENVLESGTSGRYTVETISTEEGVISTLTISNIVRADFQTIYNCTAWNSFGSDTEIIRLKEQGSEMKSGAGLEAESVPMAVIIGVAVGAGVAFLVLMATIVAFCCARSQRSTGGRSGISGRGTEKKARLRLPRRASKQECNEQGS

SEQ ID NO: 44156 - protein, 778 aa, Homo sapiens
  Payload ID: 9002
  Gene Symbol: KIRREL3
  Gene Name: kin of IRRE like 3 (Drosophila)
  Uniprot ID: Q8IZU9
  ENSP ID: ENSP00000435466
MKPFQLDLLFVCFFLFSQELGLQKRGCCLVLGYMAKDKFRRMNEGQVYSFSQQPQDQVVVSGQPVTLLCAIPEYDGFVLWIKDGLALGVGRDLSSYPQYLVVGNHLSGEHHLKILRAELQDDAVYECQAIQAAIRSRPARLTVLVPPDDPVILGGPVISLRAGDPLNLTCHADNAKPAASIIWLRKGEVINGATYSKTLLRDGKRESIVSTLFISPGDVENGQSIVCRATNKAIPGGKETSVTIDIQHPPLVNLSVEPQPVLEDNVVTFHCSAKANPAVTQYRWAKRGQIIKEASGEVYRTTVDYTYFSEPVSCEVTNALGSTNLSRTVDVYFGPRMTTEPQSLLVDLGSDAIFSCAWTGNPSLTIVWMKRGSGVVLSNEKTLTLKSVRQEDAGKYVCRAVVPRVGAGEREVTLTVNGPPIISSTQTQHALHGEKGQIKCFIRSTPPPDRIAWSWKENVLESGTSGRYTVETISTEEGVISTLTISNIVRADFQTIYNCTAWNSFGSDTEIIRLKEQGSEMKSGAGLEAESVPMAVIIGVAVGAGVAFLVLMATIVAFCCARSQRNLKGVVSAKNDIRVEIVHKEPASGREGEEHSTIKQLMMDRGEFQQDSVLKQLEVLKEEEKEFQNLKDPTNGYYSVNTFKEHHSTPTISLSSCQPDLRPAGKQRVPTGMSFTNIYSTLSGQGRLYDYGQRFVLGMGSSSIELCEREFQRGSLSDSSSFLDTQCDSSVSSSGKQDGYVQFDKASKASASSSHHSQSSSQNSDPSRPLQRRMQTHV

SEQ ID NO: 44157 - protein, 393 aa, Homo sapiens
  Payload ID: 9003
  Gene Symbol: KIN
  Gene Name: Kin17 DNA and RNA binding protein
  Uniprot ID: O60870
  ENSP ID: ENSP00000368881
MGKSDFLTPKAIANRIKSKGLQKLRWYCQMCQKQCRDENGFKCHCMSESHQRQLLLASENPQQFMDYFSEEFRNDFLELLRRRFGTKRVHNNIVYNEYISHREHIHMNATQWETLTDFTKWLGREGLCKVDETPKGWYIQYIDRDPETIRRQLELEKKKKQDLDDEEKTAKFIEEQVRRGLEGKEQEVPTFTELSRENDEEKVTFNLSKGACSSSGATSSKSSTLGPSALKTIGSSASVKRKESSQSSTQSKEKKKKKSALDEIMEIEEEKKRTARTDYWLQPEIIVKIITKKLGEKYHKKKAIVKEVIDKYTAVVKMIDSGDKLKLDQTHLETVIPAPGKRILVLNGGYRGNEGTLESINEKTFSATIVIETGPLKGRRVEGIQYEDISKLA

SEQ ID NO: 44158 - protein, 108 aa, Homo sapiens
  Payload ID: 9003
  Gene Symbol: KIN
  Gene Name: Kin17 DNA and RNA binding protein
  ENSP ID: ENSP00000473950
IEEEKKRTARTDYWLQPEIIVKIITKKLGEKYHKKKAIVKEVIDKYTAVVKMIDSGDKLKLDQTHLETVIPAPGKRILVLNGGYRGNEGTLESINEKTFSATIVIETV

SEQ ID NO: 44159 - protein, 1771 aa, Homo sapiens
  Payload ID: 9004
  Gene Symbol: KIDINS220
  Gene Name: kinase D-interacting substrate, 220kDa
  Uniprot ID: Q9ULH0
  ENSP ID: ENSP00000256707
MSVLISQSVINYVEEENIPALKALLEKCKDVDERNECGQTPLMIAAEQGNLEIVKELIKNGANCNLEDLDNWTALISASKEGHVHIVEELLKCGVNLEHRDMGGWTALMWACYKGRTDVVELLLSHGANPSVTGLYSVYPIIWAAGRGHADIVHLLLQNGAKVNCSDKYGTTPLVWAARKGHLECVKHLLAMGADVDQEGANSMTALIVAVKGGYTQSVKEILKRNPNVNLTDKDGNTALMIASKEGHTEIVQDLLDAGTYVNIPDRSGDTVLIGAVRGGHVEIVRALLQKYADIDIRGQDNKTALYWAVEKGNATMVRDILQCNPDTEICTKDGETPLIKATKMRNIEVVELLLDKGAKVSAVDKKGDTPLHIAIRGRSRKLAELLLRNPKDGRLLYRPNKAGETPYNIDCSHQKSILTQIFGARHLSPTETDGDMLGYDLYSSALADILSEPTMQPPICVGLYAQWGSGKSFLLKKLEDEMKTFAGQQIEPLFQFSWLIVFLTLLLCGGLGLLFAFTVHPNLGIAVSLSFLALLYIFFIVIYFGGRREGESWNWAWVLSTRLARHIGYLELLLKLMFVNPPELPEQTTKALPVRFLFTDYNRLSSVGGETSLAEMIATLSDACEREFGFLATRLFRVFKTEDTQGKKKWKKTCCLPSFVIFLFIIGCIISGITLLAIFRVDPKHLTVNAVLISIASVVGLAFVLNCRTWWQVLDSLLNSQRKRLHNAASKLHKLKSEGFMKVLKCEVELMARMAKTIDSFTQNQTRLVVIIDGLDACEQDKVLQMLDTVRVLFSKGPFIAIFASDPHIIIKAINQNLNSVLRDSNINGHDYMRNIVHLPVFLNSRGLSNARKFLVTSATNGDVPCSDTTGIQEDADRRVSQNSLGEMTKLGSKTALNRRDTYRRRQMQRTITRQMSFDLTKLLVTEDWFSDISPQTMRRLLNIVSVTGRLLRANQISFNWDRLASWINLTEQWPYRTSWLILYLEETEGIPDQMTLKTIYERISKNIPTTKDVEPLLEIDGDIRNFEVFLSSRTPVLVARDVKVFLPCTVNLDPKLREIIADVRAAREQISIGGLAYPPLPLHEGPPRAPSGYSQPPSVCSSTSFNGPFAGGVVSPQPHSSYYSGMTGPQHPFYNRPFFAPYLYTPRYYPGGSQHLISRPSVKTSLPRDQNNGLEVIKEDAAEGLSSPTDSSRGSGPAPGPVVLLNSLNVDAVCEKLKQIEGLDQSMLPQYCTTIKKANINGRVLAQCNIDELKKEMNMNFGDWHLFRSTVLEMRNAESHVVPEDPRFLSESSSGPAPHGEPARRASHNELPHTELSSQTPYTLNFSFEELNTLGLDEGAPRHSNLSWQSQTRRTPSLSSLNSQDSSIEISKLTDKVQAEYRDAYREYIAQMSQLEGGPGSTTISGRSSPHSTYYMGQSSSGGSIHSNLEQEKGKDSEPKPDDGRKSFLMKRGDVIDYSSSGVSTNDASPLDPITEEDEKSDQSGSKLLPGKKSSERSSLFQTDLKLKGSGLRYQKLPSDEDESGTEESDNTPLLKDDKDRKAEGKVERVPKSPEHSAEPIRTFIKAKEYLSDALLDKKDSSDSGVRSSESSPNHSLHNEVADDSQLEKANLIELEDDSHSGKRGIPHSLSGLQDPIIARMSICSEDKKSPSECSLIASSPEENWPACQKAYNLNRTPSTVTLNNNSAPANRANQNFDEMEGIRETSQVILRPSSSPNPTTIQNENLKSMTHKRSQRSSYTRLSKDPPELHAAASSESTGFGEERESIL

SEQ ID NO: 44160 - protein, 1031 aa, Homo sapiens
  Payload ID: 9004
  Gene Symbol: KIDINS220
  Gene Name: kinase D-interacting substrate, 220kDa
  Uniprot ID: Q9ULH0
  ENSP ID: ENSP00000319947
MSVLISQSVINYVEEENIPALKALLEKCKDVDERNECGQTPLMIAAEQGNLEIVKELIKNGANCNLEDLDNWTALISASKEGHVHIVEELLKCGVNLEHRDMGGWTALMWACYKGRTDVVELLLSHGANPSVTGLQYSVYPIIWAAGRGHADIVHLLLQNGAKVNCSDKYGTTPLVWAARKGHLECVKHLLAMGADVDQEGANSMTALIVAVKGGYTQSVKEILKRNPNVNLTDKDGNTALMIASKEGHTEIVQDLLDAGTYVNIPDRSGDTVLIGAVRGGHVEIVRALLQKYADIDIRGQDNKTALYWAVEKGNATMVRDILQCNPDTEICTKDGETPLIKATKMRNIEVVELLLDKGAKVSAVDKKGDTPLHIAIRGRSRKLAELLLRNPKDGRLLYRPNKAGETPYNIDCSHQKSILTQIFGARHLSPTETDGDMLGYDLYSSALADILSEPTMQPPICVGLYAQWGSGKSFLLKKLEDEMKTFAGQQIEPLFQFSWLIVFLTLLLCGGLGLLFAFTVHPNLGIAVSLSFLALLYIFFIVIYFGGRREGESWNWAWVLSTRLARHIGYLELLLKLMFVNPPELPEQTTKALPVRFLFTDYNRLSSVGGETSLAEMIATLSDACEREFGFLATRLFRVFKTEDTQGKKKWKKTCCLPSFVIFLFIIGCIISGITLLAIFRVDPKHLTVNAVLISIASVVGLAFVLNCRTWWQVLDSLLNSQRKRLHNAASKLHKLKSEGFMKVLKCEVELMARMAKTIDSFTQNQTRLVVIIDGLDACEQDKVLQMLDTVRVLFSKGPFIAIFASDPHIIIKAINQNLNSVLRDSNINGHDYMRNIVHLPVFLNSRGLSNARKFLVTSATNGDVPCSDTTGIQEDADRRVSQNSLGEMTKLGSKTALNRRDTYRRRQMQRTITRQMSFDLTKLLVTEDWFSDISPQTMRRLLNIVSVTGRLLRANQISFNWDRLASWINLTEQWPYRTSWLILYLEETEGIPDQMTLKTIYERCCGADSCDRDRIGISKSVLVAMLMES

SEQ ID NO: 44161 - protein, 36 aa, Homo sapiens
  Payload ID: 9004
  Gene Symbol: KIDINS220
  Gene Name: kinase D-interacting substrate, 220kDa
  ENSP ID: ENSP00000417390
MSVLISQSVINYVEEENIPALKALLEKCKDVDERNE

SEQ ID NO: 44162 - protein, 1752 aa, Homo sapiens
  Payload ID: 9004
  Gene Symbol: KIDINS220
  Gene Name: kinase D-interacting substrate, 220kDa
  Uniprot ID: Q9ULH0
  ENSP ID: ENSP00000418974
MSVLISQSVINYVEEENIPALKALLEKCKDVDERNECGQTPLMIAAEQGNLEIVKELIKNGANCNLEDLDNWTALISASKEGHVHIVEELLKCGVNLEHRDMGGWTALMWACYKGRTDVVELLLSHGANPSVTGLYSVYPIIWAAGRGHADIVHLLLQNGAKVNCSDKYGTTPLVWAARKGHLECVKHLLAMGADVDQEGANSMTALIVAVKGGYTQSVKEILKRNPNVNLTDKDGNTALMIASKEGHTEIVQDLLDAGTYVNIPDRSGDTVLIGAVRGGHVEIVRALLQKYADIDIRGQDNKTALYWAVEKGNATMVRDILQCNPDTEICTKDGETPLIKATKMRNIEVVELLLDKGAKVSAVDKKGDTPLHIAIRGRSRKLAELLLRNPKDGRLLYRPNKAGETPYNIDCSHQKSILTQIFGARHLSPTETDGDMLGYDLYSSALADILSEPTMQPPICVGLYAQWGSGKSFLLKKLEDEMKTFAGQQIEPLFQFSWLIVFLTLLLCGGLGLLFAFTVHPNLGIAVSLSFLALLYIFFIVIYFGGRREGESWNWAWVLSTRLARHIGYLELLLKLMFVNPPELPEQTTKALPVRFLFTDYNRLSSVGGETSLAEMIATLSDACEREFGFLATRLFRVFKTEDTQGKKKWKKTCCLPSFVIFLFIIGCIISGITLLAIFRVDPKHLTVNAVLISIASVVGLAFVLNCRTWWQVLDSLLNSQRKRLHNAASKLHKLKSEGFMKVLKCEVELMARMAKTIDSFTQNQTRLVVIIDGLDACEQDKVLQMLDTVRVLFSKGPFIAIFASDPHIIIKAINQNLNSVLRDSNINGHDYMRNIVHLPVFLNSRGLSNARKFLVTSATNGDVPCSDTTGIQEDADRRVSQNSLGEMTKLGSKTALNRRDTYRRRQMQRTITRQMSFDLTKLLVTEDWFSDISPQTMRRLLNIVSVTGRLLRANQISFNWDRLASWINLTEQWPYRTSWLILYLEETEGIPDQMTLKTIYERISKNIPTTKDVEPLLEIDGDIRNFEVFLSSRTPVLVARDVKVFLPCTVNLDPKLREIIADVRAAREQISIGGLAYPPLPLHEGPPRAPSGYSQPPSVCSSTSFNGPFAGGVVSPQPHSSYYSGMTGPQHPFYNRPFFAPYLYTPRYYPGGSQHLISRPSVKTSLPRDQNNGLGSGPAPGPVVLLNSLNVDAVCEKLKQIEGLDQSMLPQYCTTIKKANINGRVLAQCNIDELKKEMNMNFGDWHLFRSTVLEMRNAESHVVPEDPRFLSESSSGPAPHGEPARRASHNELPHTELSSQTPYTLNFSFEELNTLGLDEGAPRHSNLSWQSQTRRTPSLSSLNSQDSSIEISKLTDKVQAEYRDAYREYIAQMSQLEGGPGSTTISGRSSPHSTYYMGQSSSGGSIHSNLEQEKGKDSEPKPDDGRKSFLMKRGDVIDYSSSGVSTNDASPLDPITEEDEKSDQSGSKLLPGKKSSERSSLFQTDLKLKGSGLRYQKLPSDEDESGTEESDNTPLLKDDKDRKAEGKVERVPKSPEHSAEPIRTFIKAKEYLSDALLDKKDSSDSGVRSSESSPNHSLHNEVADDSQLEKANLIELEDDSHSGKRGIPHSLSGLQDPIIARMSICSEDKKSPSECSLIASSPEENWPACQKAYNLNRTPSTVTLNNNSAPANRANQNFDEMEGIRETSQVILRPSSSPNPTTIQNENLKSMTHKRSQRSSYTRLSKDPPELHAAASSESTGFGEERESIL

SEQ ID NO: 44163 - protein, 151 aa, Homo sapiens
  Payload ID: 9004
  Gene Symbol: KIDINS220
  Gene Name: kinase D-interacting substrate, 220kDa
  ENSP ID: ENSP00000419232
IPDQMTLKTIYERISKNIPTTKDVEPLLEIDGDIRNFEVFLSSRTPVLVARDVKVFLPCTVNLDPKLREIIADVRAAREQISIGGLAYPPLPLHEGPPRAPSGYSQPPSVCSSTSFNGPFAGGVVSPQPHSSYYSGMTGPQHPFYNRENGA

SEQ ID NO: 44164 - protein, 1305 aa, Homo sapiens
  Payload ID: 9004
  Gene Symbol: KIDINS220
  Gene Name: kinase D-interacting substrate, 220kDa
  ENSP ID: ENSP00000419964
MSVLISQSVINYVEEENIPALKALLEKCKDVDERNECGQTPLMIAAEQGNLEIVKELIKNGANCNLEDLDNWTALISASKEGHVHIVEELLKCGVNLEHRDMGGWTALMWACYKGRTDVVELLLSHGANPSVTGLQYSVYPIIWAAGRGHADIVHLLLQNGAKVNCSDKYGTTPLVWAARKGHLECVKHLLAMGADVDQEGANSMTALIVAVKGGYTQSVKEILKRNPNVNLTDKDGNTALMIASKEGHTEIVQDLLDAGTYVNIPDRSGDTVLIGAVRGGHVEIVRALLQKYADIDIRGQDNKTALYWAVEKGNATMVRDILQCNPDTEICTKDGETPLIKATKMRNIEVVELLLDKGAKVSAVDKKGDTPLHIAIRGRSRKLAELLLRNPKDGRLLYRPNKAGETPYNIDCSHQKSILTQIFGARHLSPTETDGDMLGYDLYSSALADILSEPTMQPPICVGLYAQWGSGKSFLLKKLEDEMKTFAGQQIEPLFQFSWLIVFLTLLLCGGLGLLFAFTVHPNLGIAVSLSFLALLYIFFIVIYFGGRREGESWNWAWVLSTRLARHIGYLELLLKLMFVNPPELPEQTTKALPVRFLFTDYNRLSSVGGETSLAEMIATLSDACEREFGFLATRLFRVFKTEDTQGKKKWKKTCCLPSFVIFLFIIGCIISGITLLAIFRVDPKHLTVNAVLISIASVVGLAFVLNCRTWWQVLDSLLNSQRKRLHNAASKLHKLKSEGFMKVLKCEVELMARMAKTIDSFTQNQTRLVVIIDGLDACEQDKVLQMLDTVRVLFSKGPFIAIFASDPHIIIKAINQNLNSVLRDSNINGHDYMRNIVHLPVFLNSRGLSNARKFLVTSATNGDVPCSDTTGIQEDADRRVSQNSLGEMTKLGSKTALNRRDTYRRRQMQRTITRQMSFDLTKLLVTEDWFSDISPQTMRRLLNIVSVTGRLLRANQISFNWDRLASWINLTEQWPYRTSWLILYLEETEGIPDQMTLKTIYERISKNIPTTKDVEPLLEIDGDIRNFEVFLSSRTPVLVARDVKVFLPCTVNLDPKLREIIADVRAAREQISIGGLAYPPLPLHEGPPRAPSGYSQPPSVCSSTSFNGPFAGGVVSPQPHSSYYSGMTGPQHPFYNRGSGPAPGPVVLLNSLNVDAVCEKLKQIEGLDQSMLPQYCTTIKKANINGRVLAQCNIDELKKEMNMNFGDWHLFRSTVLEMRNAESHVVPEDPRFLSESSSGPAPHGEPARRASHNELPHTELSSQTPYTLNFSFEELNTLGLDEGAPRHSNLSWQSQTRRTPSLS

SEQ ID NO: 44165 - protein, 1057 aa, Homo sapiens
  Payload ID: 9004
  Gene Symbol: KIDINS220
  Gene Name: kinase D-interacting substrate, 220kDa
  ENSP ID: ENSP00000420364
DLLDAGTYVNIPDRSGDTVLIGAVRGGHVEIVRALLQKYADIDIRGQDNKTALYWAVEKGNATMVRDILQCNPDTEICTKDGETPLIKATKMRNIEVVELLLDKGAKVSAVDKKGDTPLHIAIRGRSRKLAELLLRNPKDGRLLYRPNKAGETPYNIDCSHQKSILTQIFGARHLSPTETDGDMLGYDLYSSALADILSEPTMQPPICVGLYAQWGSGKSFLLKKLEDEMKTFAGQQIEPLFQFSWLIVFLTLLLCGGLGLLFAFTVHPNLGIAVSLSFLALLYIFFIVIYFGGRREGESWNWAWVLSTRLARHIGYLELLLKLMFVNPPELPEQTTKALPVRFLFTDYNRLSSVGGETSLAEMIATLSDACEREFGFLATRLFRVFKTEDTQGKKKWKKTCCLPSFVIFLFIIGCIISGITLLAIFRVDPKHLTVNAVLISIASVVGLAFVLNCRTWWQVLDSLLNSQRKRLHNAASKLHKLKSEGFMKVLKCEVELMARMAKTIDSFTQNQTRLVVIIDGLDACEQDKVLQMLDTVRVLFSKGPFIAIFASDPHIIIKAINQNLNSVLRDSNINGHDYMRNIVHLPVFLNSRGLSNARKFLVTSATNGDVPCSDTTGIQEDADRRVSQNSLGEMTKLGSKTALNRRDTYRRRQMQRTITRQMSFDLTKLLVTEDWFSDISPQTMRRLLNIVSVTGRLLRANQISFNWDRLASWINLTEQWPYRTSWLILYLEETEGIPDQMTLKTIYERISKNIPTTKDVEPLLEIDGDIRNFEVFLSSRTPVLVARDVKVFLPCTVNLDPKLREIIADVRAAREQISIGGLAYPPLPLHEGPPRAPSGYSQPPSVCSSTSFNGPFAGGVVSPQPHSSYYSGMTGPQHPFYNRGSGPAPGPVVLLNSLNVDAVCEKLKQIEGLDQSMLPQYCTTIKKANINGRVLAQCNIDELKKEMNMNFGDWHLFRSTVLEMRNAESHVVPEDPRFLSESSSGPAPHGEPARRASHNELPHTELSSQTPYTLNFSFEELNTLGLDEGAPRHSNLSWQEENAGLEIDSSSEDPD

SEQ ID NO: 44166 - protein, 1356 aa, Homo sapiens
  Payload ID: 9005
  Gene Symbol: KDR
  Gene Name: kinase insert domain receptor
  Uniprot ID: P35968
  ENSP ID: ENSP00000263923
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEIIILVGTAVIAMFFWLLLVIILRTVKRANGGELKTGYLSIVMDPDELPLDEHCERLPYDASKWEFPRDRLKLGKPLGRGAFGQVIEADAFGIDKTATCRTVAVKMLKEGATHSEHRALMSELKILIHIGHHLNVVNLLGACTKPGGPLMVIVEFCKFGNLSTYLRSKRNEFVPYKTKGARFRQGKDYVGAIPVDLKRRLDSITSSQSSASSGFVEEKSLSDVEEEEAPEDLYKDFLTLEHLICYSFQVAKGMEFLASRKCIHRDLAARNILLSEKNVVKICDFGLARDIYKDPDYVRKGDARLPLKWMAPETIFDRVYTIQSDVWSFGVLLWEIFSLGASPYPGVKIDEEFCRRLKEGTRMRAPDYTTPEMYQTMLDCWHGEPSQRPTFSELVEHLGNLLQANAQQDGKDYIVLPISETLSMEEDSGLSLPTSPVSCMEEEEVCDPKFHYDNTAGISQYLQNSKRKSRPVSVKTFEDIPLEEPEVKVIPDDNQTDSGMVLASEELKTLEDRTKLSPSFGGMVPSKSRESVASEGSNQTSGYQSGYHSDDTDTTVYSSEEAELLKLIEIGVQTGSTAQILQPDSGTTLSSPPV

SEQ ID NO: 44167 - protein, 1749 aa, Homo sapiens
  Payload ID: 9006
  Gene Symbol: KNDC1
  Gene Name: kinase non-catalytic C-lobe domain (KIND) containing 1
  Uniprot ID: Q76NI1
  ENSP ID: ENSP00000304437
MQAMDPAAADLYEEDGKDLDFYDFEPLPTLPEDEENVSLADILSLRDRGLSEQEAWAVCLECSLSMRSVAHAAIFQSLCITPDTLAFNTSGNVCFMEQLSDDPEGAFVPPEFDVTGNTFEAHIYSLGATLKAALEYVAEPTLEPRLSQDLEALLSRMQAEDPGDRPDLESIIALCEEKLQLTSSCRVCRSLSAVGRRVLSIESFGALQDVSESSWRERPAPGNAGPRRPPGDPSTDPEVLPTPEGPESETSRGPRASPTKALLSTPVRNGESHSREGLAGLVLDAERTLGELDRDALRRSRLRKVQTFPRLLSDSPEATLCLPLTRGKSQLPISELFSPDPRKAFLDRKNGLSSFQAQPKCRLWPEQEPEHQLGRVPCAGRSTDRGPGVPGSPGQPETSHPSQGPAEAPADPRDASGEAQTPRDDERIPEGARQLESAAAEQWVSLQDLLSQLGRPFREYELWALCLACLRALQTRPEHPAYLCLDSVLVAEDGAVLFQPPPANGSYDSFFLAPELAEERLVTEKASVYCVAAVLWTAAKFSVPRNHKLALPRRLKTLLLDMARRSAPERPSAAEAIKVCGSYLLQRGMDSRKILAHLRASICQVYQEEETISLQNAFSVVELKPSVAPAPEPSPGFLPVNSDTGLVAVPGPVPGQHPCGEEATQLPAAFTSEATHFKPIVLAQNASVARDQPALAQEESEERGGQREGEGEEKLSLEAHAGSPSLKTPDGPVPGPGPQGAAPEPLGASVQRDSAQGRPCPPPQAPANQPEGASSAAPGSPVPAPPTKASALPVEQGPAEPIPPGVASGGLRPDALGPTTAHHGPRHPPKPPRSKATERPGQEPEGPGATPAGERDDQSPDSVPERPRPADRRLCLPCVDASPLPGRTACPSLQEATRLIQEEFAFDGYLDNGLEALIMGEYIFALKDLTFATFCGAISEKFCDLYWDEKLLQNLFKVVNGQASPSPSTAEEAGSQLEGSQSPRSPSSKRPSLHRLGKEKPAMARTSSRAPCSPTSVSDVDSDALSRGNFEVGFRPQRSVKAERAQQPEAGEDRRPAGGASDVEAVTRLARSKGVGPALSPGPAGFQSCSPGWCSAFYEADCFGADVHNYVKDLGRQQADGALPDAQSPELEQQLMMEKRNYRKTLKFYQKLLQKEKRNKGSDVKTMLSKLKGQLEEMKSRVQFLSLVKKYLQVMYAERWGLEPCTLPVIVNIAAAPCDTLDFSPLDESSSLIFYNVNKHPGGRQKARILQAGTPLGLMAYLYSSDAFLEGYVQQFLYTFRYFCTPHDFLHFLLDRINSTLTRAHQDPTSTFTKIYRRSLCVLQAWVEDCYAVDFPRNSGLLGKLEDFISSKILPLDGSAKHLLGLLEVGMDRRAEGNPRGTDLENPREAEEDARPFNALCKRLSEDGISRKSFPWRLPRGNGLVLPPHKERPYTIAAALPKPCFLEDFYGPCAKTSEKGPYFLTEYSTHQLFSQLTLLQQELFQKCHPVHFLNSRALGVMDKSTAIPKASSSESLSAKTCSLFLPNYVQDKYLLQLLRNADDVSTWVAAEIVTSHTSKLQVNLLSKFLLIAKSCYEQRNFATAMQILSGLEHLAVRQSPAWRILPAKIAEVMEELKAVEVFLKSDSLCLMEGRRFRAQPTLPSAHLLAMHIQQLETGGFTMTNGAHRWSKLRNIAKVVSQVHAFQENPYTFSPDPKLQSYLKQRIARFSGADISTLAADSRANFHQVSSEKHSRKIQDKLRRMKATFQ

SEQ ID NO: 44168 - protein, 1141 aa, Homo sapiens
  Payload ID: 9006
  Gene Symbol: KNDC1
  Gene Name: kinase non-catalytic C-lobe domain (KIND) containing 1
  Uniprot ID: Q76NI1
  ENSP ID: ENSP00000357560
MRSVAHAAIFQSLCITPDTLAFNTSGNVCFMEQLSDDPEGAFVPPEFDVTGNTFEAHIYSLGATLKAALEYVAEPTLEPRLSQDLEALLSRMQAEDPGDRPDLESIIALCEEKLQLTSSCRVCRSLSAVGRRVLSIESFGALQDVSESSWRERPAPGNAGPRRPPGDPSTDPEVLPTPEGPESETSRGPRASPTKALLSTPVRNGESHSREGLAGLVLDAERTLGELDRDALRRSRLRKVQTFPRLLSDSPEATLCLPLTRGKSQLPISELFSPDPRKAFLDRKNGLSSFQAQPKCRLWPEQEPEHQLGRVPCAGRSTDRGPGVPGSPGQPETSHPSQGPAEAPADPRDASGEAQTPRDDERIPEGARQLESAAAEQWVSLQDLLSQLGRPFREYELWALCLACLRALQTRPEHPAYLCLDSVLVAEDGAVLFQPPPANGSYDSFFLAPELAEERLVTEKASVYCVAAVLWTAAKFSVPRNHKLALPRRLKTLLLDMARRSAPERPSAAEAIKVCGSYLLQRGMDSRKILAHLRASICQVYQEEETISLQNAFSVVELKPSVAPAPEPSPGFLPVNSDTGLVAVPGPVPGQHPCGEEATQLPAAFTSEATHFKPIVLAQNASVARDQPALAQEESEERGGQREGEGEEKLSLEAHAGSPSLKTPDGPVPGPGPQGAAPEPLGASVQRDSAQGRPCPPPQAPANQPEGASSAAPGSPVPAPPTKASALPVEQGPAEPIPPGVASGGLRPDALGPTTAHHGPRHPPKPPRSKATERPGQEPEGPGATPAGERDDQSPDSVPERPRPADRRLCLPCVDASPLPGRTACPSLQEATRLIQEEFAFDGYLDNGLEALIMGEYIFALKDLTFATFCGAISEKFCDLYWDEKLLQNLFKVVNGQASPSPSTAEEAGSQLEGSQSPRSPSSKRPSLHRLGKEKPAMARTSSRAPCSPTSVSDVDSDALSRGNFEVGFRPQRSVKAERAQQPEAGEDRRPAGGASDVEAVTRLARSKGVGPALSPGPAGFQSCSPGWCSAFYEADCFGADVHNYVKDLGRQQADGALPDAQSPELEQQLMMEKRNYRKTLKFYQKLLQKEKRNKGSDVKTMLSKLKGQLEEMKSRVQFLSLVKKYLQASGLRAPLCPVRQ

SEQ ID NO: 44169 - protein, 846 aa, Homo sapiens
  Payload ID: 9007
  Gene Symbol: KSR1
  Gene Name: kinase suppressor of ras 1
  ENSP ID: ENSP00000268763
AKLVRYICKQRQCKLSVAPGERTPELNSYPRFSDWLYTFNVRPEVVQEIPRDLTLDALLEMNEAKVKETLRRCGASGDECGRLQYALTCLRKVTGLGGEHKEDSSWSSLDARRESGSGPSTDTLSAASLPWPPGSSQLGRAGNSAQGPRSISVSALPASDSPTPSFSEGLSDTCIPLHASGRLTPRALHSFITPPTTPQLRRHTKLKPPRTPPPPSRKVFQLLPSFPTLTRSKSHESQLGNRIDDVSSMRFDLSHGSPQMVRRDIGLSVTHRFSTKSWLSQVCHVCQKSMIFGVKCKHCRLKCHNKCTKEAPACRISFLPLTRLRRTESVPSDINNPVDRAAEPHFGTLPKALTKKEHPPAMNHLDSSSNPSSTTSSTPSSPAPFPTSSNPSSATTPPNPSPGQRDSRFNFPAAYFIHHRQQFIFPVPSAGHCWKCLLIAESLKENAFNISAFAHAAPLPEAADGTRLDDQPKADVLEAHEAEAEEPEAGKSEAEDDEDEVDDLPSSRRPWRGPISRKASQTSVYLQEWDIPFEQVELGEPIGQGRWGRVHRGRWHGEVAIRLLEMDGHNQDHLKLFKKEVMNYRQTRHENVVLFMGACMNPPHLAIITSFCKGRTLHSFVRDPKTSLDINKTRQIAQEIIKGMGYLHAKGIVHKDLKSKNVFYDNGKVVITDFGLFGISGVVREGRRENQLKLSHDWLCYLAPEIVREMTPGKDEDQLPFSKAADVYAFGTVWYELQARDWPLKNQAAEASIWQIGSGEGMKRVLTSVSLGKEVSEILSACWAFDLQERPSFSLLMDMLEKLPKLNRRLSHPGHFWKSADINSSKVVPRFERFGLGVLESSNPKM

SEQ ID NO: 44170 - protein, 612 aa, Homo sapiens
  Payload ID: 9007
  Gene Symbol: KSR1
  Gene Name: kinase suppressor of ras 1
  ENSP ID: ENSP00000381952
HSFITPPTTPQLRRHTKLKPPRTPPPPSRKVFQLLPSFPTLTRSKSHESQLGNRIDDVSSMRFDLSHGSPQMVRRDIGLSVTHRFSTKSWLSQVCHVCQKSMIFGVKCKHCRLKCHNKCTKEAPACRISFLPLTRLRRTESVPSDINNPVDRAAEPHFGTLPKALTKKEHPPAMNHLDSSSNPSSTTSSTPSSPAPFPTSSNPSSATTPPNPSPGQRDSRFNFPAAYFIHHRQQFIFPDISAFAHAAPLPEAADGTRLDDQPKADVLEAHEAEAEEPEAGKSEAEDDEDEVDDLPSSRRPWRGPISRKASQTSVYLQEWDIPFEQVELGEPIGQGRWGRVHRGRWHGEVAIRLLEMDGHNQDHLKLFKKEVMNYRQTRHENVVLFMGACMNPPHLAIITSFCKGRTLHSFVRDPKTSLDINKTRQIAQEIIKGMGYLHAKGIVHKDLKSKNVFYDNGKVVITDFGLFGISGVVREGRRENQLKLSHDWLCYLAPEIVREMTPGKDEDQLPFSKAADVYAFGTVWYELQARDWPLKNQAAEASIWQIGSGEGMKRVLTSVSLGKEVSEILSACWAFDLQERPSFSLLMDMLEKLPKLNRRLSHPGHFWKSAEL

SEQ ID NO: 44171 - protein, 762 aa, Homo sapiens
  Payload ID: 9007
  Gene Symbol: KSR1
  Gene Name: kinase suppressor of ras 1
  Uniprot ID: Q8IVT5
  ENSP ID: ENSP00000381958
MNEAKVKETLRRCGASGDECGRLQYALTCLRKVTGLGGEHKEDSSWSSLDARRESGSGPSTDTLSAASLPWPPGSSQLGRAGNSAQGPRSISVSALPASDSPTPSFSEGLSDTCIPLHASGRLTPRALHSFITPPTTPQLRRHTKLKPPRTPPPPSRKVFQLLPSFPTLTRSKSHESQLGNRIDDVSSMRFDLSHGSPQMVRRDIGLSVTHRFSTKSWLSQVCHVCQKSMIFGVKCKHCRLKCHNKCTKEAPACRISFLPLTRLRRTESVPSDINNPVDRAAEPHFGTLPKALTKKEHPPAMNHLDSSSNPSSTTSSTPSSPAPFPTSSNPSSATTPPNPSPGQRDSRFNFPAAYFIHHRQQFIFPVPSAGHCWKCLLIAESLKENAFNISAFAHAAPLPEAADGTRLDDQPKADVLEAHEAEAEEPEAGKSEAEDDEDEVDDLPSSRRPWRGPISRKASQTSVYLQEWDIPFEQVELGEPIGQGRWGRVHRGRWHGEVAIRLLEMDGHNQDHLKLFKKEVMNYRQTRHENVVLFMGACMNPPHLAIITSFCKGRTLHSFVRDPKTSLDINKTRQIAQEIIKGMGYLHAKGIVHKDLKSKNVFYDNGKVVITDFGLFGISGVVREGRRENQLKLSHDWLCYLAPEIVREMTPGKDEDQLPFSKAADVYAFGTVWYELQARDWPLKNQAAEASIWQIGSGEGMKRVLTSVSLGKEVSEILSACWAFDLQERPSFSLLMDMLEKLPKLNRRLSHPGHFWKSAEL

SEQ ID NO: 44172 - protein, 762 aa, Homo sapiens; identical to SEQ ID NO: 44171
  Payload ID: 9007
  Gene Symbol: KSR1
  Gene Name: kinase suppressor of ras 1
  Uniprot ID: Q8IVT5
  ENSP ID: ENSP00000438795

SEQ ID NO: 44173 - protein, 46 aa, Homo sapiens
  Payload ID: 9007
  Gene Symbol: KSR1
  Gene Name: kinase suppressor of ras 1
  ENSP ID: ENSP00000463204
MNEAKVKETLRRCGASGDECGRLQYALTCLRKVTGLGGEHKEDSSW

SEQ ID NO: 44174 - protein, 98 aa, Homo sapiens
  Payload ID: 9007
  Gene Symbol: KSR1
  Gene Name: kinase suppressor of ras 1
  ENSP ID: ENSP00000463554
  MOD_RES (1)..(1): Any amino acid
XVFQLLPSFPTLTRSKSHESQLGNRIDDVSSMRFACLLPHLETSQGQLTEPSSEARSKLEDQARRGEPHHATGLAWPAPVLMDIDQGDAYIINHCAPL

SEQ ID NO: 44175 - protein, 130 aa, Homo sapiens
  Payload ID: 9007
  Gene Symbol: KSR1
  Gene Name: kinase suppressor of ras 1
  ENSP ID: ENSP00000463779
MEKDATATLTLRAPVRFWRNTLTAAKLYPGLKGLAWASWSPVIQRCSQPYGFSLLISFFLKCVSETSQQPPRQKNTACPALQTRSTRPRFRLLAINPTREMELHLLFLKMTPPTTKPVMTDSKCLHVYFS

SEQ ID NO: 44176 - protein, 139 aa, Homo sapiens
  Payload ID: 9007
  Gene Symbol: KSR1
  Gene Name: kinase suppressor of ras 1
  ENSP ID: ENSP00000463790
REMTPGKDEDQLPFSKAADVYAFGTVWYELQARDWPLKNQAAEASIWQIGSGEGMKRVLTSVSLGKEVSEILSACWAFDLQERPSFSLLMDMLEKLPKLNRRLSHPGHFWKSADINSSKVVPRFERFGLGVLESSNPKM

SEQ ID NO: 44177 - protein, 155 aa, Homo sapiens
  Payload ID: 9007
  Gene Symbol: KSR1
  Gene Name: kinase suppressor of ras 1
  ENSP ID: ENSP00000464081
MNEAKVKETLRRCGASGDECGRLQYALTCLRKVTGLGGEHKEDSSWSSLDARRESGSGPSTDTLSAASLPWPPGSSQLGRAGNSAQGPRSISVSALPASDSPTPSFSEGLSDTCIPLHASGRLTPRALHSFITPPTTPQLRRHTKLKPPRTPPPP

SEQ ID NO: 44178 - protein, 113 aa, Homo sapiens
  Payload ID: 9007
  Gene Symbol: KSR1
  Gene Name: kinase suppressor of ras 1
  ENSP ID: ENSP00000464680
MTPGKDEDQLPFSKAADVYAFGTVWYELQARDWPLKNQAAEASIWQIGSGEGMKRVLTSVSLGKEVSEILSACWAFDLQERPSFSLLMDMLEKLPKLNRRLSHPGHFWKSAEL

SEQ ID NO: 44179 - protein, 950 aa, Homo sapiens [sequence omitted]

SEQ ID NO: 44180 - protein, 921 aa, Homo sapiens
  Payload ID: 9008
  Gene Symbol: KSR2
  Gene Name: kinase suppressor of ras 2
  ENSP ID: ENSP00000389715
MIDLSISNLEGLRTKCATSNDLTQKEIRTLESKLVKYFSRQLSCKKKVALQERNAELDGFPQLRHWFRIVDVRKEVLEEISPGQLSLEDLLEMTDEQVCETVEKYGANREECARLNASLSCLRNVHMSGGNLSKQDWTIQWPTTETGKENNPVCPPEPTPWIRTHLSQSPRVPSKCVQHYCHTSPTPGAPVYTHVDRLTVDAYPGLCPPPPLESGHRSLPPSPRQRHAVRTPPRTPNIVTTVTPPGTPPMRKKNKLKPPGTPPPSSRKLIHLIPGFTALHRSKSHEFQLGHRVDEAHTPKAKKKSKPLNLKIHSSVGSCENIPSQQRSPLLSERSLRSFFVGHAPFLPSTPPVHTEANFSANTLSVPRWSPQIPRRDLGNSIKHRFSTKYWMSQTCTVCGKGMLFGLKCKNCKLKCHNKCTKEAPPCHLLIIHRGDPARLVRTESVPCDINNPLRKPPRYSDLHISQTLPKTNKINKDHIPVPYQPDSSSNPSSTTSSTPSSPAPPLPPSATPPSPLHPSPQCTRQQKNFNLPASHYYKYKQQFIFPDVVPVPETPTRAPQVILHPVTSNPILEGNPLLQIEVEPTSENEEVHDEAEESEDDFEEMNLSLLSARSFPRKASQTSIFLQEWDIPFEQLEIGELIGKGRFGQVYHGRWHGEVAIRLIDIERDNEDQLKAFKREVMAYRQTRHENVVLFMGACMSPPHLAIITSLCKGRTLYSVVRDAKIVLDVNKTRQIAQEIVKGMGYLHAKGILHKDLKSKNVFYDNGKVVITDFGLFSISGVLQAGRREDKLRIQNGWLCHLAPEIIRQLSPDTEEDKLPFSKHSDVFALGTIWYELHAREWPFKTQPAEAIIWQMGTGMKPNLSQIGMGKEISDILLFCWAFEQEERPTFTKLMDMLEKLPKRNRRLSHPGHFWKSAEL

SEQ ID NO: 44181 - protein, 1306 aa, Homo sapiens
  Payload ID: 9009
  Gene Symbol: KTN1
  Gene Name: kinectin 1 (kinesin receptor)
  Uniprot ID: Q86UP2
  ENSP ID: ENSP00000378719
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNDLREKNWEAMEALASTEKMLQDKVNKTSKERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 44182 - protein, 1306 aa, Homo sapiens; identical to SEQ ID NO: 44181
  Payload ID: 9009
  Gene Symbol: KTN1
  Gene Name: kinectin 1 (kinesin receptor)
  Uniprot ID: Q86UP2
  ENSP ID: ENSP00000378720

SEQ ID NO: 44183 - protein, 1306 aa, Homo sapiens; identical to SEQ ID NO: 44181
  Payload ID: 9009
  Gene Symbol: KTN1
  Gene Name: kinectin 1 (kinesin receptor)
  Uniprot ID: Q86UP2
  ENSP ID: ENSP00000378722

SEQ ID NO: 44184 - protein, 1357 aa, Homo sapiens
  Payload ID: 9009
  Gene Symbol: KTN1
  Gene Name: kinectin 1 (kinesin receptor)
  Uniprot ID: Q86UP2
  ENSP ID: ENSP00000378725
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNDLREKNWEAMEALASTEKMLQDKVNKTSKERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKDLLTELQKKLDDSYSEAVRQNEELNLLKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 44185 - protein, 1300 aa, Homo sapiens
  Payload ID: 9009
  Gene Symbol: KTN1
  Gene Name: kinectin 1 (kinesin receptor)
  Uniprot ID: Q86UP2
  ENSP ID: ENSP00000391964
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 44186 - protein, 1306 aa, Homo sapiens; identical to SEQ ID NO: 44181
  Payload ID: 9009
  Gene Symbol: KTN1
  Gene Name: kinectin 1 (kinesin receptor)
  Uniprot ID: Q86UP2
  ENSP ID: ENSP00000394992

SEQ ID NO: 44187 - protein, 1357 aa, Homo sapiens; identical to SEQ ID NO: 44184
  Payload ID: 9009
  Gene Symbol: KTN1
  Gene Name: kinectin 1 (kinesin receptor)
  Uniprot ID: Q86UP2
  ENSP ID: ENSP00000432149

SEQ ID NO: 44188 - protein, 16 aa, Homo sapiens
  Payload ID: 9009
  Gene Symbol: KTN1
  Gene Name: kinectin 1 (kinesin receptor)
  ENSP ID: ENSP00000451139
  MOD_RES (1)..(1): Any amino acid
XKEHYQVLGAFCLTLE

SEQ ID NO: 44189 - protein, 60 aa, Homo sapiens
  Payload ID: 9009
  Gene Symbol: KTN1
  Gene Name: kinectin 1 (kinesin receptor)
  ENSP ID: ENSP00000451641
MEFYESAYFIVLIPSIVITVIFLFFWLFMKETLYDEVLAKQKREQKLIPTKTDKKKAEKK

SEQ ID NO: 44190 - protein, 334 aa, Homo sapiens
  Payload ID: 9009
  Gene Symbol: KTN1
  Gene Name: kinectin 1 (kinesin receptor)
  ENSP ID: ENSP00000451698
MFWFRISEREKEISGLWNELDSLKDAVEHQRKKNNDLREKNWEAMEALASTEKMLQDKVNKTSKERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 44191 - protein, 138 aa, Homo sapiens
  Payload ID: 9009
  Gene Symbol: KTN1
  Gene Name: kinectin 1 (kinesin receptor)
  ENSP ID: ENSP00000451876
  MOD_RES (1)..(1): Any amino acid
XRREREHLEMELEKAEMERSTYVTEVRELKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLDTMVGDAAAIL

SEQ ID NO: 44192 - protein, 75 aa, Homo sapiens
  Payload ID: 9009
  Gene Symbol: KTN1
  Gene Name: kinectin 1 (kinesin receptor)
  ENSP ID: ENSP00000451878
MEFYESAYFIVLIPSIVITVIFLFFWLFMKETLYDEVLAKQKREQKLIPTKTDKKKAEKKKNKKKEIQNGNLHES

SEQ ID NO: 44193 - protein, 595 aa, Homo sapiens
  Payload ID: 9009
  Gene Symbol: KTN1
  Gene Name: kinectin 1 (kinesin receptor)
  ENSP ID: ENSP00000452073
MVPSCCFFRCRKQKDNRYQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 44194 - protein, 91 aa, Homo sapiens
  Payload ID: 9009
  Gene Symbol: KTN1
  Gene Name: kinectin 1 (kinesin receptor)
  ENSP ID: ENSP00000452205
  MOD_RES (1)..(1): Any amino acid
XDLSSKTQLLQDVQDENKLFKSQIEQLKQQNYQQASSFPPHEELLKVISEREKEISGLWNELDSLKDAVEHQRKKNNEGMVMQQQQQRWRH

SEQ ID NO: 44195 - protein, 162 aa, Homo sapiens
  Payload ID: 9009
  Gene Symbol: KTN1
  Gene Name: kinectin 1 (kinesin receptor)
  ENSP ID: ENSP00000452337
MVPSCCFFRCRKQKDNRYQPNKDVVEQMEKCIQEKDEKLKTVEELLETGLIQAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQM

SEQ ID NO: 44196 - protein, 160 aa, Homo sapiens
  Payload ID: 9009
  Gene Symbol: KTN1
  Gene Name: kinectin 1 (kinesin receptor)
  ENSP ID: ENSP00000452445
MEALASTEKMLQDKVNKTSKERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDI

SEQ ID NO: 44197 - protein, 14 aa, Homo sapiens
  Payload ID: 9009
  Gene Symbol: KTN1
  Gene Name: kinectin 1 (kinesin receptor)
  ENSP ID: ENSP00000452459
MQLMESEQKRVNKE

SEQ ID NO: 44198 - protein, 153 aa, Homo sapiens
  Payload ID: 9009
  Gene Symbol: KTN1
  Gene Name: kinectin 1 (kinesin receptor)
  ENSP ID: ENSP00000452576
VSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQIESSGKSSPEELTSKPRI

SEQ ID NO: 44199 - protein, 1056 aa, Homo sapiens
  Payload ID: 9010
  Gene Symbol: KIF11
  Gene Name: kinesin family member 11
  Uniprot ID: P52732
  ENSP ID: ENSP00000260731
MASQPNSSAKKKEEKGKNIQVVVRCRPFNLAERKASAHSIVECDPVRKEVSVRTGGLADKSSRKTYTFDMVFGASTKQIDVYRSVVCPILDEVIMGYNCTIFAYGQTGTGKTFTMEGERSPNEEYTWEEDPLAGIIPRTLHQIFEKLTDNGTEFSVKVSLLEIYNEELFDLLNPSSDVSERLQMFDDPRNKRGVIIKGLEEITVHNKDEVYQILEKGAAKRTTAATLMNAYSSRSHSVFSVTIHMKETTIDGEELVKIGKLNLVDLAGSENIGRSGAVDKRAREAGNINQSLLTLGRVITALVERTPHVPYRESKLTRILQDSLGGRTRTSIIATISPASLNLEETLSTLEYAHRAKNILNKPEVNQKLTKKALIKEYTEEIERLKRDLAAAREKNGVYISEENFRVMSGKLTVQEEQIVELIEKIGAVEEELNRVTELFMDNKNELDQCKSDLQNKTQELETTQKHLQETKLQLVKEEYITSALESTEEKLHDAASKLLNTVEETTKDVSGLHSKLDRKKAVDQHNAEAQDIFGKNLNSLFNNMEELIKDGSSKQKAMLEVHKTLFGNLLSSSVSALDTITTVALGSLTSIPENVSTHVSQIFNMILKEQSLAAESKTVLQELINVLKTDLLSSLEMILSPTVVSILKINSQLKHIFKTSLTVADKIEDQKKELDGFLSILCNNLHELQENTICSLVESQKQCGNLTEDLKTIKQTHSQELCKLMNLWTERFCALEEKCENIQKPLSSVQENIQQKSKDIVNKMTFHSQKFCADSDGFSQELRNFNQEGTKLVEESVKHSDKLNGNLEKISQETEQRCESLNTRTVYFSEQWVSSLNEREQELHNLLEVVSQCCEASSSDITEKSDGRKAAHEKQHNIFLDQMTIDEDKLIAQNLELNETIKIGLTKLNCFLEQDLKLDIPTGTTPQRKSYLYPSTLVRTEPREHLLDQLKRKQPELLMMLNCSENNKEETIPDVDVEEAVLGQYTEEPLSQEPSVDAGVDCSSIGGVPFFQHKKSHGKDKENRGINTLERSKVEETTEHLVTKSRLPLRAQINL

SEQ ID NO: 44200 - protein, 513 aa, Homo sapiens
  Payload ID: 9011
  Gene Symbol: KIF12
  Gene Name: kinesin family member 12
  ENSP ID: ENSP00000363232
MQRTFAWLLDRVQHLGAPVTLRASYLEIYNEQVRDLLSLGSPRPLPVRWNKTRGFYVEQLRVVEFGSLEALMELLQTGLSRRRNSAHTLNQASSRSHALLTLYISRQTAQQMPSVDPGEPPVGGKLCFVDLAGSEKVAATGSRGELMLEANSINRSLLALGHCISLLLDPQRKQSHIPFRDSKLTKLLADSLGGRGVTLMVACVSPSAQCLPETLSTLRYASRAQRVTTRPQAPKSPVAKQPQRLETEMLQLQEENRRLQFQLDQMDCKASGLSGARVAWAQRNLYGMLQEFMLENERLRKEKSQLQNSRDLAQNEQRILAQQVHALERRLLSACYHHQQGPGLTPPCPCLMAPAPPCHALPPLYSCPCCHICPLCRVPLAHWACLPGEHHLPQVLDPEASGGRPPSARPPPWAPPCSPGSAKCPRERSHSDWTQTRVLAEMLTEEEVVPSAPPLPVRPPKTSPGLRGGAGVPNLAQRLEALRDQIGSSLRRGRSQPPCSEGARSPGQVLPPH

SEQ ID NO: 44201 - protein, 333 aa, Homo sapiens
  Payload ID: 9011
  Gene Symbol: KIF12
  Gene Name: kinesin family member 12
  ENSP ID: ENSP00000473459
MELLQTGLSRRRNSAHTLNQASSRSHALLTLYISRQTAQQMPSVDPGEPPVGGKLCFVDLAGSEKVAATGSRGELMLEANSINRSLLALGHCISLLLDPQRKQSHIPFRDSKLTKLLADSLGGRGVTLMVACVSPSAQCLPETLSTLRYASRAQRVTTRPQAPKSPVAKQPQRLETEMLQLQEENRRLQFQLDQMDCKASGLSGARVAWAQRNLYGMLQEFMLENERLRKEKSQLQNSRDLAQNEQRILAQQVHALERRLLSACYHHQQGPGLTPPCPCLMAPAPPCHALPPLYSCPCCHICPLCRVPLAHWACLPGEHHLPQPLFWALRSQK

SEQ ID NO: 44202 - protein, 1805 aa, Homo sapiens
  Payload ID: 9012
  Gene Symbol: KIF13A
  Gene Name: kinesin family member 13A
  Uniprot ID: Q9H1H9
  ENSP ID: ENSP00000259711
MSDTKVKVAVRVRPMNRRELELNTKCVVEMEGNQTVLHPPPSNTKQGERKPPKVFAFDYCFWSMDESNTTKYAGQEVVFKCLGEGILEKAFQGYNACIFAYGQTGSGKSFSMMGHAEQLGLIPRLCCALFKRISLEQNESQTFKVEVSYMEIYNEKVRDLLDPKGSRQSLKVREHKVLGPYVDGLSQLAVTSFEDIESLMSEGNKSRTVAATNMNEESSRSHAVFNIIITQTLYDLQSGNSGEKVSKVSLVDLAGSERVSKTGAAGERLKEGSNINKSLTTLGLVISSLADQAAGKGKSKFVPYRDSVLTWLLKDNLGGNSQTSMIATISPAADNYEETLSTLRYADRAKRIVNHAVVNEDPNAKVIRELREEVEKLREQLSQAEAMKAPELKEKLEESEKLIKELTVTWEEKLRKTEEIAQERQRQLESMGISLEMSGIKVGDDKCYLVNLNADPALNELLVYYLKDHTRVGADTSQDIQLFGIGIQPQHCEIDIASDGDVTLTPKENARSCVNGTLVCSTTQLWHGDRILWGNNHFFRINLPKRKRRDWLKDFEKETGPPEHDLDAASEASSEPDYNYEFAQMEVIMKTLNSNDPVQNVVQVLEKQYLEEKRSALEEQRLMYERELEQLRQQLSPDRQPQSSGPDRLAYSSQTAQQKVTQWAEERDELFRQSLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQRDDEDGDDMDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQESMPPPQAHNPGCIVPSGSNGSSMPVEHNSKREKKIDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNILEDHSFTEFMGVSEGKDFDGLTDSSAGELSSRRSLPNKTGGKTVSDGLHHPSQLHSKLENDQVIIPEAAFWVLCCQ

SEQ ID NO: 44203 - protein, 889 aa, Homo sapiens
  Payload ID: 9012
  Gene Symbol: KIF13A
  Gene Name: kinesin family member 13A
  ENSP ID: ENSP00000351150
  MOD_RES (1)..(1): Any amino acid
XQYLEEKRSALEEQRLMYERELEQLRQQLSPDRQPQSSGPDRLAYSSQTAQQKVTQWAEERDELFRQSLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQRDDEDGDDMDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQEVNA

SEQ ID NO: 44204 - protein, 1749 aa, Homo sapiens
  Payload ID: 9012
  Gene Symbol: KIF13A
  Gene Name: kinesin family member 13A
  Uniprot ID: Q9H1H9
  ENSP ID: ENSP00000368091
MSDTKVKVAVRVRPMNRRELELNTKCVVEMEGNQTVLHPPPSNTKQGERKPPKVFAFDYCFWSMDESNTTKYAGQEVVFKCLGEGILEKAFQGYNACIFAYGQTGSGKSFSMMGHAEQLGLIPRLCCALFKRISLEQNESQTFKVEVSYMEIYNEKVRDLLDPKGSRQSLKVREHKVLGPYVDGLSQLAVTSFEDIESLMSEGNKSRTVAATNMNEESSRSHAVFNIIITQTLYDLQSGNSGEKVSKVSLVDLAGSERVSKTGAAGERLKEGSNINKSLTTLGLVISSLADQAAGKGKSKFVPYRDSVLTWLLKDNLGGNSQTSMIATISPAADNYEETLSTLRYADRAKRIVNHAVVNEDPNAKVIRELREEVEKLREQLSQAEAMKAPELKEKLEESEKLIKELTVTWEEKLRKTEEIAQERQRQLESMGISLEMSGIKVGDDKCYLVNLNADPALNELLVYYLKDHTRVGADTSQDIQLFGIGIQPQHCEIDIASDGDVTLTPKENARSCVNGTLVCSTTQLWHGDRILWGNNHFFRINLPKRKRRDWLKDFEKETGPPEHDLDAASEASSEPDYNYEFAQMEVIMKTLNSNDPVQNVVQVLEKQYLEEKRSALEEQRLMYERELEQLRQQLSPDRQPQSSGPDRLAYSSQTAQQKVTQWAEERDELFRQSLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQEDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNILEDHSFTEFMGVSEGKDFDGLTDSSAGELSSRRSLPNKTGGKTVSDGLHHPSQLHSKLENDQGGTTSR

SEQ ID NO: 44205 - protein, 1770 aa, Homo sapiens
  Payload ID: 9012
  Gene Symbol: KIF13A
  Gene Name: kinesin family member 13A
  Uniprot ID: Q9H1H9
  ENSP ID: ENSP00000368103
MSDTKVKVAVRVRPMNRRELELNTKCVVEMEGNQTVLHPPPSNTKQGERKPPKVFAFDYCFWSMDESNTTKYAGQEVVFKCLGEGILEKAFQGYNACIFAYGQTGSGKSFSMMGHAEQLGLIPRLCCALFKRISLEQNESQTFKVEVSYMEIYNEKVRDLLDPKGSRQSLKVREHKVLGPYVDGLSQLAVTSFEDIESLMSEGNKSRTVAATNMNEESSRSHAVFNIIITQTLYDLQSGNSGEKVSKVSLVDLAGSERVSKTGAAGERLKEGSNINKSLTTLGLVISSLADQAAGKGKSKFVPYRDSVLTWLLKDNLGGNSQTSMIATISPAADNYEETLSTLRYADRAKRIVNHAVVNEDPNAKVIRELREEVEKLREQLSQAEAMKAPELKEKLEESEKLIKELTVTWEEKLRKTEEIAQERQRQLESMGISLEMSGIKVGDDKCYLVNLNADPALNELLVYYLKDHTRVGADTSQDIQLFGIGIQPQHCEIDIASDGDVTLTPKENARSCVNGTLVCSTTQLWHGDRILWGNNHFFRINLPKRKRRDWLKDFEKETGPPEHDLDAASEASSEPDYNYEFAQMEVIMKTLNSNDPVQNVVQVLEKQYLEEKRSALEEQRLMYERELEQLRQQLSPDRQPQSSGPDRLAYSSQTAQQKVTQWAEERDELFRQSLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQRDDEDGDDMDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQEDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNILEDHSFTEFMGVSEGKDFDGLTDSSAGELSSRRSLPNKTGGKTVSDGLHHPSQLHSKLENDQVIIPEAAFWVLCCQ

SEQ ID NO: 44206 - protein, 1757 aa, Homo sapiens
  Payload ID: 9012
  Gene Symbol: KIF13A
  Gene Name: kinesin family member 13A
  Uniprot ID: Q9H1H9
  ENSP ID: ENSP00000368120
MSDTKVKVAVRVRPMNRRELELNTKCVVEMEGNQTVLHPPPSNTKQGERKPPKVFAFDYCFWSMDESNTTKYAGQEVVFKCLGEGILEKAFQGYNACIFAYGQTGSGKSFSMMGHAEQLGLIPRLCCALFKRISLEQNESQTFKVEVSYMEIYNEKVRDLLDPKGSRQSLKVREHKVLGPYVDGLSQLAVTSFEDIESLMSEGNKSRTVAATNMNEESSRSHAVFNIIITQTLYDLQSGNSGEKVSKVSLVDLAGSERVSKTGAAGERLKEGSNINKSLTTLGLVISSLADQAAGKGKSKFVPYRDSVLTWLLKDNLGGNSQTSMIATISPAADNYEETLSTLRYADRAKRIVNHAVVNEDPNAKVIRELREEVEKLREQLSQAEAMKAPELKEKLEESEKLIKELTVTWEEKLRKTEEIAQERQRQLESMGISLEMSGIKVGDDKCYLVNLNADPALNELLVYYLKDHTRVGADTSQDIQLFGIGIQPQHCEIDIASDGDVTLTPKENARSCVNGTLVCSTTQLWHGDRILWGNNHFFRINLPKRKRRDWLKDFEKETGPPEHDLDAASEASSEPDYNYEFAQMEVIMKTLNSNDPVQNVVQVLEKQYLEEKRSALEEQRLMYERELEQLRQQLSPDRQPQSSGPDRLAYSSQTAQQKVTQWAEERDELFRQSLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQEDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNILEDHSFTEFMGVSEGKDFDGLTDSSAGELSSRRSLPNKTGGKTVSDGLHHPSQLHSKLENDQVIIPEAAFWVLCCQ

SEQ ID NO: 44207 - protein, 270 aa, Homo sapiens
  Payload ID: 9012
  Gene Symbol: KIF13A
  Gene Name: kinesin family member 13A
  ENSP ID: ENSP00000422808
LEFISDGALAIEVWGHRCAGNGSSIWEVDSLHAKTRTLHDRWNEVTRRIEMWISILELNELGEYAAVELHQAKDVNTGGIFQLRQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRK

SEQ ID NO: 44208 - protein, 70 aa, Homo sapiens
  Payload ID: 9012
  Gene Symbol: KIF13A
  Gene Name: kinesin family member 13A
  Uniprot ID: Q9H1H9
  ENSP ID: ENSP00000425453
MSDTKVKVAVRVRPMNRRELELNTKCVVEMEGNQTVLHPPPSNTKQGERLVTVAHISNSSTLGGQGKRIT

SEQ ID NO: 44209 - protein, 801 aa, Homo sapiens
  Payload ID: 9012
  Gene Symbol: KIF13A
  Gene Name: kinesin family member 13A
  ENSP ID: ENSP00000425616
EVTRRIEMWISILELNELGEYAAVELHQAKDVNTGGIFQLRQGHSRRVQVTVKPVQHSGTLPLMVEAILSVSIGCVTARSTKLQRGLDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQESMPPPQAHNPGCIVPSGSNGSSMPVEHNSKREKKIDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNILEDHSFTEFMGVSEGKDFDGLTDSSAGELSSRRSLPNKTGGKTVSDGLHHPSQLHSKLENDQGGTTSR

SEQ ID NO: 44210 - protein, 1826 aa, Homo sapiens
  Payload ID: 9013
  Gene Symbol: KIF13B
  Gene Name: kinesin family member 13B
  Uniprot ID: Q9NQT8
  ENSP ID: ENSP00000427900
MGDSKVKVAVRIRPMNRRETDLHTKCVVDVDANKVILNPVNTNLSKGDARGQPKVFAYDHCFWSMDESVKEKYAGQDIVFKCLGENILQNAFDGYNACIFAYGQTGSGKSYTMMGTADQPGLIPRLCSGLFERTQKEENEEQSFKVEVSYMEIYNEKVRDLLDPKGSRQTLKVREHSVLGPYVDGLSKLAVTSYKDIESLMSEGNKSRTVAATNMNEESSRSHAVFKITLTHTLYDVKSGTSGEKVGKLSLVDLAGSERATKTGAAGDRLKEGSNINKSLTTLGLVISALADQSAGKNKNKFVPYRDSVLTWLLKDSLGGNSKTAMVATVSPAADNYDETLSTLRYADRAKHIVNHAVVNEDPNARIIRDLREEVEKLREQLTKAEAMKSPELKDRLEESEKLIQEMTVTWEEKLRKTEEIAQERQKQLESLGISLQSSGIKVGDDKCFLVNLNADPALNELLVYYLKEHTLIGSANSQDIQLCGMGILPEHCIIDITSEGQVMLTPQKNTRTFVNGSSVSSPIQLHHGDRILWGNNHFFRLNLPKKKKKAEREDEDQDPSMKNENSSEQLDVDGDSSSEVSSEVNFNYEYAQMEVTMKALGSNDPMQSILNSLEQQHEEEKRSALERQRLMYEHELEQLRRRLSPEKQNCRSMDRFSFHSPSAQQRLRQWAEEREATLNNSLMRLREQIVKANLLVREANYIAEELDKRTEYKVTLQIPASSLDANRKRGSLLSEPAIQVRRKGKGKQIWSLEKLDNRLLDMRDLYQEWKECEEDNPVIRSYFKRADPFYDEQENHSLIGVANVFLESLFYDVKLQYAVPIINQKGEVAGRLHVEVMRLSGDVGERIAGGDEVAEVSFEKETQENKLVCMVKILQATGLPQHLSHFVFCKYSFWDQQEPVIVAPEVDTSSSSVSKEPHCMVVFDHCNEFSVNITEDFIEHLSEGALAIEVYGHKINDPRKNPALWDLGIIQAKTRSLRDRWSEVTRKLEFWVQILEQNENGEYCPVEVISAKDVPTGGIFQLRQGQSRRVQVEVKSVQESGTLPLMEECILSVGIGCVKVRPLRAPRTHETFHEEEEDMDSYQDRDLERLRRKWLNALTKRQEYLDQQLQKLVSKRDKTEDDADREAQLLEMRLTLTEERNAVMVPSAGSGIPGAPAEWTPVPGMETHIPVIFLDLNADDFSSQDNLDDPEAGGWDATLTGEEEEEFFELQIVKQHDGEVKAEASWDSAVHGCPQLSRGTPVDERLFLIVRVTVQLSHPADMQLVLRKRICVNVHGRQGFAQSLLKKMSHRSSIPGCGVTFEIVSNIPEDAQGVEEREALARMAANVENPASADSEAYIEKYLRSVLAVENLLTLDRLRQEVAVKEQLTGKGKLSRRSISSPNVNRLSGSRQDLIPSYSLGSNKGRWESQQDVSQTTVSRGIAPAPALSVSPQNNHSPDPGLSNLAASYLNPVKSFVPQMPKLLKSLFPVRDEKRGKRPSPLAHQPVPRIMVQSASPDIRVTRMEEAQPEMGPDVLVQTMGAPALKICDKPAKVPSPPPVIAVTAVTPAPEAQDGPPSPLSEASSGYFSHSVSTATLSDALGPGLDAAAPPGSMPTAPEAEPEAPISHPPPPTAVPAEEPPGPQQLVSPGRERPDLEAPAPGSPFRVRRVRASELRSFSRMLAGDPGCSPGAEGNAPAPGAGGQALASDSEEADEVPEWLREGEFVTVGAHKTGVVRYVGPADFQEGTWVGVELDLPSGKNDGSIGGKQYFRCNPGYGLLVRPSRVRRATGPVRRRSTGLRLGAPEARRSATLSGSATNLASLTAALAKADRSHKNPENRKSWAS

SEQ ID NO: 44211 - protein, 61 aa, Homo sapiens
  Payload ID: 9013
  Gene Symbol: KIF13B
  Gene Name: kinesin family member 13B
  ENSP ID: ENSP00000429027
MGDSKVKVAVRIRPMNRRETDLHTKCVVDVDANKVILNPVNTNLSKGDARLWKILYHDGHS

SEQ ID NO: 44212 - protein, 418 aa, Homo sapiens
  Payload ID: 9013
  Gene Symbol: KIF13B
  Gene Name: kinesin family member 13B
  ENSP ID: ENSP00000429106
LSGSRQDLIPSYSLGSNKGRWESQQDVSQTTVSRGIAPAPALSVSPQNNHSPDPGLSNLAASYLNPVKSFVPQMPKLLKSLFPVRDEKRGKRPSPLAHQAQPEMGPDVLVQTMGAPALKICDKPAKVPSPPPVIAVTAVTPAPEAQDGPPSPLSEASSGYFSHSVSTATLSDALGPGLDAAAPPGSMPTAPEAEPEAPISHPPPPTAVPAEEPPGPQQLVSPGRERPDLEAPAPGSPFRVRRVRASELRSFSRMLAGDPGCSPGAEGNAPAPGAGGQALASDSEEADEVPEWLREGEFVTVGAHKTGVVRYVGPADFQEGTWVGVELDLPSGKNDGSIGGKQYFRCNPGYGLLVRPSRVRRATGPVRRRSTGLRLGAPEARRSATLSGSATNLASLTAALAKADRSHKNPENRKSWAS

SEQ ID NO: 44213 - protein, 743 aa, Homo sapiens
  Payload ID: 9013
  Gene Symbol: KIF13B
  Gene Name: kinesin family member 13B
  ENSP ID: ENSP00000429201
MGDSKVKVAVRIRPMNRRETDLHTKCVVDVDANKVILNPVNTNLSKGDARGQPKVFAYDHCFWSMDESVKEKYAGQDIVFKCLGENILQNAFDGYNACIFAYGQTGSGKSYTMMGTADQPGLIPRLCSGLFERTQKEENEEQSFKVEVSYMEIYNEKVRDLLDPKGSRQTLKVREHSVLGPYVDGLSKLAVTSYKDIESLMSEGNKSRTVAATNMNEESSRSHAVFKITLTHTLYDVKSGTSGEKVGKLSLVDLAGSERATKTGAAGDRLKEGSNINKSLTTLGLVISALADQSAGKNKNKFVPYRDSVLTWLLKDSLGGNSKTAMVATVSPAADNYDETLSTLRYADRAKHIVNHAVVNEDPNARIIRDLREEVEKLREQLTKAEAMKSPELKDRLEESEKLIQEMTVTWEEKLRKTEEIAQERQKQLESLGISLQSSGIKVGDDKCFLVNLNADPALNELLVYYLKEHTLIGSANSQDIQLCGMGILPEHCIIDITSEGQVMLTPQKNTRTFVNGSSVSSPIQLHHGDRILWGNNHFFRLNLPKKKKKAEREDEDQDPSMKNENSSEQLDVDGDSSSEVSSEVNFNYEYAQMEVTMKALGSNDPMQSILNSLEQQHEEEKRSALERQRLMYEHELEQLRRRLSPEKQNCRSMDRFSFHSPSAQQRLRQWAEEREATLNNSLMRLREQIVKANLLVREANYIAEELDKRTEYKVTLQIPASSLDANRKVRLPFLEKNKDLIG

SEQ ID NO: 44214 - protein, 53 aa, Homo sapiens
  Payload ID: 9013
  Gene Symbol: KIF13B
  Gene Name: kinesin family member 13B
  ENSP ID: ENSP00000431006
MGDSKVKVAVRIRPMNRRDLTVRSQLIQYGQIPLSSGFKKLSWTSGPEEVKRD

SEQ ID NO: 44215 - protein, 1648 aa, Homo sapiens
  Payload ID: 9014
  Gene Symbol: KIF14
  Gene Name: kinesin family member 14
  Uniprot ID: Q15058
  ENSP ID: ENSP00000356319
MSLHSTHNRNNSGDILDIPSSQNSSSLNALTHSSRLKLHLKSDMSECENDDPLLRSAGKVRDINRTYVISASRKTADMPLTPNPVGRLALQRRTTRNKESSLLVSELEDTTEKTAETRLTLQRRAKTDSAEKWKTAEIDSVKMTLNVGGETENNGVSKESRTNVRIVNNAKNSFVASSVPLDEDPQVIEMMADKKYKETFSAPSRANENVALKYSSNRPPIASLSQTEVVRSGHLTTKPTQSKLDIKVLGTGNLYHRSIGKEIAKTSNKFGSLEKRTPTKCTTEHKLTTKCSLPQLKSPAPSILKNRMSNLQVKQRPKSSFLANKQERSAENTILPEEETVVQNTSAGKDPLKVENSQVTVAVRVRPFTKREKIEKASQVVFMSGKEITVEHPDTKQVYNFIYDVSFWSFDECHPHYASQTTVYEKLAAPLLERAFEGFNTCLFAYGQTGSGKSYTMMGFSEEPGIIPRFCEDLFSQVARKQTQEVSYHIEMSFFEVYNEKIHDLLVCKDENGQRKQPLRVREHPVYGPYVEALSMNIVSSYADIQSWLELGNKQRATAATGMNDKSSRSHSVFTLVMTQTKTEFVEGEEHDHRITSRINLIDLAGSERCSTAHTNGDRLKEGVSINKSLLTLGKVISALSEQANQRSVFIPYRESVLTWLLKESLGGNSKTAMIATISPAASNIEETLSTLRYANQARLIVNIAKVNEDMNAKLIRELKAEIAKLKAAQRNSRNIDPERYRLCRQEITSLRMKLHQQERDMAEMQRVWKEKFEQAEKRKLQETKELQKAGIMFQMDNHLPNLVNLNEDPQLSEMLLYMIKEGTTTVGKYKPNSSHDIQLSGVLIADDHCTIKNFGGTVSIIPVGEAKTYVNGKHILEITVLRHGDRVILGGDHYFRFNHPVEVQKGKRPSGRDTPISEGPKDFEFAKNELLMAQRSQLEAEIKEAQLKAKEEMMQGIQIAKEMAQQELSSQKAAYESKIKALEAELREESQRKKMQEINNQKANHKIEELEKAKQHLEQEIYVNKKRLEMETLATKQALEDHSIRHARILEALETEKQKIAKEVQILQQNRNNRDKTFTVQTTWSSMKLSMMIQEANAISSKLKTYYVFGRHDISDKSSSDTSIRVRNLKLGISTFWSLEKFESKLAAMKELYESNGSNRGEDAFCDPEDEWEPDITDAPVSSLSRRRSRSLMKNRRISGCLHDIQVHPIKNLHSSHSSGLMDKSSTIYSNSAESFLPGICKELIGSSLDFFGQSYDEERTIADSLINSFLKIYNGLFAISKAHEEQDEESQDNLFSSDRAIQSLTIQTACAFEQLVVLMKHWLSDLLPCTNIARLEDELRQEVKKLGGYLQLFLQGCCLDISSMIKEAQKNAIQIVQQAVKYVGQLAVLKGSKLHFLENGNNKAASVQEEFMDAVCDGVGLGMKILLDSGLEKAKELQHELFRQCTKNEVTKEMKTNAMGLIRSLENIFAESKIKSFRRQVQEENFEYQDFKRMVNRAPEFLKLKHCLEKAIEIIISALKGCHSDINLLQTCVESIRNLASDFYSDFSVPSTSVGSYESRVTHIVHQELESLAKSLLFCFESEESPDLLKPWETYNQNTKEEHQQSKSSGIDGSKNKGVPKRVYELHGSSPAVSSEECTPSRIQWV

SEQ ID NO: 44216 - protein, 1648 aa, Homo sapiens; identical to SEQ ID NO: 44215
  Payload ID: 9014
  Gene Symbol: KIF14
  Gene Name: kinesin family member 14
  Uniprot ID: Q15058
  ENSP ID: ENSP00000483069

SEQ ID NO: 44217 - protein, 1388 aa, Homo sapiens
  Payload ID: 9015
  Gene Symbol: KIF15
  Gene Name: kinesin family member 15
  Uniprot ID: Q9NS87
  ENSP ID: ENSP00000324020
MAPGCKTELRSVTNGQSNQPSNEGDAIKVFVRIRPPAERSGSADGEQNLCLSVLSSTSLRLHSNPEPKTFTFDHVADVDTTQESVFATVAKSIVESCMSGYNGTIFAYGQTGSGKTFTMMGPSESDNFSHNLRGVIPRSFEYLFSLIDREKEKAGAGKSFLCKCSFIEIYNEQIYDLLDSASAGLYLREHIKKGVFVVGAVEQVVTSAAEAYQVLSGGWRNRRVASTSMNRESSRSHAVFTITIESMEKSNEIVNIRTSLLNLVDLAGSERQKDTHAEGMRLKEAGNINRSLSCLGQVITALVDVGNGKQRHVCYRDSKLTFLLRDSLGGNAKTAIIANVHPGSRCFGETLSTLNFAQRAKLIKNKAVVNEDTQGNVSQLQAEVKRLKEQLAELASGQTPPESFLTRDKKKTNYMEYFQEAMLFFKKSEQEKKSLIEKVTQLEDLTLKKEKFIQSNKMIVKFREDQIIRLEKLHKESRGGFLPEEQDRLLSELRNEIQTLREQIEHHPRVAKYAMENHSLREENRRLRLLEPVKRAQEMDAQTIAKLEKAFSEISGMEKSDKNQQGFSPKAQKEPCLFANTEKLKAQLLQIQTELNNSKQEYEEFKELTRKRQLELESELQSLQKANLNLENLLEATKACKRQEVSQLNKIHAETLKIITTPTKAYQLHSRPVPKLSPEMGSFGSLYTQNSSILDNDILNEPVPPEMNEQAFEAISEELRTVQEQMSALQAKLDEEEHKNLKLQQHVDKLEHHSTQMQELFSSERIDWTKQQEELLSQLNVLEKQLQETQTKNDFLKSEVHDLRVVLHSADKELSSVKLEYSSFKTNQEKEFNKLSERHMHVQLQLDNLRLENEKLLESKACLQDSYDNLQEIMKFEIDQLSRNLQNFKKENETLKSDLNNLMELLEAEKERNNKLSLQFEEDKENSSKEILKVLEAVRQEKQKETAKCEQQMAKVQKLEESLLATEKVISSLEKSRDSDKKVVADLMNQIQELRTSVCEKTETIDTLKQELKDINCKYNSALVDREESRVLIKKQEVDILDLKETLRLRILSEDIERDMLCEDLAHATEQLNMLTEASKKHSGLLQSAQEELTKKEALIQELQHKLNQKKEEVEQKKNEYNFKMRQLEHVMDSAAEDPQSPKTPPHFQTHLAKLLETQEQEIEDGRASKTSLEHLVTKLNEDREVKNAEILRMKEQLREMENLRLESQQLIEKNWLLQGQLDDIKRQKENSDQNHPDNQQLKNEQEESIKERLAKSKIVEEMLKMKADLEEVQSALYNKEMECLRMTDEVERTQTLESKAFQEKEQLRSKLEEMYEERERTSQEMEMLRKQVECLAEENGKLVGHQNLHQKIQYVVRLKKENVRLAEETEKLRAENVFLKEKKRSES

SEQ ID NO: 44218 - protein, 1023 aa, Homo sapiens
  Payload ID: 9015
  Gene Symbol: KIF15
  Gene Name: kinesin family member 15
  ENSP ID: ENSP00000389982
MAVVNEDTQGNVSQLQAEVKRLKEQLAELASGQTPPESFLTRDKKKTNYMEYFQEAMLFFKKSEQEKKSLIEKVTQLEDLTLKKEKFIQSNKMIVKFREDQIIRLEKLHKESRGGFLPEEQDRLLSELRNEIQTLREQIEHHPRVAKYAMENHSLREENRRLRLLEPVKRAQEMDAQTIAKLEKAFSEISGMEKSDKNQQGFSPKAQKEPCLFANTEKLKAQLLQIQTELNNSKQEYEEFKELTRKRQLELESELQSLQKANLNLENLLEATKACKRQEVSQLNKIHAETLKIITTPTKAYQLHSRPVPKLSPEMGSFGSLYTQNSSILDNDILNEPVPPEMNEQAFEAISEELRTVQEQMSALQAKLDEEEHKNLKLQQHVDKLEHHSTQMQELFSSERIDWTKQQEELLSQLNVLEKQLQETQTKNDFLKSEVHDLRVVLHSADKELSSVKLEYSSFKTNQEKEFNKLSERHMHVQLQLDNLRLENEKLLESKACLQDSYDNLQEIMKFEIDQLSRNLQNFKKENETLKSDLNNLMELLEAEKERNNKLSLQFEEDKENSSKEILKVLEAVRQEKQKETAKCEQQMAKVQKLEESLLATEKVISSLEKSRDSDKKVVADLMNQIQELRTSVCEKTETIDTLKQELKDINCKYNSALVDREESRVLIKKQEVDILDLKETLRLRILSEDIERDMLCEDLAHATEQLNMLTEASKKHSGLLQSAQEELTKKEALIQELQHKLNQKKEEVEQKKNEYNFKMRQLEHVMDSAAEDPQSPKTPPHFQTHLAKLLETQEQEIEDGRASKTSLEHLVTKLNEDREVKNAEILRMKEQLREMENLRLESQQLIEKNWLLQGQLDDIKRQKENSDQNHPDNQQLKNEQEESIKERLAKSKIVEEMLKMKADLEEVQSALYNKEMECLRMTDEVERTQTLESKAFQEKEQLRSKLEEMYEERERTSQEMEMLRKQVECLAEENGKLVGHQNLHQKIQYVVRLKKENVRLAEETEKLRAENVFLKEKKRSES

SEQ ID NO: 44219 - protein, 194 aa, Homo sapiens
  Payload ID: 9015
  Gene Symbol: KIF15
  Gene Name: kinesin family member 15
  ENSP ID: ENSP00000391205
  MOD_RES (1)..(1): Any amino acid
XEQLREMENLRLESQQLIEKNWLLQGQLDDIKRQKENSDQNHPDNQQLKNEQEESIKERLAKSKIVEEMLKMKADLEEVQSALYNKEMECLRMTDEVERTQTLESKAFQEKEQLRSKLEEMYEERERTSQEMEMLRKQVECLAEENGKLVGHQNLHQKIQYVVRLKKENVRLAEETEKLRAENVFLKEKKRSES

SEQ ID NO: 44220 - protein, 128 aa, Homo sapiens
  Payload ID: 9015
  Gene Symbol: KIF15
  Gene Name: kinesin family member 15
  ENSP ID: ENSP00000400802
  MOD_RES (1)..(1): Any amino acid
XSVKLEYSSFKTNQEKEFNKLSERHMHVQLQLDNLRLENEKLLESKACLQDSYDNLQEIMKFEIDQLSRNLQNFKKENETLKSDLNNLMELLEAEKERNNKLSLQFEEDKENSSKPWYTVVNVELTSS

SEQ ID NO: 44221 - protein, 83 aa, Homo sapiens
  Payload ID: 9015
  Gene Symbol: KIF15
  Gene Name: kinesin family member 15
  ENSP ID: ENSP00000406939
MAPGCKIMKVMPSKFLCEFVLLQKDLGQLMESRTYAYLCCPPRVSGCTPTLSPRPSRLIMLQMWIPLRNLYSQLWLKALWSLA

SEQ ID NO: 44222 - protein, 711 aa, Homo sapiens
  Payload ID: 9015
  Gene Symbol: KIF15
  Gene Name: kinesin family member 15
  ENSP ID: ENSP00000425499
MNRESSRSHAVFTITIESMEKSNEIVNIRTSLLNLVDLAGSERQKDTHAEGMRLKEAGNINRSLSCLGQVITALVDVGNGKQRHVCYRDSKLTFLLRDSLGGNAKTAIIANVHPGSRCFGETLSTLNFAQRAKLIKNKAVVNEDTQGNVSQLQAEVKRLKEQLAELASGQTPPESFLTRDKKKTNYMEYFQEAMLFFKKSEQEKKSLIEKVTQLEDLTLKKEKFIQSNKMIVKFREDQIIRLEKLHKESRGGFLPEEQDRLLSELRNEIQTLREQIEHHPRVAKYAMENHSLREENRRLRLLEPVKRAQEMDAQTIAKLEKAFSEISGMEKSDKNQQGFSPKAQKEPCLFANTEKLKAQLLQIQTELNNSKQEYEEFKELTRKRQLELESELQSLQKANLNLENLLEATKACKRQEVSQLNKIHAETLKIITTPTKAYQLHSRPVPKLSPEMGSFGSLYTQNSSILDNDILNEPVPPEMNEQAFEAISEELRTVQEQMSALQAKLDEEEHKNLKLQQHVDKLEHHSTQMQELFSSERIDWTKQQEELLSQLNVLEKQLQETQTKNDFLKSEVHDLRVVLHSADKELSSVKLEYSSFKTNQEKEFNKLSERHMHVQLQLDNLRLENEKLLESKACLQDSYDNLQEIMKFEIDQLSRNLQNFKKENETLKSDLNNLMELLEAEKERNNKLSLQFEEDKENSSKEILKVLEAVR

SEQ ID NO: 44223 - protein, 128 aa, Homo sapiens; identical to SEQ ID NO: 44220
  Payload ID: 9015
  Gene Symbol: KIF15
  Gene Name: Kinesin family member 15
  ENSP ID: ENSP00000485853
  MOD_RES (1)..(1): Any amino acid

SEQ ID NO: 44224 - protein, 1388 aa, Homo sapiens; identical to SEQ ID NO: 44217
  Payload ID: 9015
  Gene Symbol: KIF15
  Gene Name: Kinesin family member 15
  ENSP ID: ENSP00000486004

SEQ ID NO: 44225 - protein, 83 aa, Homo sapiens; identical to SEQ ID NO: 44221
  Payload ID: 9015
  Gene Symbol: KIF15
  Gene Name: Kinesin family member 15
  ENSP ID: ENSP00000486282

SEQ ID NO: 44226 - protein, 194 aa, Homo sapiens; identical to SEQ ID NO: 44219
  Payload ID: 9015
  Gene Symbol: KIF15
  Gene Name: Kinesin family member 15
  ENSP ID: ENSP00000486350
  MOD_RES (1)..(1): Any amino acid

SEQ ID NO: 44227 - protein, 711 aa, Homo sapiens; identical to SEQ ID NO: 44222
  Payload ID: 9015
  Gene Symbol: KIF15
  Gene Name: Kinesin family member 15
  ENSP ID: ENSP00000486999

SEQ ID NO: 44228 - protein, 1023 aa, Homo sapiens; identical to SEQ ID NO: 44218
  Payload ID: 9015
  Gene Symbol: KIF15
  Gene Name: Kinesin family member 15
  ENSP ID: ENSP00000487255

SEQ ID NO: 44229 - protein, 1317 aa, Homo sapiens
  Payload ID: 9016
  Gene Symbol: KIF16B
  Gene Name: kinesin family member 16B
  Uniprot ID: Q96L93
  ENSP ID: ENSP00000347076
MASVKVAVRVRPMNRREKDLEAKFIIQMEKSKTTITNLKIPEGGTGDSGRERTKTFTYDFSFYSADTKSPDYVSQEMVFKTLGTDVVKSAFEGYNACVFAYGQTGSGKSYTMMGNSGDSGLIPRICEGLFSRINETTRWDEASFRTEVSYLEIYNERVRDLLRRKSSKTFNLRVREHPKEGPYVEDLSKHLVQNYGDVEELMDAGNINRTTAATGMNDVSSRSHAIFTIKFTQAKFDSEMPCETVSKIHLVDLAGSERADATGATGVRLKEGGNINKSLVTLGNVISALADLSQDAANTLAKKKQVFVPYRDSVLTWLLKDSLGGNSKTIMIATISPADVNYGETLSTLRYANRAKNIINKPTINEDANVKLIRELRAEIARLKTLLAQGNQIALLDSPTALSMEEKLQQNEARVQELTKEWTNKWNETQNILKEQTLALRKEGIGVVLDSELPHLIGIDDDLLSTGIILYHLKEGQTYVGRDDASTEQDIVLHGLDLESEHCIFENIGGTVTLIPLSGSQCSVNGVQIVEATHLNQGAVILLGRTNMFRFNHPKEAAKLREKRKSGLLSSFSLSMTDLSKSRENLSAVMLYNPGLEFERQQREELEKLESKRKLIEEMEEKQKSDKAELERMQQEVETQRKETEIVQLQIRKQEESLKRRSFHIENKLKDLLAEKEKFEEERLREQQEIELQKKRQEEETFLRVQEELQRLKELNNNEKAEKFQIFQELDQLQKEKDEQYAKLELEKKRLEEQEKEQVMLVAHLEEQLREKQEMIQLLRRGEVQWVEEEKRDLEGIRESLLRVKEARAGGDEDGEELEKAQLRFFEFKRRQLVKLVNLEKDLVQQKDILKKEVQEEQEILECLKCEHDKESRLLEKHDESVTDVTEVPQDFEKIKPVEYRLQYKERQLQYLLQNHLPTLLEEKQRAFEILDRGPLSLDNTLYQVEKEMEEKEEQLAQYQANANQLQKLQATFEFTANIARQEEKVRKKEKEILESREKQQREALERALARLERRHSALQRHSTLGMEIEEQRQKLASLNSGSREQSGLQASLEAEQEALEKDQERLEYEIQQLKQKIYEVDGVQKDHHGTLEGKVASSSLPVSAEKSHLVPLMDARINAYIEEEVQRRLQDLHRVISEGCSTSADTMKDNEKLHNGTIQRKLKYERMVSRSLGANPDDLKDPIKISIPRYVLCGQGKDAHFEFEVKITVLDETWTVFRRYSRFREMHKTLKLKYAELAALEFPPKKLFGNKDERVIAERRSHLEKYLRDFFSVMLQSATSPLHINKVGLTLSKHTICEFSPFFKKGVFDYSSHGTG

SEQ ID NO: 44230 - protein, 201 aa, Homo sapiens
  Payload ID: 9016
  Gene Symbol: KIF16B
  Gene Name: kinesin family member 16B
  ENSP ID: ENSP00000347995
RINAYIEEEVQRRLQDLHRVISEGCSTSADTMKDNEKLHNGTIQRKLKYERMVSRSLGANPDDLKDPIKISIPRYVLCGQGKDAHFEFEVKITVLDETWTVFRRYSRFREMHKTLKLKYAELAALEFPPKKLFGNKDERVIAERRSHLEKYLRDFFSVMLQSATSPLHINKVGLTLSKHTICEFSPFFKKGVFDYSSHGTG

SEQ ID NO: 44231 - protein, 1392 aa, Homo sapiens
  Payload ID: 9016
  Gene Symbol: KIF16B
  Gene Name: kinesin family member 16B
  Uniprot ID: Q96L93
  ENSP ID: ENSP00000384164
MASVKVAVRVRPMNRREKDLEAKFIIQMEKSKTTITNLKIPEGGTGDSGRERTKTFTYDFSFYSADTKSPDYVSQEMVFKTLGTDVVKSAFEGYNACVFAYGQTGSGKSYTMMGNSGDSGLIPRICEGLFSRINETTRWDEASFRTEVSYLEIYNERVRDLLRRKSSKTFNLRVREHPKEGPYVEDLSKHLVQNYGDVEELMDAGNINRTTAATGMNDVSSRSHAIFTIKFTQAKFDSEMPCETVSKIHLVDLAGSERADATGATGVRLKEGGNINKSLVTLGNVISALADLSQDAANTLAKKKQVFVPYRDSVLTWLLKDSLGGNSKTIMIATISPADVNYGETLSTLRYANRAKNIINKPTINEDANVKLIRELRAEIARLKTLLAQGNQIALLDSPTALSMEEKLQQNEARVQELTKEWTNKWNETQNILKEQTLALRKEGIGVVLDSELPHLIGIDDDLLSTGIILYHLKEGQTYVGRDDASTEQDIVLHGLDLESEHCIFENIGGTVTLIPLSGSQCSVNGVQIVEATHLNQGAVILLGRTNMFRFNHPKEAAKLREKRKSGLLSSFSLSMTDLSKSRENLSAVMLYNPGLEFERQQREELEKLESKRKLIEEMEEKQKSDKAELERMQQEVETQRKETEIVQLQIRKQEESLKRRSFHIENKLKDLLAEKEKFEEERLREQQEIELQKKRQEEETFLRVQEELQRLKELNNNEKAEKFQIFQELDQLQKEKDEQYAKLELEKKRLEEQEKEQVMLVAHLEEQLREKQEMIQLLRRGEVQWVEEEKRDLEGIRESLLRVKEARAGGDEDGEELEKAQLRFFEFKRRQLVKLVNLEKDLVQQKDILKKEVQEEQEILECLKCEHDKESRLLEKHDESVTDVTEVPQDFEKIKPVEYRLQYKERQLQYLLQNHLPTLLEEKQRAFEILDRGPLSLDNTLYQVEKEMEEKEEQLAQYQANANQLQKLQATFEFTANIARQEEKVRKKEKEILESREKQQREALERALARLERRHSALQRHSTLGMEIEEQRQKLASLNSGSREQSGLQASLEAEQEALEKDQERLEYEIQQLKQKIYEVDGVQKDHHGTLEGKVASSSLPVSAEKSHLVPLMDARINAYIEEEVQRRLQDLHRVISEGCSTSADTMKDNEKLHNGTIQRKLKYELCRDLLCVLMPEPDAAACANHPLLQQDLVQLSLDWKTEIPDLVLPNGVQVSSKFQTTLVDMIYFLHGNMEVNVPSLAEVQLLLYTTVKVMGDSGHDQCQSLVLLNTHIALVKEDCVFYPRIRSRNIPPPGAQFDVIKCHALSEFRCVVVPEKKNVSTVELVFLQKLKPSVGSRNSPPEHLQEAPNVQLFTTPLYLQGSQNVAPEVWKLTFNSQDEALWLISHLTRL

SEQ ID NO: 44232 - protein, 185 aa, Homo sapiens
  Payload ID: 9016
  Gene Symbol: KIF16B
  Gene Name: kinesin family member 16B
  ENSP ID: ENSP00000396264
  MOD_RES (1)..(1): Any amino acid
XDLSKSRENLSAVMLYNPGLFPIKGPICLRLEFERQQREELEKLESKRKLIEEMEEKQKSDKAELERMQQEVETQRKETEIVQLQIRKQEESLKRRSFHIENKLKDLLAEKEKFEEERLREQQEIELQKKRQEEETFLRVQEELQRLKELNNNEKAEKFQIFQELDQLQKEKDEQYAKLELEKKR

SEQ ID NO: 44233 - protein, 1029 aa, Homo sapiens
  Payload ID: 9017
  Gene Symbol: KIF17
  Gene Name: kinesin family member 17
  Uniprot ID: Q9P2E2
  ENSP ID: ENSP00000247986
MASEAVKVVVRCRPMNQRERELRCQPVVTVDCARAQCCIQNPGAADEPPKQFTFDGAYHVDHVTEQIYNEIAYPLVEGVTEGYNGTIFAYGQTGSGKSFTMQGLPDPPSQRGIIPRAFEHVFESVQCAENTKFLVRASYLEIYNEDVRDLLGADTKQKLELKEHPEKGVYVKGLSMHTVHSVAQCEHIMETGWKNRSVGYTLMNKDSSRSHSIFTISIEMSAVDERGKDHLRAGKLNLVDLAGSERQSKTGATGERLKEATKINLSLSALGNVISALVDGRCKHVPYRDSKLTRLLQDSLGGNTKTLMVACLSPADNNYDETLSTLRYANRAKNIRNKPRINEDPKDALLREYQEEIKKLKAILTQQMSPSSLSALLSRQVPPDPVQVEEKLLPQPVIQHDVEAEKQLIREEYEERLARLKADYKAEQESRARLEEDITAMRNSYDVRLSTLEENLRKETEAVLQVGVLYKAEVMSRAEFASSAEYPPAFQYETVVKPKVFSTTDTLPSDDVSKTQVSSRFAELPKVEPSKSEISLGSSESSSLEETSVSEAFPGPEEPSNVEVSMPTEESRSRYFLDECLGQEAAGHLLGEQNYLPQEEPQEVPLQGLLGLQDPFAEVEAKLARLSSTVARTDAPQADVPKVPVQVPAPTDLLEPSDARPEAEAADDFPPRPEVDLASEVALEVVRTAEPGVWLEAQAPVALVAQPEPLPATAGVKRESVGMEVAVLTDDPLPVVDQQQVLARLQLLEQQVVGGEQAKNKDLKEKHKRRKRYADERRKQLVAALQNSDEDSGDWVLLNVYDSIQEEVRAKSKLLEKMQRKLRAAEVEIKDLQSEFQLEKIDYLATIRRQERDSMLLQQLLEQVQPLIRRDCNYSNLEKILRESCWDEDNGFWKIPHPVITKTSLPVAVSTGPQNKPARKTSAADNGEPNMEDDRYRLMLSRSNSENIASNYFRSKRASQILSTDARKSLTHHNSPPGLSCPLSNNSAIPPTQAPEMPQPRPFRLESLDIPFTKAKRKKSKSNFGSEPL

SEQ ID NO: 44234 - protein, 929 aa, Homo sapiens
  Payload ID: 9017
  Gene Symbol: KIF17
  Gene Name: kinesin family member 17
  ENSP ID: ENSP00000364184
MQGLPDPPSQRGIIPRAFEHVFESVQCAENTKFLVRASYLEIYNEDVRDLLGADTKQKLELKEHPEKGVYVKGLSMHTVHSVAQCEHIMETGWKNRSVGYTLMNKDSSRSHSIFTISIEMSAVDERGKDHLRAGKLNLVDLAGSERQSKTGATGERLKEATKINLSLSALGNVISALVDGRCKHVPYRDSKLTRLLQDSLGGNTKTLMVACLSPADNNYDETLSTLRYANRAKNIRNKPRINEDPKDALLREYQEEIKKLKAILTQQMSPSSLSALLSRQVPPDPVQVEEKLLPQPVIQHDVEAEKQLIREEYEERLARLKADYKAEQESRARLEEDITAMRNSYDVRLSTLEENLRKETEAVLQVGVLYKAEVMSRAEFASSAEYPPAFQYETVVKPKVFSTTDTLPSDDVSKTQVSSRFAELPKVEPSKSEISLGSSESSSLEETSVSEAFPGPEEPSNVEVSMPTEESRSRYFLDECLGQEAAGHLLGEQNYLPQEEPQEVPLQGLLGLQDPFAEVEAKLARLSSTVARTDAPQADVPKVPVQVPAPTDLLEPSDARPEAEAADDFPPRPEVDLASEVALEVVRTAEPGVWLEAQAPVALVAQPEPLPATAGVKRESVGMEVAVLTDDPLPVVDQQQVLARLQLLEQQVVGGEQAKNKDLKEKHKRRKRYADERRKQLVAALQNSDEDSGDWVLLNVYDSIQEEVRAKSKLLEKMQRKLRAAEVEIKDLQSEFQLEKIDYLATIRRQERDSMLLQQLLEQVQPLIRRDCNYSNLEKILRESCWDEDNGFWKIPHPVITKTSLPVAVSTGPQNKPARKTSAADNGEPNMEDDRYRLMLSRSNSENIASNYFRSKRASQILSTDARKSLTHHNSPPGLSCPLSNNSAIPPTQAPEMPQPRPFRLESLDIPFTKAKRKKSKSNFGSEPL

SEQ ID NO: 44235 - protein, 1028 aa, Homo sapiens
  Payload ID: 9017
  Gene Symbol: KIF17
  Gene Name: kinesin family member 17
  Uniprot ID: Q9P2E2
  ENSP ID: ENSP00000383311
MASEAVKVVVRCRPMNQRERELRCQPVVTVDCARAQCCIQNPGAADEPPKQFTFDGAYHVDHVTEQIYNEIAYPLVEGVTEGYNGTIFAYGQTGSGKSFTMQGLPDPPSQRGIIPRAFEHVFESVQCAENTKFLVRASYLEIYNEDVRDLLGADTKQKLELKEHPEKGVYVKGLSMHTVHSVAQCEHIMETGWKNRSVGYTLMNKDSSRSHSIFTISIEMSAVDERGKDHLRAGKLNLVDLAGSERQSKTGATGERLKEATKINLSLSALGNVISALVDGRCKHVPYRDSKLTRLLQDSLGGNTKTLMVACLSPADNNYDETLSTLRYANRAKNIRNKPRINEDPKDALLREYQEEIKKLKAILTQQMSPSSLSALLSRQVPPDPVQVEEKLLPQPVIQHDVEAEKQLIREEYEERLARLKADYKAEQESRARLEEDITAMRNSYDVRLSTLEENLRKETEAVLQVGVLYKAEVMSRAEFASSAEYPPAFQYETVVKPKVFSTTDTLPSDDVSKTQVSSRFAELPKVEPSKSEISLGSSESSSLEETSVSEAFPGPEEPSNVEVSMPTEESRSRYFLDECLGQEAAGHLLGEQNYLPQEEPQEVPLQGLLGLQDPFAEVEAKLARLSSTVARTDAPQADVPKVPVQVPAPTDLLEPSDARPEAEAADDFPPRPEVDLASEVALEVVRTAEPGVWLEAQAPVALVAQPEPLPATAGVKRESVGMEVAVLTDDPLPVVDQQQVLARLQLLEQQVVGGEQAKNKDLKEKHKRRKRYADERRKQLVAALQNSDEDSGDWVLLNVYDSIQEEVRAKSKLLEKMQRKLRAAEVEIKDLQSEFQLEKIDYLATIRRQERDSMLLQQLLEQVQPLIRRDCNYSNLEKILRESCWDEDNGFWKIPHPVITKTSLPVVSTGPQNKPARKTSAADNGEPNMEDDRYRLMLSRSNSENIASNYFRSKRASQILSTDARKSLTHHNSPPGLSCPLSNNSAIPPTQAPEMPQPRPFRLESLDIPFTKAKRKKSKSNFGSEPL

SEQ ID NO: 44236 - protein, 898 aa, Homo sapiens
  Payload ID: 9018
  Gene Symbol: KIF18A
  Gene Name: kinesin family member 18A
  Uniprot ID: Q8NI77
  ENSP ID: ENSP00000263181
MSVTEEDLCHHMKVVVRVRPENTKEKAAGFHKVVHVVDKHILVFDPKQEEVSFFHGKKTTNQNVIKKQNKDLKFVFDAVFDETSTQSEVFEHTTKPILRSFLNGYNCTVLAYGATGAGKTHTMLGSADEPGVMYLTMLHLYKCMDEIKEEKICSTAVSYLEVYNEQIRDLLVNSGPLAVREDTQKGVVVHGLTLHQPKSSEEILHLLDNGNKNRTQHPTDMNATSSRSHAVFQIYLRQQDKTASINQNVRIAKMSLIDLAGSERASTSGAKGTRFVEGTNINRSLLALGNVINALADSKRKNQHIPYRNSKLTRLLKDSLGGNCQTIMIAAVSPSSVFYDDTYNTLKYANRAKDIKSSLKSNVLNVNNHITQYVKICNEQKAEILLLKEKLKAYEEQKAFTNENDQAKLMISNPQEKEIERFQEILNCLFQNREEIRQEYLKLEMLLKENELKSFYQQQCHKQIEMMCSEDKVEKATGKRDHRLAMLKTRRSYLEKRREEELKQFDENTNWLHRVEKEMGLLSQNGHIPKELKKDLHCHHLHLQNKDLKAQIRHMMDLACLQEQQHRQTEAVLNALLPTLRKQYCTLKEAGLSNAAFESDFKEIEHLVERKKVVVWADQTAEQPKQNDLPGISVLMTFPQLGPVQPIPCCSSSGGTNLVKIPTEKRTRRKLMPSPLKGQHTLKSPPSQSVQLNDSLSKELQPIVYTPEDCRKAFQNPSTVTLMKPSSFTTSFQAISSNINSDNCLKMLCEVAIPHNRRKECGQEDLDSTFTICEDIKSSKCKLPEQESLPNDNKDILQRLDPSSFSTKHSMPVPSMVPSYMAMTTAAKRKRKLTSSTSNSSLTADVNSGFAKRVRQDNSSEKHLQENKPTMEHKRNICKINPSMVRKFGRNISKGNLR

SEQ ID NO: 44237 - protein, 833 aa, Homo sapiens
  Payload ID: 9019
  Gene Symbol: KIF18B
  Gene Name: kinesin family member 18B
  ENSP ID: ENSP00000465377
MAVEDSTLQVVVRVRPPTPRELDSQRRPVVQVVDERVLVFNPEEPDGGFPGLKWGGTHDGPKKKGKDLTFVFDRVFGEAATQQDVFQHTTHSVLDSFLQGYNCSVFAYGATGAGKTHTMLGREGDPGIMYLTTVELYRRLEARQQEKHFEVLISYQEVYNEQIHDLLEPKGPLAIREDPDKGVVVQGLSFHQPASAEQLLEILTRGNRNRTQHPTDANATSSRSHAIFQIFVKQQDRVPGLTQAVQVAKMSLIDLAGSERASSTHAKGERLREGANINRSLLALINVLNALADAKGRKTHVPYRDSKLTRLLKDSLGGNCRTVMIAAISPSSLTYEDTYNTLKYADRAKEIRLSLKSNVTSLDCHISQYATICQQLQAEVAALRKKLQVYEGGGQPPPQDLPGSPKSGPPPEHLPSSPLPPHPPSQPCTPELPAGPRALQEESLGMEAQVERAMEGNSSDQEQSPEDEDEGPAEEVPTQMPEQNPTHALPESPRLTLQPKPVVGHFSARELDGDRSKQLALKVLCVAQRQYSLLQAANLLTPDMITEFETLQQLVQEEKIEPGAEALRTSGLARGAPLAQELCSESIPVPSPLCPEPPGYTGPVTRTMARRLSGPLHTLGIPPGPNCTPAQGSRWPMEKKRRRPSALEADSPMAPKRGTKRQRQSFLPCLRRGSLPDTQPSQGPSTPKGERASSPCHSPRVCPATVIKSRVPLGPSAMQNCSTPLALPTRDLNATFDLSEEPPSKPSFHECIGWDKIPQELSRLDQPFIPRAPVPLFTMKGPKPTSSLPGTSACKKKRVASSSVSHGRSRIARLPSSTLKRPAGPLVLPGDWH

SEQ ID NO: 44238 - protein, 842 aa, Homo sapiens
  Payload ID: 9019
  Gene Symbol: KIF18B
  Gene Name: kinesin family member 18B
  Uniprot ID: Q86Y91
  ENSP ID: ENSP00000465501
MSHPGVTTVMAVEDSTLQVVVRVRPPTPRELDSQRRPVVQVVDERVLVFNPEEPDGGFPGLKWGGTHDGPKKKGKDLTFVFDRVFGEAATQQDVFQHTTHSVLDSFLQGYNCSVFAYGATGAGKTHTMLGREGDPGIMYLTTVELYRRLEARQQEKHFEVLISYQEVYNEQIHDLLEPKGPLAIREDPDKGVVVQGLSFHQPASAEQLLEILTRGNRNRTQHPTDANATSSRSHAIFQIFVKQQDRVPGLTQAVQVAKMSLIDLAGSERASSTHAKGERLREGANINRSLLALINVLNALADAKGRKTHVPYRDSKLTRLLKDSLGGNCRTVMIAAISPSSLTYEDTYNTLKYADRAKEIRLSLKSNVTSLDCHISQYATICQQLQAEVAALRKKLQVYEGGGQPPPQDLPGSPKSGPPPEHLPSSPLPPHPPSQPCTPELPAGPRALQEESLGMEAQVERAMEGNSSDQEQSPEDEDEGPAEEVPTQMPEQNPTHALPESPRLTLQPKPVVGHFSARELDGDRSKQLALKVLCVAQRQYSLLQAANLLTPDMITEFETLQQLVQEEKIEPGAEALRTSGLARGAPLAQELCSESIPVPSPLCPEPPGYTGPVTRTMARRLSGPLHTLGIPPGPNCTPAQGSRWPMEKKRRRPSALEADSPMAPKRGTKRQRQSFLPCLRRGSLPDTQPSQGPSTPKGERASSPCHSPRVCPATVIKSRVPLGPSAMQNCSTPLALPTRDLNATFDLSEEPPSKPSFHECIGWDKIPQELSRLDQPFIPRAPVPLFTMKGPKPTSSLPGTSACKKKRVASSSVSHGRSRIARLPSSTLKRPAGPLVLPGDWH

SEQ ID NO: 44239 - protein, 852 aa, Homo sapiens
  Payload ID: 9019
  Gene Symbol: KIF18B
  Gene Name: kinesin family member 18B
  ENSP ID: ENSP00000465992
MAVEDSTLQVVVRVRPPTPRELDSQRRPVVQVVDERVLVFNPEEPDGGFPGLKWGGTHDGPKKKGKDLTFVFDRVFGEAATQQDVFQHTTHSVLDSFLQGYNCSVFAYGATGAGKTHTMLGREGDPGIMYLTTVELYRRLEARQQEKHFEVLISYQEVYNEQIHDLLEPKGPLAIREDPDKGVVVQGLSFHQPASAEQLLEILTRGNRNRTQHPTDANATSSRSHAIFQIFVKQQDRVPGLTQAVQVAKMSLIDLAGSERASSTHAKGERLREGANINRSLLALINVLNALADAKGRKTHVPYRDSKLTRLLKDSLGGNCRTVMIAAISPSSLTYEDTYNTLKYADRAKEIRLSLKSNVTSLDCHISQYATICQQLQAEVAALRKKLQVYEGGGQPPPQDLPGSPKSGPPPEHQPCTPELPAGPRALQEESLGMEAQVERAMEGNSSDQEQSPEDEDEGPAEEVPTQMPEQNPTHALPESPRLTLQPKPVVGHFSARELDGDRSKQLALKVLCVAQRQYSLLQAANLLTPDMITEFETLQQLVQEEKIEPGAEALRTSGLARGAPLAQELCSESIPVPSPLCPEPPGYTGPVTRTMARRLSGPLHTLGIPPGPNCTPAQGSRWPMEKKRRRPSALEADSPMAPKRGTKRQRQSFLPCLRRGSLPDTQPSQGPSTPKGERASSPCHSPRVCPATVIKSRVPLGPSAMQNCSTPLALPTRDLNATFDLSEEPPSKPSFHECIGWDKIPQELSRLDQPFIPRAPVPLFTMKGPKPTSSLPGTSACKKKRVASSSVSHGRSRIARLPSSTLKRPAGPLVLPELPLSPLCPSNRRNGKDLIRVGRALSAGNGVTKVS

SEQ ID NO: 44240 - protein, 998 aa, Homo sapiens
  Payload ID: 9020
  Gene Symbol: KIF19
  Gene Name: kinesin family member 19
  Uniprot ID: Q2TAC6
  ENSP ID: ENSP00000374566
MKDSGDSKDQQLMVALRVRPISVAELEEGATLIAHKVDEQMVVLMDPMEDPDDILRAHRSREKSYLFDVAFDFTATQEMVYQATTKSLIEGVISGYNATVFAYGPTGCGKTYTMLGTDQEPGIYVQTLNDLFRAIEETSNDMEYEVSMSYLEIYNEMIRDLLNPSLGYLELREDSKGVIQVAGITEVSTINAKEIMQLLMKGNRQRTQEPTAANQTSSRSHAVLQVTVRQRSRVKNILQEVRQGRLFMIDLAGSERASQTQNRGQRMKEGAHINRSLLALGNCINALSDKGSNKYINYRDSKLTRLLKDSLGGNSRTVMIAHISPASSAFEESRNTLTYAGRAKNIKTRVKQNLLNVSYHIAQYTSIIADLRGEIQRLKRKIDEQTGRGQARGRQDRGDIRHIQAEVQLHSGQGEKAGMGQLREQLASAFQEQMDVRRRLLELENRAMEVQIDTSRHLLTIAGWKHEKSRRALKWREEQRKECYAKDDSEKDSDTGDDQPDILEPPEVAAARESIAALVDEQKQLRKQKLALEQRCRELRARGRRLEETLPRRIGSEEQREVLSLLCRVHELEVENTEMQSHALLRDGALRHRHEAVRRLEQHRSLCDEIIQGQRQIIDDYNLAVPQRLEELYEVYLRELEEGSLEQATIMDQVASRALQDSSLPKITPAGTSLTPDSDLESVKTLSSDAQHLQNSALPPLSTESEGHHVFKAGTGAWQAKSSSVPTPPPIQLGSLVTQEAPAQDSLGSWINSSPDSSENLSEIPLSHKERKEILTGTKCIWVKAARRRSRALGTEGRHLLAPATERSSLSLHSLSEGDDARPPGPLACKRPPSPTLQHAASEDNLSSSTGEAPSRAVGHHGDGPRPWLRGQKKSLGKKREESLEAKRRKRRSRSFEVTGQGLSHPKTHLLGPHQAERISDHRMPVCRHPAPGIRHLGKVTLPLAKVKLPPSQNTGPGDSSPLAVPPNPGGGSRRATRGPRLPHGTSTHGKDGCSRHN

SEQ ID NO: 44241 - protein, 613 aa, Homo sapiens
  Payload ID: 9020
  Gene Symbol: KIF19
  Gene Name: kinesin family member 19
  ENSP ID: ENSP00000449134
MKDSGDSKDQQLMVALRVRPISVAELEEGATLIAHKVDEQMVVLMDPMEDPDDILRAHRSREKSYLFDVAFDFTATQEMVYQATTKSLIEGVISGYNATVFAYGPTGCGKTYTMLGTDQEPGIYVQTLNDLFRAIEETSNDMEYEVSMSYLEIMQLLMKGNRQRTQEPTAANQTSSRSHAVLQVTVRQRSRVKNILQEVRQGRLFMIDLAGSERASQTQNRGQRMKEGAHINRSLLALGNCINALSDKGSNKYINYRDSKLTRLLKDSLGGNSRTVMIAHISPASSAFEESRNTLTYAGRAKNIKTRVKQNLLNVSYHIAQYTSIIADLRGEIQRLKRKIDEQTGRGQARGRQDRGDIRHIQAEVQLHSGQGEKAGMGQLREQLASAFQEQMDVRRRLLELENRAMEVQIDTSRHLLTIAGWKHEKSRRALKWREEQRKECYAKDDSEKDSDTGDDQPDILEPPEVAAARESIAALVDEQKQLRKQKLALEQRCRELRARGRRLEETLPRRIGSEEQREVLSLLCRVHELEVENTEMQSHALLRDGALRHRHEAVRRLEQHRSLCDEIIQGQRQIIDDYNLAVPQRLEELYEVYLRELEEGSLEQATIMDQVA

SEQ ID NO: 44242 - protein, 1690 aa, Homo sapiens
  Payload ID: 9021
  Gene Symbol: KIF1A
  Gene Name: kinesin family member 1A
  Uniprot ID: Q12756
  ENSP ID: ENSP00000322791
MAGASVKVAVRVRPFNSREMSRDSKCIIQMSGSTTTIVNPKQPKETPKSFSFDYSYWSHTSPEDINYASQKQVYRDIGEEMLQHAFEGYNVCIFAYGQTGAGKSYTMMGKQEKDQQGIIPQLCEDLFSRINDTTNDNMSYSVEVSYMEIYCERVRDLLNPKNKGNLRVREHPLLGPYVEDLSKLAVTSYNDIQDLMDSGNKARTVAATNMNETSSRSHAVFNIIFTQKRHDAETNITTEKVSKISLVDLAGSERADSTGAKGTRLKEGANINKSLTTLGKVISALAEMDSGPNKNKKKKKTDFIPYRDSVLTWLLRENLGGNSRTAMVAALSPADINYDETLSTLRYADRAKQIRCNAVINEDPNNKLIRELKDEVTRLRDLLYAQGLGDITDMTNALVGMSPSSSLSALSSRAASVSSLHERILFAPGSEEAIERLKETEKIIAELNETWEEKLRRTEAIRMEREALLAEMGVAMREDGGTLGVFSPKKTPHLVNLNEDPLMSECLLYYIKDGITRVGREDGERRQDIVLSGHFIKEEHCVFRSDSRGGSEAVVTLEPCEGADTYVNGKKVTEPSILRSGNRIIMGKSHVFRFNHPEQARQERERTPCAETPAEPVDWAFAQRELLEKQGIDMKQEMEQRLQELEDQYRREREEATYLLEQQRLDYESKLEALQKQMDSRYYPEVNEEEEEPEDEVQWTERECELALWAFRKWKWYQFTSLRDLLWGNAIFLKEANAISVELKKKVQFQFVLLTDTLYSPLPPDLLPPEAAKDRETRPFPRTIVAVEVQDQKNGATHYWTLEKLRQRLDLMREMYDRAAEVPSSVIEDCDNVVTGGDPFYDRFPWFRLVGRAFVYLSNLLYPVPLVHRVAIVSEKGEVKGFLRVAVQAISADEEAPDYGSGVRQSGTAKISFDDQHFEKFQSESCPVVGMSRSGTSQEELRIVEGQGQGADVGPSADEVNNNTCSAVPPEGLLLDSSEKAALDGPLDAALDHLRLGNTFTFRVTVLQASSISAEYADIFCQFNFIHRHDEAFSTEPLKNTGRGPPLGFYHVQNIAVEVTKSFIEYIKSQPIVFEVFGHYQQHPFPPLCKDVLSPLRPSRRHFPRVMPLSKPVPATKLSTLTRPCPGPCHCKYDLLVYFEICELEANGDYIPAVVDHRGGMPCMGTFLLHQGIQRRITVTLLHETGSHIRWKEVRELVVGRIRNTPETDESLIDPNILSLNILSSGYIHPAQDDRTFYQFEAAWDSSMHNSLLLNRVTPYREKIYMTLSAYIEMENCTQPAVVTKDFCMVFYSRDAKLPASRSIRNLFGSGSLRASESNRVTGVYELSLCHVADAGSPGMQRRRRRVLDTSVAYVRGEENLAGWRPRSDSLILDHQWELEKLSLLQEVEKTRHYLLLREKLETAQRPVPEALSPAFSEDSESHGSSSASSPLSAEGRPSPLEAPNERQRELAVKCLRLLTHTFNREYTHSHVCVSASESKLSEMSVTLLRDPSMSPLGVATLTPSSTCPSLVEGRYGATDLRTPQPCSRPASPEPELLPEADSKKLPSPARATETDKEPQRLLVPDIQEIRVSPIVSKKGYLHFLEPHTSGWARRFVVVRRPYAYMYNSDKDTVERFVLNLATAQVEYSEDQQAMLKTPNTFAVCTEHRGILLQAASDKDMHDWLYAFNPLLAGTIRSKLSRRRSAQMRV

SEQ ID NO: 44243 - protein, 1471 aa, Homo sapiens
  Payload ID: 9021
  Gene Symbol: KIF1A
  Gene Name: kinesin family member 1A
  ENSP ID: ENSP00000384231
MAGASVKVAVRVRPFNSREMSRDSKCIIQMSGSTTTIVNPKQPKETPKSFSFDYSYWSHTSPEDINYASQKQVYRDIGEEMLQHAFEGYNVCIFAYGQTGAGKSYTMMGKQEKDQQGIIPQLCEDLFSRINDTTNDNMSYSVEVSYMEIYCERVRDLLNPKNKGNLRVREHPLLGPYVEDLSKLAVTSYNDIQDLMDSGNKARTVAATNMNETSSRSHAVFNIIFTQKRHDAETNITTEKVSKISLVDLAGSERADSTGAKGTRLKEGANINKSLTTLGKVISALAEMDSGPNKNKKKKKTDFIPYRDSVLTWLLRENLGGNSRTAMVAALSPADINYDETLSTLRYADRAKQIRCNAVINEDPNNKLIRELKDEVTRLRDLLYAQGLGDITDTNTVPGGPKLTNALVGMSPSSSLSALSSRAASVSSLHERILFAPGSEEAIERLKETEKIIAELNETWEEKLRRTEAIRMEREALLAEMGVAMREDGGTLGVFSPKKTPHLVNLNEDPLMSECLLYYIKDGITRVGREDGERRQDIVLSGHFIKEEHCVFRSDSRGGSEAVVTLEPCEGADTYVNGKKVTEPSILRSGNRIIMGKSHVFRFNHPEQARQERERTPCAETPAEPVDWAFAQRELLEKQGIDMKQEMEQRLQELEDQYRREREEATYLLEQQRLDYESKLEALQKQMDSRYYPEVNEEEEEPEDEVQWTERECELALWAFRKWKWYQFTSLRDLLWGNAIFLKEANAISVELKKKVQFQFVLLTDTLYSPLPPDLLPPEAAKDRETRPFPRTIVAVEVQDQKNGATHYWTLEKLRQRLDLMREMYDRAAEVPSSVIEDCDNVVTGGDPFYDRFPWFRLVGSSAISGCNSYPLLNTCMSERMAALTPSPTFSSPDSDATEPAEEQSVGEEEEEEEEEEDEEEEDLEDDVFPEHALCDGRDPFYDRPPLFSLVGRAFVYLSNLLYPVPLVHRVAIVSEKGEVKGFLRVAVQAISADEEAPDYGSGVRQSGTAKISFDDQHFEKFQSESCPVVGMSRSGTSQEELRIVEGQGQGADVGPSADEVNNNTCSAVPPEGLLLDSSEKAALDGPLDAALDHLRLGNTFTFRVTVLQASSISAEYADIFCQFNFIHRHDEAFSTEPLKNTGRGPPLGFYHVQNIAVEVTKSFIEYIKSQPIVFEVFGHYQQHPFPPLCKDVLSPLRPSRRHFPRVMPLSKPVPATKLSTLTRPCPGPCHCKYDLLVYFEICELEANGDYIPAVVDHRGGMPCMGTFLLHQGIQRRITVTLLHETGSHIRWKEVRELVVGRIRNTPETDESLIDPNILSLNILSSGYIHPAQDDRVSLGNDTRTFYQFEAAWDSSMHNSLLLNRVTPYREKIYMTLSAYIEMENCTQPAVVTKDFCMVFYSRDAKLPASRSIRNLFGSGSLRASESNRVTGVYELSLCHVADAGSPGMQRRRRRVLDTSVAYVRGEENLA

SEQ ID NO: 44244 - protein, 227 aa, Homo sapiens
  Payload ID: 9021
  Gene Symbol: KIF1A
  Gene Name: kinesin family member 1A
  ENSP ID: ENSP00000395443
  MOD_RES (1)..(1): Any amino acid
XDLMDSGNKARTVAATNMNETSSRSHAVFNIIFTQKRHDAETNITTEKVSKISLVDLAGSERADSTGAKGTRLKEGANINKSLTTLGKVISALAEMDSGPNKNKKKKKTDFIPYRDSVLTWLLRENLGGNSRTAMVAALSPADINYDETLSTLRYADRAKQIRCNAVINEDPNNKLIRELKDEVTRLRDLLYAQGLGDITDTNTVPGGPKYVSDLENNNLNRGGTVN

SEQ ID NO: 44245 - protein, 38 aa, Homo sapiens
  Payload ID: 9021
  Gene Symbol: KIF1A
  Gene Name: kinesin family member 1A
  ENSP ID: ENSP00000398686
MAGASVKVAVRVRPFNSREMSRDSKCIIQMSGSTTTIV

SEQ ID NO: 44246 - protein, 357 aa, Homo sapiens
  Payload ID: 9021
  Gene Symbol: KIF1A
  Gene Name: kinesin family member 1A
  ENSP ID: ENSP00000414613
  MOD_RES (1)..(1): Any amino acid
XGHYQQHPFPPLCKDVLSPLRPSRRHFPRVMPLSKPVPATKLSTLTRPCPGPCHCKYDLLVYFEICELEANGDYIPAVVDHRGGMPCMGTFLLHQGIQRRITVTLLHETGSHIRWKEVRELVVGRIRNTPETDESLIDPNILSLNILSSGYIHPAQDDRQFLDSDIPRTFYQFEAAWDSSMHNSLLLNRVTPYREKIYMTLSAYIEMENCTQPAVVTKDFCMVFYSRDAKLPASRSIRNLFGSGSLRASESNRVTGVYELSLCHVADAGSPGMQRRRRRVLDTSVAYVRGEENLAGWRPRSDSLILDHQWELEKLSLLQEVEKTRHYLLLREKLETAQRPVPEALSPAFSEDSESHG

SEQ ID NO: 44247 - protein, 183 aa, Homo sapiens
  Payload ID: 9021
  Gene Symbol: KIF1A
  Gene Name: kinesin family member 1A
  ENSP ID: ENSP00000415367
  MOD_RES (1)..(1): Any amino acid
XLGSEGEHQGRAPALLLEADEEAPDYGSGVRQSGTAKISFDDQHFEKFQSESCPVVGMSRSGTSQEELRIVEGQGQGADVGPSADEVNNNTCSAVPPEGLLLDSSEKAALDGPLDAALDHLRLGNTFTFRVTVLQASSISAEYADIFCQFNFIHRHDEAFSTEPLKNTGRGPPLGFYHVQNIA

SEQ ID NO: 44248 - protein, 1791 aa, Homo sapiens
  Payload ID: 9021
  Gene Symbol: KIF1A
  Gene Name: kinesin family member 1A
  Uniprot ID: Q12756
  ENSP ID: ENSP00000438388
MAGASVKVAVRVRPFNSREMSRDSKCIIQMSGSTTTIVNPKQPKETPKSFSFDYSYWSHTSPEDINYASQKQVYRDIGEEMLQHAFEGYNVCIFAYGQTGAGKSYTMMGKQEKDQQGIIPQLCEDLFSRINDTTNDNMSYSVEVSYMEIYCERVRDLLNPKNKGNLRVREHPLLGPYVEDLSKLAVTSYNDIQDLMDSGNKARTVAATNMNETSSRSHAVFNIIFTQKRHDAETNITTEKVSKISLVDLAGSERADSTGAKGTRLKEGANINKSLTTLGKVISALAEMDSGPNKNKKKKKTDFIPYRDSVLTWLLRENLGGNSRTAMVAALSPADINYDETLSTLRYADRAKQIRCNAVINEDPNNKLIRELKDEVTRLRDLLYAQGLGDITDTNTVPGGPKLTNALVGMSPSSSLSALSSRAASVSSLHERILFAPGSEEAIERLKETEKIIAELNETWEEKLRRTEAIRMEREALLAEMGVAMREDGGTLGVFSPKKTPHLVNLNEDPLMSECLLYYIKDGITRVGREDGERRQDIVLSGHFIKEEHCVFRSDSRGGSEAVVTLEPCEGADTYVNGKKVTEPSILRSGNRIIMGKSHVFRFNHPEQARQERERTPCAETPAEPVDWAFAQRELLEKQGIDMKQEMEQRLQELEDQYRREREEATYLLEQQRLDYESKLEALQKQMDSRYYPEVNEEEEEPEDEVQWTERECELALWAFRKWKWYQFTSLRDLLWGNAIFLKEANAISVELKKKVQFQFVLLTDTLYSPLPPDLLPPEAAKDRETRPFPRTIVAVEVQDQKNGATHYWTLEKLRQRLDLMREMYDRAAEVPSSVIEDCDNVVTGGDPFYDRFPWFRLVGSSAISGCNSYPLLNTCMSERMAALTPSPTFSSPDSDATEPAEEQSVGEEEEEEEEEEDEEEEDLEDDVFPEHALCDGRDPFYDRPPLFSLVGRAFVYLSNLLYPVPLVHRVAIVSEKGEVKGFLRVAVQAISADEEAPDYGSGVRQSGTAKISFDDQHFEKFQSESCPVVGMSRSGTSQEELRIVEGQGQGADVGPSADEVNNNTCSAVPPEGLLLDSSEKAALDGPLDAALDHLRLGNTFTFRVTVLQASSISAEYADIFCQFNFIHRHDEAFSTEPLKNTGRGPPLGFYHVQNIAVEVTKSFIEYIKSQPIVFEVFGHYQQHPFPPLCKDVLSPLRPSRRHFPRVMPLSKPVPATKLSTLTRPCPGPCHCKYDLLVYFEICELEANGDYIPAVVDHRGGMPCMGTFLLHQGIQRRITVTLLHETGSHIRWKEVRELVVGRIRNTPETDESLIDPNILSLNILSSGYIHPAQDDRTFYQFEAAWDSSMHNSLLLNRVTPYREKIYMTLSAYIEMENCTQPAVVTKDFCMVFYSRDAKLPASRSIRNLFGSGSLRASESNRVTGVYELSLCHVADAGSPGMQRRRRRVLDTSVAYVRGEENLAGWRPRSDSLILDHQWELEKLSLLQEVEKTRHYLLLREKLETAQRPVPEALSPAFSEDSESHGSSSASSPLSAEGRPSPLEAPNERQRELAVKCLRLLTHTFNREYTHSHVCVSASESKLSEMSVTLLRDPSMSPLGVATLTPSSTCPSLVEGRYGATDLRTPQPCSRPASPEPELLPEADSKKLPSPARATETDKEPQRLLVPDIQEIRVSPIVSKKGYLHFLEPHTSGWARRFVVVRRPYAYMYNSDKDTVERFVLNLATAQVEYSEDQQAMLKTPNTFAVCTEHRGILLQAASDKDMHDWLYAFNPLLAGTIRSKLSRRRSAQMRV

SEQ ID NO: 44249 - protein, 1770 aa, Homo sapiens
  Payload ID: 9022
  Gene Symbol: KIF1B
  Gene Name: kinesin family member 1B
  Uniprot ID: O60333
  ENSP ID: ENSP00000263934
MSGASVKVAVRVRPFNSRETSKESKCIIQMQGNSTSIINPKNPKEAPKSFSFDYSYWSHTSPEDPCFASQNRVYNDIGKEMLLHAFEGYNVCIFAYGQTGAGKSYTMMGKQEESQAGIIPQLCEELFEKINDNCNEEMSYSVEVSYMEIYCERVRDLLNPKNKGNLRVREHPLLGPYVEDLSKLAVTSYTDIADLMDAGNKARTVAATNMNETSSRSHAVFTIVFTQKKHDNETNLSTEKVSKISLVDLAGSERADSTGAKGTRLKEGANINKSLTTLGKVISALAEVSKKKKKTDFIPYRDSVLTWLLRENLGGNSRTAMVAALSPADINYDETLSTLRYADRAKQIKCNAVINEDPNAKLVRELKEEVTRLKDLLRAQGLGDIIDTSMGSLTSSPSSCSLSSQVGLTSVTSIQERIMSTPGGEEAIERLKESEKIIAELNETWEEKLRKTEAIRMEREALLAEMGVAIREDGGTLGVFSPKKTPHLVNLNEDPLMSECLLYYIKDGITRVGQADAERRQDIVLSGAHIKEEHCIFRSERSNSGEVIVTLEPCERSETYVNGKRVSQPVQLRSGNRIIMGKNHVFRFNHPEQARAEREKTPSAETPSEPVDWTFAQRELLEKQGIDMKQEMEKRLQEMEILYKKEKEEADLLLEQQRLDYESKLQALQKQVETRSLAAETTEEEEEEEEVPWTQHEFELAQWAFRKWKSHQFTSLRDLLWGNAVYLKEANAISVELKKKVQFQFVLLTDTLYSPLPPELLPTEMEKTHEDRPFPRTVVAVEVQDLKNGATHYWSLEKLKQRLDLMREMYDRAGEMASSAQDESETTVTGSDPFYDRFHWFKLVGSSPIFHGCVNERLADRTPSPTFSTADSDITELADEQQDEMEDFDDEAFVDDAGSDAGTEEGSDLFSDGHDPFYDRSPWFILVGRAFVYLSNLLYPVPLIHRVAIVSEKGEVRGFLRVAVQAIAADEEAPDYGSGIRQSGTAKISFDNEYFNQSDFSSVAMTRSGLSLEELRIVEGQGQSSEVITPPEEISRINDLDLKSSTLLDGKMVMEGFSEEIGNHLKLGSAFTFRVTVLQASGILPEYADIFCQFNFLHRHDEAFSTEPLKNNGRGSPLAFYHVQNIAVEITESFVDYIKTKPIVFEVFGHYQQHPLHLQGQELNSPPQPCRRFFPPPMPLSKPVPATKLNTMSKTSLGQSMSKYDLLVWFEISELEPTGEYIPAVVDHTAGLPCQGTFLLHQGIQRRITVTIIHEKGSELHWKDVRELVVGRIRNKPEVDEAAVDAILSLNIISAKYLKSSHNSSRTFYRFEAVWDSSLHNSLLLNRVTPYGEKIYMTLSAYLELDHCIQPAVITKDVCMVFYSRDAKISPPRSLRSLFGSGYSKSPDSNRVTGIYELSLCKMSDTGSPGMQRRRRKILDTSVAYVRGEENLAGWRPRGDSLILEHQWELEKLELLHEVEKTRHFLLLRERLGDSIPKSLSDSLSPSLSSGTLSTSTSISSQISTTTFESAITPSESSGYDSGDIESLVDREKELATKCLQLLTHTFNREFSQVHGSVSDCKLSDISPIGRDPSESSFSSATLTPSSTCPSLVDSRSNSLDQKTPEANSRASSPCPEFEQFQIVPAVETPYLARAGKNEFLNLVPDIEEIRPSSVVSKKGYLHFKEPLYSNWAKHFVVVRRPYVFIYNSDKDPVERGIINLSTAQVEYSEDQQAMVKTPNTFAVCTKHRGVLLQALNDKDMNDWLYAFNPLLAGTIRSKLSRRCPSQSKY

SEQ ID NO: 44250 - protein, 1823 aa, Homo sapiens
  Payload ID: 9022
  Gene Symbol: KIF1B
  Gene Name: kinesin family member 1B
  Uniprot ID: O60333
  ENSP ID: ENSP00000366284
MSGASVKVAVRVRPFNSRETSKESKCIIQMQGNSTSIINPKNPKEAPKSFSFDYSYWSHTSPEDPCFASQNRVYNDIGKEMLLHAFEGYNVCIFAYGQTGAGKSYTMMGKQEESQAGIIPQLCEELFEKINDNCNEEMSYSVEVSYMEIYCERVRDLLNPKNKGNLRVREHPLLGPYVEDLSKLAVTSYTDIADLMDAGNKARTVAATNMNETSSRSHAVFTIVFTQKKHDNETNLSTEKVSKISLVDLAGSERADSTGAKGTRLKEGANINKSLTTLGKVISALAEVDNCTSKSKKKKKTDFIPYRDSVLTWLLRENLGGNSRTAMVAALSPADINYDETLSTLRYADRAKQIKCNAVINEDPNAKLVRELKEEVTRLKDLLRAQGLGDIIDIDPLIDDYSGSGSKYLKDFQNNKHRYLLASENQRPGHFSTASMGSLTSSPSSCSLSSQVGLTSVTSIQERIMSTPGGEEAIERLKESEKIIAELNETWEEKLRKTEAIRMEREALLAEMGVAIREDGGTLGVFSPKKTPHLVNLNEDPLMSECLLYYIKDGITRVGQADAERRQDIVLSGAHIKEEHCIFRSERSNSGEVIVTLEPCERSETYVNGKRVSQPVQLRSGNRIIMGKNHVFRFNHPEQARAEREKTPSAETPSEPVDWTFAQRELLEKQGIDMKQEMEKRLQEMEILYKKEKEEADLLLEQQRLDYESKLQALQKQVETRSLAAETTEEEEEEEEVPWTQHEFELAQWAFRKWKSHQFTSLRDLLWGNAVYLKEANAISVELKKKVQFQFVLLTDTLYSPLPPELLPTEMEKTHEDRPFPRTVVAVEVQDLKNGATHYWSLEKLKQRLDLMREMYDRAGEMASSAQDESETTVTGSDPFYDRFHWFKLVGSSPIFHGCVNERLADRTPSPTFSTADSDITELADEQQDEMEDFDDEAFVDDAGSDAGTEEGSDLFSDGHDPFYDRSPWFILVGRAFVYLSNLLYPVPLIHRVAIVSEKGEVRGFLRVAVQAIAADEEAPDYGSGIRQSGTAKISFDNEYFNQSDFSSVAMTRSGLSLEELRIVEGQGQSSEVITPPEEISRINDLDLKSSTLLDGKMVMEGFSEEIGNHLKLGSAFTFRVTVLQASGILPEYADIFCQFNFLHRHDEAFSTEPLKNNGRGSPLAFYHVQNIAVEITESFVDYIKTKPIVFEVFGHYQQHPLHLQGQELNSPPQPCRRFFPPPMPLSKPVPATKLNTMSKTSLGQSMSKYDLLVWFEISELEPTGEYIPAVVDHTAGLPCQGTFLLHQGIQRRITVTIIHEKGSELHWKDVRELVVGRIRNKPEVDEAAVDAILSLNIISAKYLKSSHNSSRTFYRFEAVWDSSLHNSLLLNRVTPYGEKIYMTLSAYLELDHCIQPAVITKDVCMVFYSRDAKISPPRSLRSLFGSGYSKSPDSNRVTGIYELSLCKMSDTGSPGMQRRRRKILDTSVAYVRGEENLAGWRPRGDSLILEHQWELEKLELLHEVEKTRHFLLLRERLGDSIPKSLSDSLSPSLSSGTLSTSTSISSQISTTTFESAITPSESSGYDSGDIESLVDREKELATKCLQLLTHTFNREFSQVHGSVSDCKLSDISPIGRDPSESSFSSATLTPSSTCPSLVDSRSNSLDQKTPEANSRASSPCPEFEQFQIVPAVETPYLARAGKNEFLNLVPDIEEIRPSSVVSKKGYLHFKEPLYSNWAKHFVVVRRPYVFIYNSDKDPVERGIINLSTAQVEYSEDQQAMVKTPNTFAVCTKHRGVLLQALNDKDMNDWLYAFNPLLAGTIRPGHLASEIIREDKSVSFSCQ

SEQ ID NO: 44251 - protein, 1153 aa, Homo sapiens
  Payload ID: 9022
  Gene Symbol: KIF1B
  Gene Name: kinesin family member 1B
  Uniprot ID: O60333
  ENSP ID: ENSP00000366287
MSGASVKVAVRVRPFNSRETSKESKCIIQMQGNSTSIINPKNPKEAPKSFSFDYSYWSHTSPEDPCFASQNRVYNDIGKEMLLHAFEGYNVCIFAYGQTGAGKSYTMMGKQEESQAGIIPQLCEELFEKINDNCNEEMSYSVEVSYMEIYCERVRDLLNPKNKGNLRVREHPLLGPYVEDLSKLAVTSYTDIADLMDAGNKARTVAATNMNETSSRSHAVFTIVFTQKKHDNETNLSTEKVSKISLVDLAGSERADSTGAKGTRLKEGANINKSLTTLGKVISALAEVSKKKKKTDFIPYRDSVLTWLLRENLGGNSRTAMVAALSPADINYDETLSTLRYADRAKQIKCNAVINEDPNAKLVRELKEEVTRLKDLLRAQGLGDIIDTSMGSLTSSPSSCSLSSQVGLTSVTSIQERIMSTPGGEEAIERLKESEKIIAELNETWEEKLRKTEAIRMEREALLAEMGVAIREDGGTLGVFSPKKTPHLVNLNEDPLMSECLLYYIKDGITRVGQADAERRQDIVLSGAHIKEEHCIFRSERSNSGEVIVTLEPCERSETYVNGKRVSQPVQLRSGNRIIMGKNHVFRFNHPEQARAEREKTPSAETPSEPVDWTFAQRELLEKQGIDMKQEMEKRLQEMEILYKKEKEEADLLLEQQRLDADSDSGDDSDKRSCEESWKLITSLREKLPPSKLQTIVKKCGLPSSGKKREPIKMYQIPQRRRLSKDSKWVTISDLKIQAVKEICYEVALNDFRHSRQEIEALAIVKMKELCAMYGKKDPNERDSWRAVARDVWDTVGVGDEKIEDVMATGKGSTDVDDLKVHIDKLEDILQEVKKQNNMKDEEIKVLRNKMLKMEKVLPLIGSQEQKSPGSHKAKEPVGAGVSSTSENNVSKGDNGELAKEERVSQLMNGDPAFRRGRLRWMRQEQIRFKNLQQQEITKQLRRQNVPHRFIPPENRKPRFPFKSNPKHRNSWSPGTHIIITEDEVIELRIPKDDEARKGNKEESQEKGGKGAFKDPQFPWGSQGMRSQDHIQVSKQHINNQQQPPQLRWRSNSLNNGQPKSTRCQASASAESLNSHSGHPTADVQTFQAKRHIHQHRQSYCNYNTGGQLEGNAATSYQKQTDKPSHCSQFVTPPRMRRQFSAPNLKAGRETTV

SEQ ID NO: 44252 - protein, 1816 aa, Homo sapiens
  Payload ID: 9022
  Gene Symbol: KIF1B
  Gene Name: kinesin family member 1B
  Uniprot ID: O60333
  ENSP ID: ENSP00000366290
MSGASVKVAVRVRPFNSRETSKESKCIIQMQGNSTSIINPKNPKEAPKSFSFDYSYWSHTSPEDPCFASQNRVYNDIGKEMLLHAFEGYNVCIFAYGQTGAGKSYTMMGKQEESQAGIIPQLCEELFEKINDNCNEEMSYSVEVSYMEIYCERVRDLLNPKNKGNLRVREHPLLGPYVEDLSKLAVTSYTDIADLMDAGNKARTVAATNMNETSSRSHAVFTIVFTQKKHDNETNLSTEKVSKISLVDLAGSERADSTGAKGTRLKEGANINKSLTTLGKVISALAEVDNCTSKSKKKKKTDFIPYRDSVLTWLLRENLGGNSRTAMVAALSPADINYDETLSTLRYADRAKQIKCNAVINEDPNAKLVRELKEEVTRLKDLLRAQGLGDIIDIDPLIDDYSGSGSKYLKDFQNNKHRYLLASENQRPGHFSTASMGSLTSSPSSCSLSSQVGLTSVTSIQERIMSTPGGEEAIERLKESEKIIAELNETWEEKLRKTEAIRMEREALLAEMGVAIREDGGTLGVFSPKKTPHLVNLNEDPLMSECLLYYIKDGITRVGQADAERRQDIVLSGAHIKEEHCIFRSERSNSGEVIVTLEPCERSETYVNGKRVSQPVQLRSGNRIIMGKNHVFRFNHPEQARAEREKTPSAETPSEPVDWTFAQRELLEKQGIDMKQEMEKRLQEMEILYKKEKEEADLLLEQQRLDYESKLQALQKQVETRSLAAETTEEEEEEEEVPWTQHEFELAQWAFRKWKSHQFTSLRDLLWGNAVYLKEANAISVELKKKVQFQFVLLTDTLYSPLPPELLPTEMEKTHEDRPFPRTVVAVEVQDLKNGATHYWSLEKLKQRLDLMREMYDRAGEMASSAQDESETTVTGSDPFYDRFHWFKLVGSSPIFHGCVNERLADRTPSPTFSTADSDITELADEQQDEMEDFDDEAFVDDAGSDAGTEEGSDLFSDGHDPFYDRSPWFILVGRAFVYLSNLLYPVPLIHRVAIVSEKGEVRGFLRVAVQAIAADEEAPDYGSGIRQSGTAKISFDNEYFNQSDFSSVAMTRSGLSLEELRIVEGQGQSSEVITPPEEISRINDLDLKSSTLLDGKMVMEGFSEEIGNHLKLGSAFTFRVTVLQASGILPEYADIFCQFNFLHRHDEAFSTEPLKNNGRGSPLAFYHVQNIAVEITESFVDYIKTKPIVFEVFGHYQQHPLHLQGQELNSPPQPCRRFFPPPMPLSKPVPATKLNTMSKTSLGQSMSKYDLLVWFEISELEPTGEYIPAVVDHTAGLPCQGTFLLHQGIQRRITVTIIHEKGSELHWKDVRELVVGRIRNKPEVDEAAVDAILSLNIISAKYLKSSHNSSRTFYRFEAVWDSSLHNSLLLNRVTPYGEKIYMTLSAYLELDHCIQPAVITKDVCMVFYSRDAKISPPRSLRSLFGSGYSKSPDSNRVTGIYELSLCKMSDTGSPGMQRRRRKILDTSVAYVRGEENLAGWRPRGDSLILEHQWELEKLELLHEVEKTRHFLLLRERLGDSIPKSLSDSLSPSLSSGTLSTSTSISSQISTTTFESAITPSESSGYDSGDIESLVDREKELATKCLQLLTHTFNREFSQVHGSVSDCKLSDISPIGRDPSESSFSSATLTPSSTCPSLVDSRSNSLDQKTPEANSRASSPCPEFEQFQIVPAVETPYLARAGKNEFLNLVPDIEEIRPSSVVSKKGYLHFKEPLYSNWAKHFVVVRRPYVFIYNSDKDPVERGIINLSTAQVEYSEDQQAMVKTPNTFAVCTKHRGVLLQALNDKDMNDWLYAFNPLLAGTIRSKLSRRCPSQSKY

SEQ ID NO: 44253 - protein, 1153 aa, Homo sapiens; identical to SEQ ID NO: 44251
  Payload ID: 9022
  Gene Symbol: KIF1B
  Gene Name: kinesin family member 1B
  Uniprot ID: O60333
  ENSP ID: ENSP00000366297

SEQ ID NO: 44254 - protein, 1809 aa, Homo sapiens
  Payload ID: 9022
  Gene Symbol: KIF1B
  Gene Name: kinesin family member 1B
  ENSP ID: ENSP00000478500
MSGASVKVAVRVRPFNSRETSKESKCIIQMQGNSTSIINPKNPKEAPKSFSFDYSYWSHTSPEDPCFASQNRVYNDIGKEMLLHAFEGYNVCIFAYGQTGAGKSYTMMGKQEESQAGIIPQLCEELFEKINDNCNEEMSYSVEVSYMEIYCERVRDLLNPKNKGNLRVREHPLLGPYVEDLSKLAVTSYTDIADLMDAGNKARTVAATNMNETSSRSHAVFTIVFTQKKHDNETNLSTEKVSKISLVDLAGSERADSTGAKGTRLKEGANINKSLTTLGKVISALAEVDNCTSKSKKKKKTDFIPYRDSVLTWLLRENLGGNSRTAMVAALSPADINYDETLSTLRYADRAKQIKCNAVINEDPNAKLVRELKEEVTRLKDLLRAQGLGDIIDNLKDFQNNKHRYLLASENQRPGHFSTASMGSLTSSPSSCSLSSQVGLTSVTSIQERIMSTPGGEEAIERLKESEKIIAELNETWEEKLRKTEAIRMEREALLAEMGVAIREDGGTLGVFSPKKTPHLVNLNEDPLMSECLLYYIKDGITRVGQADAERRQDIVLSGAHIKEEHCIFRSERSNSGEVIVTLEPCERSETYVNGKRVSQPVQLRSGNRIIMGKNHVFRFNHPEQARAEREKTPSAETPSEPVDWTFAQRELLEKQGIDMKQEMEKRLQEMEILYKKEKEEADLLLEQQRLDYESKLQALQKQVETRSLAAETTEEEEEEEEVPWTQHEFELAQWAFRKWKSHQFTSLRDLLWGNAVYLKEANAISVELKKKVQFQFVLLTDTLYSPLPPELLPTEMEKTHEDRPFPRTVVAVEVQDLKNGATHYWSLEKLKQRLDLMREMYDRAGEMASSAQDESETTVTGSDPFYDRFHWFKLVGSSPIFHGCVNERLADRTPSPTFSTADSDITELADEQQDEMEDFDDEAFVDDAGSDAGTEEGSDLFSDGHDPFYDRSPWFILVGRAFVYLSNLLYPVPLIHRVAIVSEKGEVRGFLRVAVQAIAADEEAPDYGSGIRQSGTAKISFDNEYFNQSDFSSVAMTRSGLSLEELRIVEGQGQSSEVITPPEEISRINDLDLKSSTLLDGKMVMEGFSEEIGNHLKLGSAFTFRVTVLQASGILPEYADIFCQFNFLHRHDEAFSTEPLKNNGRGSPLAFYHVQNIAVEITESFVDYIKTKPIVFEVFGHYQQHPLHLQGQELNSPPQPCRRFFPPPMPLSKPVPATKLNTMSKTSLGQSMSKYDLLVWFEISELEPTGEYIPAVVDHTAGLPCQGTFLLHQGIQRRITVTIIHEKGSELHWKDVRELVVGRIRNKPEVDEAAVDAILSLNIISAKYLKSSHNSSRTFYRFEAVWDSSLHNSLLLNRVTPYGEKIYMTLSAYLELDHCIQPAVITKDVCMVFYSRDAKISPPRSLRSLFGSGYSKSPDSNRVTGIYELSLCKMSDTGSPGMQRRRRKILDTSVAYVRGEENLAGWRPRGDSLILEHQWELEKLELLHEVEKTRHFLLLRERLGDSIPKSLSDSLSPSLSSGTLSTSTSISSQISTTTFESAITPSESSGYDSGDIESLVDREKELATKCLQLLTHTFNREFSQVHGSVSDCKLSDISPIGRDPSESSFSSATLTPSSTCPSLVDSRSNSLDQKTPEANSRASSPCPEFEQFQIVPAVETPYLARAGKNEFLNLVPDIEEIRPSSVVSKKGYLHFKEPLYSNWAKHFVVVRRPYVFIYNSDKDPVERGIINLSTAQVEYSEDQQAMVKTPNTFAVCTKHRGVLLQALNDKDMNDWLYAFNPLLAGTIRPGHLASEIIREDKSVSFSCQ

SEQ ID NO: 44255 - protein, 1797 aa, Homo sapiens
  Payload ID: 9022
  Gene Symbol: KIF1B
  Gene Name: kinesin family member 1B
  ENSP ID: ENSP00000480063
MSGASVKVAVRVRPFNSRETSKESKCIIQMQGNSTSIINPKNPKEAPKSFSFDYSYWSHTSPEDPCFASQNRVYNDIGKEMLLHAFEGYNVCIFAYGQTGAGKSYTMMGKQEESQAGIIPQLCEELFEKINDNCNEEMSYSVEVSYMEIYCERVRDLLNPKNKGNLRVREHPLLGPYVEDLSKLAVTSYTDIADLMDAGNKARTVAATNMNETSSRSHAVFTIVFTQKKHDNETNLSTEKVSKISLVDLAGSERADSTGAKGTRLKEGANINKSLTTLGKVISALAEVDNCTSKSKKKKKTDFIPYRDSVLTWLLRENLGGNSRTAMVAALSPADINYDETLSTLRYADRAKQIKCNAVINEDPNAKLVRELKEEVTRLKDLLRAQGLGDIIDIDPLIDDYSGSGSKSSMGSLTSSPSSCSLSSQVGLTSVTSIQERIMSTPGGEEAIERLKESEKIIAELNETWEEKLRKTEAIRMEREALLAEMGVAIREDGGTLGVFSPKKTPHLVNLNEDPLMSECLLYYIKDGITRVGQADAERRQDIVLSGAHIKEEHCIFRSERSNSGEVIVTLEPCERSETYVNGKRVSQPVQLRSGNRIIMGKNHVFRFNHPEQARAEREKTPSAETPSEPVDWTFAQRELLEKQGIDMKQEMEKRLQEMEILYKKEKEEADLLLEQQRLDYESKLQALQKQVETRSLAAETTEEEEEEEEVPWTQHEFELAQWAFRKWKSHQFTSLRDLLWGNAVYLKEANAISVELKKKVQFQFVLLTDTLYSPLPPELLPTEMEKTHEDRPFPRTVVAVEVQDLKNGATHYWSLEKLKQRLDLMREMYDRAGEMASSAQDESETTVTGSDPFYDRFHWFKLVGSSPIFHGCVNERLADRTPSPTFSTADSDITELADEQQDEMEDFDDEAFVDDAGSDAGTEEGSDLFSDGHDPFYDRSPWFILVGRAFVYLSNLLYPVPLIHRVAIVSEKGEVRGFLRVAVQAIAADEEAPDYGSGIRQSGTAKISFDNEYFNQSDFSSVAMTRSGLSLEELRIVEGQGQSSEVITPPEEISRINDLDLKSSTLLDGKMVMEGFSEEIGNHLKLGSAFTFRVTVLQASGILPEYADIFCQFNFLHRHDEAFSTEPLKNNGRGSPLAFYHVQNIAVEITESFVDYIKTKPIVFEVFGHYQQHPLHLQGQELNSPPQPCRRFFPPPMPLSKPVPATKLNTMSKTSLGQSMSKYDLLVWFEISELEPTGEYIPAVVDHTAGLPCQGTFLLHQGIQRRITVTIIHEKGSELHWKDVRELVVGRIRNKPEVDEAAVDAILSLNIISAKYLKSSHNSSRTFYRFEAVWDSSLHNSLLLNRVTPYGEKIYMTLSAYLELDHCIQPAVITKDVCMVFYSRDAKISPPRSLRSLFGSGYSKSPDSNRVTGIYELSLCKMSDTGSPGMQRRRRKILDTSVAYVRGEENLAGWRPRGDSLILEHQWELEKLELLHEVEKTRHFLLLRERLGDSIPKSLSDSLSPSLSSGTLSTSTSISSQISTTTFESAITPSESSGYDSGDIESLVDREKELATKCLQLLTHTFNREFSQVHGSVSDCKLSDISPIGRDPSESSFSSATLTPSSTCPSLVDSRSNSLDQKTPEANSRASSPCPEFEQFQIVPAVETPYLARAGKNEFLNLVPDIEEIRPSSVVSKKGYLHFKEPLYSNWAKHFVVVRRPYVFIYNSDKDPVERGIINLSTAQVEYSEDQQAMVKTPNTFAVCTKHRGVLLQALNDKDMNDWLYAFNPLLAGTIRPGHLASEIIREDKSVSFSCQ

SEQ ID NO: 44256 - protein, 498 aa, Homo sapiens
  Payload ID: 9022
  Gene Symbol: KIF1B
  Gene Name: kinesin family member 1B
  ENSP ID: ENSP00000489057
  MOD_RES (1)..(1): Any amino acid
XAVDAILSLNIISAKYLKSSHNSSRLFLDKDIPRTFYRFEAVWDSSLHNSLLLNRVTPYGEKIYMTLSAYLELDHCIQPAVITKDVCMVFYSRDAKISPPRSLRSLFGSGYSKSPDSNRVTGIYELSLCKMSDTGSPGMQRRRRKILDTSVAYVRGEENLAGWRPRGDSLILEHQWELEKLELLHEVEKTRHFLLLRERLGDSIPKSLSDSLSPSLSSGTLSTSTSISSQISTTTFESAITPSESSGYDSGDIESLVDREKELATKCLQLLTHTFNREFSQVHGSVSDCKLSDISPIGRDPSESSFSSATLTPSSTCPSLVDSRSNSLDQKTPEANSRASSPCPEFEQFQIVPAVETPYLARAGKNEFLNLVPDIEEIRPSSVVSKKGYLHFKEPLYSNWAKHFVVVRRPYVFIYNSDKDPVERGIINLSTAQVEYSEDQQAMVKTPNTFAVCTKHRGVLLQALNDKDMNDWLYAFNPLLAGTIRSKLSRRCPSQSKY

SEQ ID NO: 44257 - protein, 1103 aa, Homo sapiens
  Payload ID: 9023
  Gene Symbol: KIF1C
  Gene Name: kinesin family member 1C
  Uniprot ID: O43896
  ENSP ID: ENSP00000320821
MAGASVKVAVRVRPFNARETSQDAKCVVSMQGNTTSIINPKQSKDAPKSFTFDYSYWSHTSTEDPQFASQQQVYRDIGEEMLLHAFEGYNVCIFAYGQTGAGKSYTMMGRQEPGQQGIVPQLCEDLFSRVSENQSAQLSYSVEVSYMEIYCERVRDLLNPKSRGSLRVREHPILGPYVQDLSKLAVTSYADIADLMDCGNKARTVAATNMNETSSRSHAVFTIVFTQRCHDQLTGLDSEKVSKISLVDLAGSERADSSGARGMRLKEGANINKSLTTLGKVISALADMQSKKRKSDFIPYRDSVLTWLLKENLGGNSRTAMIAALSPADINYEETLSTLRYADRTKQIRCNAIINEDPNARLIRELQEEVARLRELLMAQGLSASALEGLKTEEGSVRGALPAVSSPPAPVSPSSPTTHNGELEPSFSPNTESQIGPEEAMERLQETEKIIAELNETWEEKLRKTEALRMEREALLAEMGVAVREDGGTVGVFSPKKTPHLVNLNEDPLMSECLLYHIKDGVTRVGQVDMDIKLTGQFIREQHCLFRSIPQPDGEVVVTLEPCEGAETYVNGKLVTEPLVLKSGNRIVMGKNHVFRFNHPEQARLERERGVPPPPGPPSEPVDWNFAQKELLEQQGIDIKLEMEKRLQDLENQYRKEKEEADLLLEQQRLYADSDSGDDSDKRSCEESWRLISSLREQLPPTTVQTIVKRCGLPSSGKRRAPRRVYQIPQRRRLQGKDPRWATMADLKMQAVKEICYEVALADFRHGRAEIEALAALKMRELCRTYGKPDGPGDAWRAVARDVWDTVGEEEGGGAGSGGGSEEGARGAEVEDLRAHIDKLTGILQEVKLQNSSKDRELQALRDRMLRMERVIPLAQDHEDENEEGGEVPWAPPEGSEAAEEAAPSDRMPSARPPSPPLSSWERVSRLMEEDPAFRRGRLRWLKQEQLRLQGLQGSGGRGGGLRRPPARFVPPHDCKLRFPFKSNPQHRESWPGMGSGEAPTPLQPPEEVTPHPATPARRPPSPRRSHHPRRNSLDGGGRSRGAGSAQPEPQHFQPKKHNSYPQPPQPYPAQRPPGPRYPPYTTPPRMRRQRSAPDLKESGAAV

SEQ ID NO: 44258 - protein, 138 aa, Homo sapiens
  Payload ID: 9023
  Gene Symbol: KIF1C
  Gene Name: kinesin family member 1C
  ENSP ID: ENSP00000458697
MAGASVKVAVRVRPFNARETSQDAKCVVSMQGNTTSIINPKQSKDAPKSFTFDYSYWSHTSTEDPQFASQQQVYRDIGEEMLLHAFEGYNVCIFAYGQTGAGKSYTMMGRQEPGQQGIVPQLCEDLFSRVSENQSAQL

SEQ ID NO: 44259 - protein, 890 aa, Homo sapiens
  Payload ID: 9024
  Gene Symbol: KIF20A
  Gene Name: kinesin family member 20A
  Uniprot ID: O95235
  ENSP ID: ENSP00000378356
MSQGILSPPAGLLSDDDVVVSPMFESTAADLGSVVRKNLLSDCSVVSTSLEDKQQVPSEDSMEKVKVYLRVRPLLPSELERQEDQGCVRIENVETLVLQAPKDSFALKSNERGIGQATHRFTFSQIFGPEVGQASFFNLTVKEMVKDVLKGQNWLIYTYGVTNSGKTHTIQGTIKDGGILPRSLALIFNSLQGQLHPTPDLKPLLSNEVIWLDSKQIRQEEMKKLSLLNGGLQEEELSTSLKRSVYIESRIGTSTSFDSGIAGLSSISQCTSSSQLDETSHRWAQPDTAPLPVPANIRFSIWISFFEIYNELLYDLLEPPSQQRKRQTLRLCEDQNGNPYVKDLNWIHVQDAEEAWKLLKVGRKNQSFASTHLNQNSSRSHSIFSIRILHLQGEGDIVPKISELSLCDLAGSERCKDQKSGERLKEAGNINTSLHTLGRCIAALRQNQQNRSKQNLVPFRDSKLTRVFQGFFTGRGRSCMIVNVNPCASTYDETLHVAKFSAIASQLVHAPPMQLGFPSLHSFIKEHSLQVSPSLEKGAKADTGLDDDIENEADISMYGKEELLQVVEAMKTLLLKERQEKLQLEMHLRDEICNEMVEQMQQREQWCSEHLDTQKELLEEMYEEKLNILKESLTSFYQEEIQERDEKIEELEALLQEARQQSVAHQQSGSELALRRSQRLAASASTQQLQEVKAKLQQCKAELNSTTEELHKYQKMLEPPPSAKPFTIDVDKKLEEGQKNIRLLRTELQKLGESLQSAERACCHSTGAGKLRQALTTCDDILIKQDQTLAELQNNMVLVKLDLRKKAACIAEQYHTVLKLQGQVSAKKRLGTNQENQQPNQQPPGKKPFLRNLLPRTPTCQSSTDCSPYARILRSRRSPLLKSGPFGKKY

SEQ ID NO: 44260 - protein, 872 aa, Homo sapiens
  Payload ID: 9024
  Gene Symbol: KIF20A
  Gene Name: kinesin family member 20A
  Uniprot ID: O95235
  ENSP ID: ENSP00000420880
MSQGILSPPAGLLSDDDVVVSPMFESTAADLGSVVRKNLLSDCSVVSTSLEDKQQVPSEDSMEKEDQGCVRIENVETLVLQAPKDSFALKSNERGIGQATHRFTFSQIFGPEVGQASFFNLTVKEMVKDVLKGQNWLIYTYGVTNSGKTHTIQGTIKDGGILPRSLALIFNSLQGQLHPTPDLKPLLSNEVIWLDSKQIRQEEMKKLSLLNGGLQEEELSTSLKRSVYIESRIGTSTSFDSGIAGLSSISQCTSSSQLDETSHRWAQPDTAPLPVPANIRFSIWISFFEIYNELLYDLLEPPSQQRKRQTLRLCEDQNGNPYVKDLNWIHVQDAEEAWKLLKVGRKNQSFASTHLNQNSSRSHSIFSIRILHLQGEGDIVPKISELSLCDLAGSERCKDQKSGERLKEAGNINTSLHTLGRCIAALRQNQQNRSKQNLVPFRDSKLTRVFQGFFTGRGRSCMIVNVNPCASTYDETLHVAKFSAIASQLVHAPPMQLGFPSLHSFIKEHSLQVSPSLEKGAKADTGLDDDIENEADISMYGKEELLQVVEAMKTLLLKERQEKLQLEMHLRDEICNEMVEQMQQREQWCSEHLDTQKELLEEMYEEKLNILKESLTSFYQEEIQERDEKIEELEALLQEARQQSVAHQQSGSELALRRSQRLAASASTQQLQEVKAKLQQCKAELNSTTEELHKYQKMLEPPPSAKPFTIDVDKKLEEGQKNIRLLRTELQKLGESLQSAERACCHSTGAGKLRQALTTCDDILIKQDQTLAELQNNMVLVKLDLRKKAACIAEQYHTVLKLQGQVSAKKRLGTNQENQQPNQQPPGKKPFLRNLLPRTPTCQSSTDCSPYARILRSRRSPLLKSGPFGKKY

SEQ ID NO: 44261 - protein, 159 aa, Homo sapiens
  Payload ID: 9024
  Gene Symbol: KIF20A
  Gene Name: kinesin family member 20A
  ENSP ID: ENSP00000422928
MSQGILSPPAGLLSDDDVVVSPMFESTAADLGSVVRKNLLSDCSVVSTSLEDKQQVPSEDSMEKVKVYLRVRPLLPSELERQEDQGCVRIENVETLVLQAPKDSFALKSNERGIGQATHRFTFSQIFGPEVGQASFFNLTVKEMVKDVLKGQNWLIYTY

SEQ ID NO: 44262 - protein, 225 aa, Homo sapiens
  Payload ID: 9024
  Gene Symbol: KIF20A
  Gene Name: kinesin family member 20A
  ENSP ID: ENSP00000424056
MSQGILSPPAGLLSDDDVVVSPMFESTAADLGSVVRKNLLSDCSVVSTSLEDKQQVPSEDSMEKVKVYLRVRPLLPSELERQEDQGCVRIENVETLVLQAPKDSFALKSNERGIGQATHRFTFSQIFGPEVGQASFFNLTVKEMVKDVLKGQNWLIYTYGVTNSGKTHTIQGTIKDGGILPRSLALIFNSLQGQLHPTPDLKPLLSNEVIWLDSKQIRQEEMKKL

SEQ ID NO: 44263 - protein, 82 aa, Homo sapiens
  Payload ID: 9024
  Gene Symbol: KIF20A
  Gene Name: kinesin family member 20A
  ENSP ID: ENSP00000426704
AMKTLLLKERQEKLQLEMHLRDEICNEMVEQMQQREQWCSEHLDTQKELLEEMYEEKLNILKESLTSFYQEEIQSCISIRKC

SEQ ID NO: 44264 - protein, 1780 aa, Homo sapiens
  Payload ID: 9025
  Gene Symbol: KIF20B
  Gene Name: kinesin family member 20B
  Uniprot ID: Q96Q89
  ENSP ID: ENSP00000260753
MESNFNQEGVPRPSYVFSADPIARPSEINFDGIKLDLSHEFSLVAPNTEANSFESKDYLQVCLRIRPFTQSEKELESEGCVHILDSQTVVLKEPQCILGRLSEKSSGQMAQKFSFSKVFGPATTQKEFFQGCIMQPVKDLLKGQSRLIFTYGLTNSGKTYTFQGTEENIGILPRTLNVLFDSLQERLYTKMNLKPHRSREYLRLSSEQEKEEIASKSALLRQIKEVTVHNDSDDTLYGSLTNSLNISEFEESIKDYEQANLNMANSIKFSVWVSFFEIYNEYIYDLFVPVSSKFQKRKMLRLSQDVKGYSFIKDLQWIQVSDSKEAYRLLKLGIKHQSVAFTKLNNASSRSHSIFTVKILQIEDSEMSRVIRVSELSLCDLAGSERTMKTQNEGERLRETGNINTSLLTLGKCINVLKNSEKSKFQQHVPFRESKLTHYFQSFFNGKGKICMIVNISQCYLAYDETLNVLKFSAIAQKVCVPDTLNSSQEKLFGPVKSSQDVSLDSNSNSKILNVKRATISWENSLEDLMEDEDLVEELENAEETQNVETKLLDEDLDKTLEENKAFISHEEKRKLLDLIEDLKKKLINEKKEKLTLEFKIREEVTQEFTQYWAQREADFKETLLQEREILEENAERRLAIFKDLVGKCDTREEAAKDICATKVETEEATACLELKFNQIKAELAKTKGELIKTKEELKKRENESDSLIQELETSNKKIITQNQRIKELINIIDQKEDTINEFQNLKSHMENTFKCNDKADTSSLIINNKLICNETVEVPKDSKSKICSERKRVNENELQQDEPPAKKGSIHVSSAITEDQKKSEEVRPNIAEIEDIRVLQENNEGLRAFLLTIENELKNEKEEKAELNKQIVHFQQELSLSEKKNLTLSKEVQQIQSNYDIAIAELHVQKSKNQEQEEKIMKLSNEIETATRSITNNVSQIKLMHTKIDELRTLDSVSQISNIDLLNLRDLSNGSEEDNLPNTQLDLLGNDYLVSKQVKEYRIQEPNRENSFHSSIEAIWEECKEIVKASSKKSHQIEELEQQIEKLQAEVKGYKDENNRLKEKEHKNQDDLLKEKETLIQQLKEELQEKNVTLDVQIQHVVEGKRALSELTQGVTCYKAKIKELETILETQKVECSHSAKLEQDILEKESIILKLERNLKEFQEHLQDSVKNTKDLNVKELKLKEEITQLTNNLQDMKHLLQLKEEEEETNRQETEKLKEELSASSARTQNLKADLQRKEEDYADLKEKLTDAKKQIKQVQKEVSVMRDEDKLLRIKINELEKKKNQCSQELDMKQRTIQQLKEQLNNQKVEEAIQQYERACKDLNVKEKIIEDMRMTLEEQEQTQVEQDQVLEAKLEEVERLATELEKWKEKCNDLETKNNQRSNKEHENNTDVLGKLTNLQDELQESEQKYNADRKKWLEEKMMLITQAKEAENIRNKEMKKYAEDRERFFKQQNEMEILTAQLTEKDSDLQKWREERDQLVAALEIQLKALISSNVQKDNEIEQLKRIISETSKIETQIMDIKPKRISSADPDKLQTEPLSTSFEISRNKIEDGSVVLDSCEVSTENDQSTRFPKPELEIQFTPLQPNKMAVKHPGCTTPVTVKIPKARKRKSNEMEEDLVKCENKKNATPRTNLKFPISDDRNSSVKKEQKVAIRPSSKKTYSLRSQASIIGVNLATKKKEGTLQKFGDFLQHSPSILQSKAKKIIETMSSSKLSNVEASKENVSQPKRAKRKLYTSEISSPIDISGQVILMDQKMKESDHQIIKRRLRTKTAK

SEQ ID NO: 44265 - protein, 1820 aa, Homo sapiens
  Payload ID: 9025
  Gene Symbol: KIF20B
  Gene Name: kinesin family member 20B
  Uniprot ID: Q96Q89
  ENSP ID: ENSP00000360793
MESNFNQEGVPRPSYVFSADPIARPSEINFDGIKLDLSHEFSLVAPNTEANSFESKDYLQVCLRIRPFTQSEKELESEGCVHILDSQTVVLKEPQCILGRLSEKSSGQMAQKFSFSKVFGPATTQKEFFQGCIMQPVKDLLKGQSRLIFTYGLTNSGKTYTFQGTEENIGILPRTLNVLFDSLQERLYTKMNLKPHRSREYLRLSSEQEKEEIASKSALLRQIKEVTVHNDSDDTLYGSLTNSLNISEFEESIKDYEQANLNMANSIKFSVWVSFFEIYNEYIYDLFVPVSSKFQKRKMLRLSQDVKGYSFIKDLQWIQVSDSKEAYRLLKLGIKHQSVAFTKLNNASSRSHSIFTVKILQIEDSEMSRVIRVSELSLCDLAGSERTMKTQNEGERLRETGNINTSLLTLGKCINVLKNSEKSKFQQHVPFRESKLTHYFQSFFNGKGKICMIVNISQCYLAYDETLNVLKFSAIAQKVCVPDTLNSSQEKLFGPVKSSQDVSLDSNSNSKILNVKRATISWENSLEDLMEDEDLVEELENAEETQNVETKLLDEDLDKTLEENKAFISHEEKRKLLDLIEDLKKKLINEKKEKLTLEFKIREEVTQEFTQYWAQREADFKETLLQEREILEENAERRLAIFKDLVGKCDTREEAAKDICATKVETEETHNYVGFEDIIDSLQDNVADIKKQAEIAHLYIASLPDPQEATACLELKFNQIKAELAKTKGELIKTKEELKKRENESDSLIQELETSNKKIITQNQRIKELINIIDQKEDTINEFQNLKSHMENTFKCNDKADTSSLIINNKLICNETVEVPKDSKSKICSERKRVNENELQQDEPPAKKGSIHVSSAITEDQKKSEEVRPNIAEIEDIRVLQENNEGLRAFLLTIENELKNEKEEKAELNKQIVHFQQELSLSEKKNLTLSKEVQQIQSNYDIAIAELHVQKSKNQEQEEKIMKLSNEIETATRSITNNVSQIKLMHTKIDELRTLDSVSQISNIDLLNLRDLSNGSEEDNLPNTQLDLLGNDYLVSKQVKEYRIQEPNRENSFHSSIEAIWEECKEIVKASSKKSHQIEELEQQIEKLQAEVKGYKDENNRLKEKEHKNQDDLLKEKETLIQQLKEELQEKNVTLDVQIQHVVEGKRALSELTQGVTCYKAKIKELETILETQKVECSHSAKLEQDILEKESIILKLERNLKEFQEHLQDSVKNTKDLNVKELKLKEEITQLTNNLQDMKHLLQLKEEEEETNRQETEKLKEELSASSARTQNLKADLQRKEEDYADLKEKLTDAKKQIKQVQKEVSVMRDEDKLLRIKINELEKKKNQCSQELDMKQRTIQQLKEQLNNQKVEEAIQQYERACKDLNVKEKIIEDMRMTLEEQEQTQVEQDQVLEAKLEEVERLATELEKWKEKCNDLETKNNQRSNKEHENNTDVLGKLTNLQDELQESEQKYNADRKKWLEEKMMLITQAKEAENIRNKEMKKYAEDRERFFKQQNEMEILTAQLTEKDSDLQKWREERDQLVAALEIQLKALISSNVQKDNEIEQLKRIISETSKIETQIMDIKPKRISSADPDKLQTEPLSTSFEISRNKIEDGSVVLDSCEVSTENDQSTRFPKPELEIQFTPLQPNKMAVKHPGCTTPVTVKIPKARKRKSNEMEEDLVKCENKKNATPRTNLKFPISDDRNSSVKKEQKVAIRPSSKKTYSLRSQASIIGVNLATKKKEGTLQKFGDFLQHSPSILQSKAKKIIETMSSSKLSNVEASKENVSQPKRAKRKLYTSEISSPIDISGQVILMDQKMKESDHQIIKRRLRTKTAK

SEQ ID NO: 44266 - protein, 206 aa, Homo sapiens
  Payload ID: 9025
  Gene Symbol: KIF20B
  Gene Name: kinesin family member 20B
  ENSP ID: ENSP00000390946
MESNFNQEGVPRPSYVFSADPIARPSEINFDGIKLDLSHEFSLVAPNTEANSFESKDYLQVCLRIRPFTQSEKELESEGCVHILDSQTVVLKEPQCILGRLSEKSSGQMAQKFSFSKVFGPATTQKEFFQGCIMQPVKDLLKGQSRLIFTYGLTNSGKTYTFQGTEENIGILPRTLNVLFDSLQERLYTKMNLKPHRSREYLRLSS

SEQ ID NO: 44267 - protein, 1661 aa, Homo sapiens
  Payload ID: 9026
  Gene Symbol: KIF21A
  Gene Name: kinesin family member 21A
  Uniprot ID: Q7Z4S6
  ENSP ID: ENSP00000354851
MLGAPDESSVRVAVRIRPQLAKEKIEGCHICTSVTPGEPQVFLGKDKAFTFDYVFDIDSQQEQIYIQCIEKLIEGCFEGYNATVFAYGQTGAGKTYTMGTGFDVNIVEEELGIISRAVKHLFKSIEEKKHIAIKNGLPAPDFKVNAQFLELYNEEVLDLFDTTRDIDAKSKKSNIRIHEDSTGGIYTVGVTTRTVNTESEMMQCLKLGALSRTTASTQMNVQSSRSHAIFTIHVCQTRVCPQIDADNATDNKIISESAQMNEFETLTAKFHFVDLAGSERLKRTGATGERAKEGISINCGLLALGNVISALGDKSKRATHVPYRDSKLTRLLQDSLGGNSQTIMIACVSPSDRDFMETLNTLKYANRARNIKNKVMVNQDRASQQINALRSEITRLQMELMEYKTGKRIIDEEGVESINDMFHENAMLQTENNNLRVRIKAMQETVDALRSRITQLVSDQANHVLARAGEGNEEISNMIHSYIKEIEDLRAKLLESEAVNENLRKNLTRATARAPYFSGSSTFSPTILSSDKETIEIIDLAKKDLEKLKRKEKRKKKSVAGKEDNTDTDQEKKEEKGVSERENNELEVEESQEVSDHEDEEEEEEEEEDDIDGGESSDESDSESDEKANYQADLANITCEIAIKQKLIDELENSQKRLQTLKKQYEEKLMMLQHKIRDTQLERDQVLQNLGSVESYSEEKAKKVRSEYEKKLQAMNKELQRLQAAQKEHARLLKNQSQYEKQLKKLQQDVMEMKKTKVRLMKQMKEEQEKARLTESRRNREIAQLKKDQRKRDHQLRLLEAQKRNQEVVLRRKTEEVTALRRQVRPMSDKVAGKVTRKLSSSDAPAQDTGSSAAAVETDASRTGAQQKMRIPVARVQALPTPATNGNRKKYQRKGLTGRVFISKTARMKWQLLERRVTDIIMQKMTISNMEADMNRLLKQREELTKRREKLSKRREKIVKENGEGDKNVANINEEMESLTANIDYINDSISDCQANIMQMEEAKEEGETLDVTAVINACTLTEARYLLDHFLSMGINKGLQAAQKEAQIKVLEGRLKQTEITSATQNQLLFHMLKEKAELNPELDALLGHALQDLDSVPLENVEDSTDEDAPLNSPGSEGSTLSSDLMKLCGEVKPKNKARRRTTTQMELLYADSSELASDTSTGDASLPGPLTPVAEGQEIGMNTETSGTSAREKELSPPPGLPSKIGSISRQSSLSEKKIPEPSPVTRRKAYEKAEKSKAKEQKHSDSGTSEASLSPPSSPPSRPRNELNVFNRLTVSQGNTSVQQDKSDESDSSLSEVHRSSRRGIINPFPASKGIRAFPLQCIHIAEGHTKAVLCVDSTDDLLFTGSKDRTCKVWNLVTGQEIMSLGGHPNNVVSVKYCNYTSLVFTVSTSYIKVWDIRDSAKCIRTLTSSGQVTLGDACSASTSRTVAIPSGENQINQIALNPTGTFLYAASGNAVRMWDLKRFQSTGKLTGHLGPVMCLTVDQISSGQDLIITGSKDHYIKMFDVTEGALGTVSPTHNFEPPHYDGIEALTIQGDNLFSGSRDNGIKKWDLTQKDLLQQVPNAHKDWVCALGVVPDHPVLLSGCRGGILKVWNMDTFMPVGEMKGHDSPINAICVNSTHIFTAADDRTVRIWKARNLQDGQISDTGDLGEDIASN

SEQ ID NO: 44268 - protein, 1674 aa, Homo sapiens
  Payload ID: 9026
  Gene Symbol: KIF21A
  Gene Name: kinesin family member 21A
  Uniprot ID: Q7Z4S6
  ENSP ID: ENSP00000354878
MLGAPDESSVRVAVRIRPQLAKEKIEGCHICTSVTPGEPQVFLGKDKAFTFDYVFDIDSQQEQIYIQCIEKLIEGCFEGYNATVFAYGQTGAGKTYTMGTGFDVNIVEEELGIISRAVKHLFKSIEEKKHIAIKNGLPAPDFKVNAQFLELYNEEVLDLFDTTRDIDAKSKKSNIRIHEDSTGGIYTVGVTTRTVNTESEMMQCLKLGALSRTTASTQMNVQSSRSHAIFTIHVCQTRVCPQIDADNATDNKIISESAQMNEFETLTAKFHFVDLAGSERLKRTGATGERAKEGISINCGLLALGNVISALGDKSKRATHVPYRDSKLTRLLQDSLGGNSQTIMIACVSPSDRDFMETLNTLKYANRARNIKNKVMVNQDRASQQINALRSEITRLQMELMEYKTGKRIIDEEGVESINDMFHENAMLQTENNNLRVRIKAMQETVDALRSRITQLVSDQANHVLARAGEGNEEISNMIHSYIKEIEDLRAKLLESEAVNENLRKNLTRATARAPYFSGSSTFSPTILSSDKETIEIIDLAKKDLEKLKRKEKRKKKRLQKLEESNREERSVAGKEDNTDTDQEKKEEKGVSERENNELEVEESQEVSDHEDEEEEEEEEEDDIDGGESSDESDSESDEKANYQADLANITCEIAIKQKLIDELENSQKRLQTLKKQYEEKLMMLQHKIRDTQLERDQVLQNLGSVESYSEEKAKKVRSEYEKKLQAMNKELQRLQAAQKEHARLLKNQSQYEKQLKKLQQDVMEMKKTKVRLMKQMKEEQEKARLTESRRNREIAQLKKDQRKRDHQLRLLEAQKRNQEVVLRRKTEEVTALRRQVRPMSDKVAGKVTRKLSSSDAPAQDTGSSAAAVETDASRTGAQQKMRIPVARVQALPTPATNGNRKKYQRKGLTGRVFISKTARMKWQLLERRVTDIIMQKMTISNMEADMNRLLKQREELTKRREKLSKRREKIVKENGEGDKNVANINEEMESLTANIDYINDSISDCQANIMQMEEAKEEGETLDVTAVINACTLTEARYLLDHFLSMGINKGLQAAQKEAQIKVLEGRLKQTEITSATQNQLLFHMLKEKAELNPELDALLGHALQDLDSVPLENVEDSTDEDAPLNSPGSEGSTLSSDLMKLCGEVKPKNKARRRTTTQMELLYADSSELASDTSTGDASLPGPLTPVAEGQEIGMNTETSGTSAREKELSPPPGLPSKIGSISRQSSLSEKKIPEPSPVTRRKAYEKAEKSKAKEQKHSDSGTSEASLSPPSSPPSRPRNELNVFNRLTVSQGNTSVQQDKSDESDSSLSEVHRSSRRGIINPFPASKGIRAFPLQCIHIAEGHTKAVLCVDSTDDLLFTGSKDRTCKVWNLVTGQEIMSLGGHPNNVVSVKYCNYTSLVFTVSTSYIKVWDIRDSAKCIRTLTSSGQVTLGDACSASTSRTVAIPSGENQINQIALNPTGTFLYAASGNAVRMWDLKRFQSTGKLTGHLGPVMCLTVDQISSGQDLIITGSKDHYIKMFDVTEGALGTVSPTHNFEPPHYDGIEALTIQGDNLFSGSRDNGIKKWDLTQKDLLQQVPNAHKDWVCALGVVPDHPVLLSGCRGGILKVWNMDTFMPVGEMKGHDSPINAICVNSTHIFTAADDRTVRIWKARNLQDGQISDTGDLGEDIASN

SEQ ID NO: 44269 - protein, 1621 aa, Homo sapiens
  Payload ID: 9026
  Gene Symbol: KIF21A
  Gene Name: kinesin family member 21A
  Uniprot ID: Q7Z4S6
  ENSP ID: ENSP00000438075
MLGAPDESSVRVAVRIRPQLAKEKIEGCHICTSVTPGEPQVFLGKDKAFTFDYVFDIDSQQEQIYIQCIEKLIEGCFEGYNATVFAYGQTGAGKTYTMGTGFDVNIVEEELGIISRAVKHLFKSIEEKKHIAIKNGLPAPDFKVNAQFLELYNEEVLDLFDTTRDIDAKSKKSNIRIHEDSTGGIYTVGVTTRTVNTESEMMQCLKLGALSRTTASTQMNVQSSRSHAIFTIHVCQTRVCPQIDADNATDNKIISESAQMNEFETLTAKFHFVDLAGSERLKRTGATGERAKEGISINCGLLALGNVISALGDKSKRATHVPYRDSKLTRLLQDSLGGNSQTIMIACVSPSDRDFMETLNTLKYANRARNIKNKVMVNQDRASQQINALRSEITRLQMELMEYKTGKRIIDEEGVESINDMFHENAMLQTENNNLRVRIKAMQETVDALRSRITQLVSDQANHVLARAGEGNEEISNMIHSYIKEIEDLRAKLLESEAVNENLRKNLTRATARAPYFSGSSTFSPTILSSDKETIEIIDLAKKDLEKLKRKEKRKKKSVAGKEDNTDTDQEKKEEKGVSERENNELEVEESQEVSDHEDEEEEEEEEEDDIDGGESSDESDSESDEKANYQADLANITCEIAIKQKLIDELENSQKRLQTLKKQYEEKLMMLQHKIRDTQLERDQVLQNLGSVESYSEEKAKKVRSEYEKKLQAMNKELQRLQAAQKEHARLLKNQSQYEKQLKKLQQDVMEMKKTKVRLMKQMKEEQEKARLTESRRNREIAQLKKDQRKRDVTALRRQVRPMSDKVAGKVTRKLSSSDAPAQDTGSSAAAVETDASRTGAQQKMRIPVARVQALPTPATNGNRKKYQRKGLTGRVFISKTARMKWQLLERRVTDIIMQKMTISNMEADMNRLLKQREELTKRREKLSKRREKIVKENGEGDKNVANINEEMESLTANIDYINDSISDCQANIMQMEEAKEEGETLDVTAVINACTLTEARYLLDHFLSMGINKGLQAAQKEAQIKVLEGRLKQTEITSATQNQLLFHMLKEKAELNPELDALLGHALQDLDSVPLENVEDSTDEDAPLNSPGSEGSTLSSDLMKLCGEVKPKNKARRRTTTQMELLYADSSELASDTSTGDASLPGPLTPVAEGQEIGMNTETSGTSAREKELSPPPGLPSKIGSISRQSSLSEKKIPEPSPVTRRKAYEKAEKSKAKEQKHSDSGTSEASLSPPSSPPSRPRNELNVFNRLTVSQGNTSVQQDKGIINPFPASKGIRAFPLQCIHIAEGHTKAVLCVDSTDDLLFTGSKDRTCKVWNLVTGQEIMSLGGHPNNVVSVKYCNYTSLVFTVSTSYIKVWDIRDSAKCIRTLTSSGQVTLGDACSASTSRTVAIPSGENQINQIALNPTGTFLYAASGNAVRMWDLKRFQSTGKLTGHLGPVMCLTVDQISSGQDLIITGSKDHYIKMFDVTEGALGTVSPTHNFEPPHYDGIEALTIQGDNLFSGSRDNGIKKWDLTQKDLLQQVPNAHKDWVCALGVVPDHPVLLSGCRGGILKVWNMDTFMPVGEMKGHDSPINAICVNSTHIFTAADDRTVRIWKARNLQDGQISDTGDLGEDIASN

SEQ ID NO: 44270 - protein, 1637 aa, Homo sapiens
  Payload ID: 9026
  Gene Symbol: KIF21A
  Gene Name: kinesin family member 21A
  Uniprot ID: Q7Z4S6
  ENSP ID: ENSP00000445606
MLGAPDESSVRVAVRIRPQLAKEKIEGCHICTSVTPGEPQVFLGKDKAFTFDYVFDIDSQQEQIYIQCIEKLIEGCFEGYNATVFAYGQTGAGKTYTMGTGFDVNIVEEELGIISRAVKHLFKSIEEKKHIAIKNGLPAPDFKVNAQFLELYNEEVLDLFDTTRDIDAKSKKSNIRIHEDSTGGIYTVGVTTRTVNTESEMMQCLKLGALSRTTASTQMNVQSSRSHAIFTIHVCQTRVCPQIDADNATDNKIISESAQMNEFETLTAKFHFVDLAGSERLKRTGATGERAKEGISINCGLLALGNVISALGDKSKRATHVPYRDSKLTRLLQDSLGGNSQTIMIACVSPSDRDFMETLNTLKYANRARNIKNKVMVNQDRASQQINALRSEITRLQMELMEYKTGKRIIDEEGVESINDMFHENAMLQTENNNLRVRIKAMQETVDALRSRITQLVSDQANHVLARAGEGNEEISNMIHSYIKEIEDLRAKLLESEAVNENLRKNLTRATARAPYFSGSSTFSPTILSSDKETIEIIDLAKKDLEKLKRKEKRKKKSVAGKEDNTDTDQEKKEEKGVSERENNELEVEESQEVSDHEDEEEEEEEEEDDIDGGESSDESDSESDEKANYQADLANITCEIAIKQKLIDELENSQKRLQTLKKQYEEKLMMLQHKIRDTQLERDQVLQNLGSVESYSEEKAKKVRSEYEKKLQAMNKELQRLQAAQKEHARLLKNQSQYEKQLKKLQQDVMEMKKTKVRLMKQMKEEQEKARLTESRRNREIAQLKKDQRKRDHQLRLLEAQKRNQEVVLRRKTEEVTALRRQVRPMSDKVAGKVTRKLSSSDAPAQDTGSSAAAVETDASRTGAQQKMRIPVARVQALPTPATNGNRKKYQRKGLTGRVFISKTARMKWQLLERRVTDIIMQKMTISNMEADMNRLLKQREELTKRREKLSKRREKIVKENGEGDKNVANINEEMESLTANIDYINDSISDCQANIMQMEEAKEEGETLDVTAVINACTLTEARYLLDHFLSMGINKGLQAAQKEAQIKVLEGRLKQTEITSATQNQLLFHMLKEKAELNPELDALLGHALQENVEDSTDEDAPLNSPGSEGSTLSSDLMKLCGEVKPKNKARRRTTTQMELLYADSSELASDTSTGDASLPGPLTPVAEGQEIGMNTETSGTSAREKELSPPPGLPSKIGSISRQSSLSEKKIPEPSPVTRRKAYEKAEKSKAKEQKHSDSGTSEASLSPPSSPPSRPRNELNVFNRLTVSQGNTSVQQDKGIINPFPASKGIRAFPLQCIHIAEGHTKAVLCVDSTDDLLFTGSKDRTCKVWNLVTGQEIMSLGGHPNNVVSVKYCNYTSLVFTVSTSYIKVWDIRDSAKCIRTLTSSGQVTLGDACSASTSRTVAIPSGENQINQIALNPTGTFLYAASGNAVRMWDLKRFQSTGKLTGHLGPVMCLTVDQISSGQDLIITGSKDHYIKMFDVTEGALGTVSPTHNFEPPHYDGIEALTIQGDNLFSGSRDNGIKKWDLTQKDLLQQVPNAHKDWVCALGVVPDHPVLLSGCRGGILKVWNMDTFMPVGEMKGHDSPINAICVNSTHIFTAADDRTVRIWKARNLQDGQISDTGDLGEDIASN

SEQ ID NO: 44271 - protein, 138 aa, Homo sapiens
  Payload ID: 9026
  Gene Symbol: KIF21A
  Gene Name: kinesin family member 21A
  ENSP ID: ENSP00000447070
KNVANINEEMESLTANIDYINDSISDCQANIMQMEEAKEEGETLDVTAVINACTLTEARYLLDHFLSMGINKGLQAAQKEAQIKVLEGRLKQTEITSATQNQLLFHMLKEKAELNPELDALLGHALQDLDSVPLGKYV

SEQ ID NO: 44272 - protein, 975 aa, Homo sapiens
  Payload ID: 9026
  Gene Symbol: KIF21A
  Gene Name: kinesin family member 21A
  ENSP ID: ENSP00000447765
  MOD_RES (1)..(1): Any amino acid
XIAIKQKLIDELENSQKRLQTLKKQYEEKLMMLQHKIRDTQLERDQVLQNLGSVESYSEEKAKKVRSEYEKKLQAMNKELQRLQAAQKEHARLLKNQSQYEKQLKKLQQDVMEMKKTKVRLMKQMKEEQEKARLTESRRNREIAQLKKDQRKRDHQLRLLEAQKRNQEVVLRRKTEEVTALRRQVRPMSDKVAGKVTRKLSSSDAPAQDTGSSAAAVETDASRTGAQQKMRIPVARVQALPTPATNGNRKKYQRKGLTGRVFISKTARMKWQLLERRVTDIIMQKMTISNMEADMNRLLKQREELTKRREKLSKRREKIVKENGEGDKNVANINEEMESLTANIDYINDSISDCQANIMQMEEAKEEGETLDVTAVINACTLTEARYLLDHFLSMGINKGLQAAQKEAQIKVLEGRLKQTEITSATQNQLLFHMLKEKAELNPELDALLGHALQDLDSVPLENVEDSTDEDAPLNSPGSEGSTLSSDLMKLCGEVKPKNKARRRTTTQMELLYADSSELASDTSTGDASLPGPLTPVAEGQEIGMNTETSGTSAREKELSPPPGLPSKIGSISRQSSLSEKKIPEPSPVTRRKAYEKAEKSKAKEQKQSDESDSSLSEVHRGIINPFPASKGIRAFPLQCIHIAEGHTKAVLCVDSTDDLLFTGSKDRTCKVWNLVTGQEIMSLGGHPNNVVSVKYCNYTSLVFTVSTSYIKVWDIRDSAKCIRTLTSSGQVTLGDACSASTSRTVAIPSGENQINQIALNPTGTFLYAASGNAVRMWDLKRFQSTGKLTGHLGPVMCLTVDQISSGQDLIITGSKDHYIKMFDVTEGALGTVSPTHNFEPPHYDGIEALTIQGDNLFSGSRDNGIKKWDLTQKDLLQQVPNAHKDWVCALGVVPDHPVLLSGCRGGILKVWNMDTFMPVGEMKGHDSPINAICVNSTHIFTAADDRTVRIWKARNLQDGQISDTGDLGEDIASN

SEQ ID NO: 44273 - protein, 655 aa, Homo sapiens
  Payload ID: 9026
  Gene Symbol: KIF21A
  Gene Name: kinesin family member 21A
  ENSP ID: ENSP00000448792
QREELTKRREKLSKRREKIVKENGEGDKNVANINEEMESLTANIDYINDSISDCQANIMQMEEAKEEGETLDVTAVINACTLTEARYLLDHFLSMGINKGLQAAQKEAQIKVLEGRLKQTEITSATQNQLLFHMLKEKAELNPELDALLGHALQENVEDSTDEDAPLNSPGSEGSTLSSDLMKLCGEVKPKNKARRRTTTQMELLYADSSELASDTSTGDASLPGPLTPVAEGQEIGMNTETSGTSAREKELSPPPGLPSKIGSISRQSSLSEKKIPEPSPVTRRKAYEKAEKSKAKEQKQGIINPFPASKGIRAFPLQCIHIAEGHTKAVLCVDSTDDLLFTGSKDRTCKVWNLVTGQEIMSLGGHPNNVVSVKYCNYTSLVFTVSTSYIKVWDIRDSAKCIRTLTSSGQVTLGDACSASTSRTVAIPSGENQINQIALNPTGTFLYAASGNAVRMWDLKRFQSTGKLTGHLGPVMCLTVDQISSGQDLIITGSKDHYIKMFDVTEGALGTVSPTHNFEPPHYDGIEALTIQGDNLFSGSRDNGIKKWDLTQKDLLQQVPNAHKDWVCALGVVPDHPVLLSGCRGGILKVWNMDTFMPVGEMKGHDSPINAICVNSTHIFTAADDRTVRIWKARNLQDGQISDTGDLGEDIASN

SEQ ID NO: 44274 - protein, 475 aa, Homo sapiens
  Payload ID: 9026
  Gene Symbol: KIF21A
  Gene Name: kinesin family member 21A
  ENSP ID: ENSP00000449698
  MOD_RES (1)..(1): Any amino acid
XRLLKNQSQYEKQLKKLQQDVMEMKKTKVRLMKQMKEEQEKARLTESRRNREIAQLKKDQRKRDHQLRLLEAQKRNQEVVLRRKTEEVTALRRQVRPMSDKVAGKVTRKLSSSDAPAQDTGSSAAAVETDASRTGAQQKMRIPVARVQALPTPATNGNRKKYQRKGLTGRVFISKTARMKWQLLERRVTDIIMQKMTISNMEADMNRLLKQREELTKRREKLSKRREKIVKENGEGDKNVANINEEMESLTANIDYINDSISDCQANIMQMEEAKEEGETLDVTAVINACTLTEARYLLDHFLSMGINKGLQAAQKEAQIKVLEGRLKQTEITSATQNQLLFHMLKEKAELNPELDALLGHALQENVEDSTDEDAPLNSPGSEGSTLSSDLMKLCGEVKPKNKARRRTTTQMELLYADSSELASDTSTGDASLPGPLTPVAEGQEIGMNTETSGTSAREKELSPPPGLPSKIGSM

SEQ ID NO: 44275 - protein, 290 aa, Homo sapiens
  Payload ID: 9026
  Gene Symbol: KIF21A
  Gene Name: kinesin family member 21A
  ENSP ID: ENSP00000449700
YTVGVTTRTVNTESESLFLPLFQMMQCLKLGALSRTTASTQMNVQSSRSHAIFTIHVCQTRVCPQIDADNATDNKIISESAQMNEFETLTAKFHFVDLAGSERLKRTGATGERAKEGISINCGLLALGNVISALGDKSKRATHVPYRDSKLTRLLQDSLGGNSQTIMIACVSPSDRDFMETLNTLKYANRARNIKNKVMVNQDRASQQINALRSEITRLQMELMEYKTGKRIIDEEGVESINDMFHENAMLQTENNNLRVRIKAMQETVDALRSRITQLVSDQANHVLAR

SEQ ID NO: 44276 - protein, 1624 aa, Homo sapiens
  Payload ID: 9027
  Gene Symbol: KIF21B
  Gene Name: kinesin family member 21B
  Uniprot ID: O75037
  ENSP ID: ENSP00000328494
MAGQGDCCVKVAVRIRPQLSKEKIEGCHICTSVTPGEPQVLLGKDKAFTYDFVFDLDTWQEQIYSTCVSKLIEGCFEGYNATVLAYGQTGAGKTYTMGTGFDMATSEEEQGIIPRAIAHLFGGIAERKRRAQEQGVAGPEFKVSAQFLELYNEEILDLFDSTRDPDTRHRRSNIKIHEDANGGIYTTGVTSRLIHSQEELIQCLKQGALSRTTASTQMNVQSSRSHAIFTIHLCQMRMCTQPDLVNEAVTGLPDGTPPSSEYETLTAKFHFVDLAGSERLKRTGATGERAKEGISINCGLLALGNVISALGDQSKKVVHVPYRDSKLTRLLQDSLGGNSQTIMIACVSPSDRDFMETLNTLKYANRARNIKNKVVVNQDKTSQQISALRAEIARLQMELMEYKAGKRVIGEDGAEGYSDLFRENAMLQKENGALRLRVKAMQEAIDAINNRVTQLMSQEANLLLAKAGDGNEAIGALIQNYIREIEELRTKLLESEAMNESLRRSLSRASARSPYSLGASPAAPAFGGSPASSMEDASEVIRRAKQDLERLKKKEVRQRRKSPEKEAFKKRAKLQQENSEETDENEAEEEEEERDESGCEEEEGREDEDEDSGSEESLVDSDSDPEEKEVNFQADLADLTCEIEIKQKLIDELENSQRRLQTLKHQYEEKLILLQNKIRDTQLERDRVLQNLSTMECYTEEKANKIKADYEKRLREMNRDLQKLQAAQKEHARLLKNQSRYERELKKLQAEVAEMKKAKVALMKQMREEQQRRRLVETKRNREIAQLKKEQRRQEFQIRALESQKRQQEMVLRRKTQEVSALRRLAKPMSERVAGRAGLKPPMLDSGAEVSASTTSSEAESGARSVSSIVRQWNRKINHFLGDHPAPTVNGTRPARKKFQKKGASQSFSKAARLKWQSLERRIIDIVMQRMTIVNLEADMERLIKKREELFLLQEALRRKRERLQAESPEEEKGLQELAEEIEVLAANIDYINDGITDCQATIVQLEETKEELDSTDTSVVISSCSLAEARLLLDNFLKASIDKGLQVAQKEAQIRLLEGRLRQTDMAGSSQNHLLLDALREKAEAHPELQALIYNVQQENGYASTDEEISEFSEGSFSQSFTMKGSTSHDDFKFKSEPKLSAQMKAVSAECLGPPLDISTKNITKSLASLVEIKEDGVGFSVRDPYYRDRVSRTVSLPTRGSTFPRQSRATETSPLTRRKSYDRGQPIRSTDVGFTPPSSPPTRPRNDRNVFSRLTSNQSQGSALDKGIISPVGGAKGARTAPLQCVSMAEGHTKPILCLDATDELLFTGSKDRSCKMWNLVTGQEIAALKGHPNNVVSIKYCSHSGLVFSVSTSYIKVWDIRDSAKCIRTLTSSGQVISGDACAATSTRAITSAQGEHQINQIALSPSGTMLYAASGNAVRIWELSRFQPVGKLTGHIGPVMCLTVTQTASQHDLVVTGSKDHYVKMFELGECVTGTIGPTHNFEPPHYDGIECLAIQGDILFSGSRDNGIKKWDLDQQELIQQIPNAHKDWVCALAFIPGRPMLLSACRAGVIKVWNVDNFTPIGEIKGHDSPINAICTNAKHIFTASSDCRVKLWNYVPGLTPCLPRRVLAIKGRATTLP

SEQ ID NO: 44277 - protein, 1610 aa, Homo sapiens
  Payload ID: 9027
  Gene Symbol: KIF21B
  Gene Name: kinesin family member 21B
  Uniprot ID: O75037
  ENSP ID: ENSP00000353724
MAGQGDCCVKVAVRIRPQLSKEKIEGCHICTSVTPGEPQVLLGKDKAFTYDFVFDLDTWQEQIYSTCVSKLIEGCFEGYNATVLAYGQTGAGKTYTMGTGFDMATSEEEQGIIPRAIAHLFGGIAERKRRAQEQGVAGPEFKVSAQFLELYNEEILDLFDSTRDPDTRHRRSNIKIHEDANGGIYTTGVTSRLIHSQEELIQCLKQGALSRTTASTQMNVQSSRSHAIFTIHLCQMRMCTQPDLVNEAVTGLPDGTPPSSEYETLTAKFHFVDLAGSERLKRTGATGERAKEGISINCGLLALGNVISALGDQSKKVVHVPYRDSKLTRLLQDSLGGNSQTIMIACVSPSDRDFMETLNTLKYANRARNIKNKVVVNQDKTSQQISALRAEIARLQMELMEYKAGKRVIGEDGAEGYSDLFRENAMLQKENGALRLRVKAMQEAIDAINNRVTQLMSQEANLLLAKAGDGNEAIGALIQNYIREIEELRTKLLESEAMNESLRRSLSRASARSPYSLGASPAAPAFGGSPASSMEDASEVIRRAKQDLERLKKKEVRQRRKSPEKEAFKKRAKLQQENSEETDENEAEEEEEERDESGCEEEEGREDEDEDSGSEESLVDSDSDPEEKEVNFQADLADLTCEIEIKQKLIDELENSQRRLQTLKHQYEEKLILLQNKIRDTQLERDRVLQNLSTMECYTEEKANKIKADYEKRLREMNRDLQKLQAAQKEHARLLKNQSRYERELKKLQAEVAEMKKAKVALMKQMREEQQRRRLVETKRNREIAQLKKEQRRQEFQIRALESQKRQQEMVLRRKTQEVSALRRLAKPMSERVAGRAGLKPPMLDSGAEVSASTTSSEAESGARSVSSIVRQWNRKINHFLGDHPAPTVNGTRPARKKFQKKGASQSFSKAARLKWQSLERRIIDIVMQRMTIVNLEADMERLIKKREELFLLQEALRRKRERLQAESPEEEKGLQELAEEIEVLAANIDYINDGITDCQATIVQLEETKEELDSTDTSVVISSCSLAEARLLLDNFLKASIDKGLQVAQKEAQIRLLEGRLRQTDMAGSSQNHLLLDALREKAEAHPELQALIYNVQQENGYASTDEEISEFSEGSFSQSFTMKGSTSHDDFKFKSEPKLSAQMKAVSAECLGPPLDISTKNITKSLASLVEIKEDGVGFSVRDPYYRDRVSRTVSLPTRGSTFPRQSRATETSPLTRRKSYDRGQPIRSTDVGFTPPSSPPTRPRNDRNVFSRLTSNQSQGSALDKGIISPVGGAKGARTAPLQCVSMAEGHTKPILCLDATDELLFTGSKDRSCKMWNLVTGQEIAALKGHPNNVVSIKYCSHSGLVFSVSTSYIKVWDIRDSAKCIRTLTSSGQVISGDACAATSTRAITSAQGEHQINQIALSPSGTMLYAASGNAVRIWELSRFQPVGKLTGHIGPVMCLTVTQTASQHDLVVTGSKDHYVKMFELGECVTGTIGPTHNFEPPHYDGIECLAIQGDILFSGSRDNGIKKWDLDQQELIQQIPNAHKDWVCALAFIPGRPMLLSACRAGVIKVWNVDNFTPIGEIKGHDSPINAICTNAKHIFTASSDLTVKFWSVRRLPHSGPP

SEQ ID NO: 44278 - protein, 1637 aa, Homo sapiens
  Payload ID: 9027
  Gene Symbol: KIF21B
  Gene Name: kinesin family member 21B
  Uniprot ID: O75037
  ENSP ID: ENSP00000411831
MAGQGDCCVKVAVRIRPQLSKEKIEGCHICTSVTPGEPQVLLGKDKAFTYDFVFDLDTWQEQIYSTCVSKLIEGCFEGYNATVLAYGQTGAGKTYTMGTGFDMATSEEEQGIIPRAIAHLFGGIAERKRRAQEQGVAGPEFKVSAQFLELYNEEILDLFDSTRDPDTRHRRSNIKIHEDANGGIYTTGVTSRLIHSQEELIQCLKQGALSRTTASTQMNVQSSRSHAIFTIHLCQMRMCTQPDLVNEAVTGLPDGTPPSSEYETLTAKFHFVDLAGSERLKRTGATGERAKEGISINCGLLALGNVISALGDQSKKVVHVPYRDSKLTRLLQDSLGGNSQTIMIACVSPSDRDFMETLNTLKYANRARNIKNKVVVNQDKTSQQISALRAEIARLQMELMEYKAGKRVIGEDGAEGYSDLFRENAMLQKENGALRLRVKAMQEAIDAINNRVTQLMSQEANLLLAKAGDGNEAIGALIQNYIREIEELRTKLLESEAMNESLRRSLSRASARSPYSLGASPAAPAFGGSPASSMEDASEVIRRAKQDLERLKKKEVRQRRKSPEKEAFKKRAKLQQENSEETDENEAEEEEEERDESGCEEEEGREDEDEDSGSEESLVDSDSDPEEKEVNFQADLADLTCEIEIKQKLIDELENSQRRLQTLKHQYEEKLILLQNKIRDTQLERDRVLQNLSTMECYTEEKANKIKADYEKRLREMNRDLQKLQAAQKEHARLLKNQSRYERELKKLQAEVAEMKKAKVALMKQMREEQQRRRLVETKRNREIAQLKKEQRRQEFQIRALESQKRQQEMVLRRKTQEVSALRRLAKPMSERVAGRAGLKPPMLDSGAEVSASTTSSEAESGARSVSSIVRQWNRKINHFLGDHPAPTVNGTRPARKKFQKKGASQSFSKAARLKWQSLERRIIDIVMQRMTIVNLEADMERLIKKREELFLLQEALRRKRERLQAESPEEEKGLQELAEEIEVLAANIDYINDGITDCQATIVQLEETKEELDSTDTSVVISSCSLAEARLLLDNFLKASIDKGLQVAQKEAQIRLLEGRLRQTDMAGSSQNHLLLDALREKAEAHPELQALIYNVQQENGYASTDEEISEFSEGSFSQSFTMKGSTSHDDFKFKSEPKLSAQMKAVSAECLGPPLDISTKNITKSLASLVEIKEDGVGFSVRDPYYRDRVSRTVSLPTRGSTFPRQSRATETSPLTRRKSYDRGQPIRSTDVGFTPPSSPPTRPRNDRNVFSRLTSNQSQGSALDKSDDSDSSLSEVLRGIISPVGGAKGARTAPLQCVSMAEGHTKPILCLDATDELLFTGSKDRSCKMWNLVTGQEIAALKGHPNNVVSIKYCSHSGLVFSVSTSYIKVWDIRDSAKCIRTLTSSGQVISGDACAATSTRAITSAQGEHQINQIALSPSGTMLYAASGNAVRIWELSRFQPVGKLTGHIGPVMCLTVTQTASQHDLVVTGSKDHYVKMFELGECVTGTIGPTHNFEPPHYDGIECLAIQGDILFSGSRDNGIKKWDLDQQELIQQIPNAHKDWVCALAFIPGRPMLLSACRAGVIKVWNVDNFTPIGEIKGHDSPINAICTNAKHIFTASSDCRVKLWNYVPGLTPCLPRRVLAIKGRATTLP

SEQ ID NO: 44279 - protein, 1623 aa, Homo sapiens
  Payload ID: 9027
  Gene Symbol: KIF21B
  Gene Name: kinesin family member 21B
  Uniprot ID: O75037
  ENSP ID: ENSP00000433808
MAGQGDCCVKVAVRIRPQLSKEKIEGCHICTSVTPGEPQVLLGKDKAFTYDFVFDLDTWQEQIYSTCVSKLIEGCFEGYNATVLAYGQTGAGKTYTMGTGFDMATSEEEQGIIPRAIAHLFGGIAERKRRAQEQGVAGPEFKVSAQFLELYNEEILDLFDSTRDPDTRHRRSNIKIHEDANGGIYTTGVTSRLIHSQEELIQCLKQGALSRTTASTQMNVQSSRSHAIFTIHLCQMRMCTQPDLVNEAVTGLPDGTPPSSEYETLTAKFHFVDLAGSERLKRTGATGERAKEGISINCGLLALGNVISALGDQSKKVVHVPYRDSKLTRLLQDSLGGNSQTIMIACVSPSDRDFMETLNTLKYANRARNIKNKVVVNQDKTSQQISALRAEIARLQMELMEYKAGKRVIGEDGAEGYSDLFRENAMLQKENGALRLRVKAMQEAIDAINNRVTQLMSQEANLLLAKAGDGNEAIGALIQNYIREIEELRTKLLESEAMNESLRRSLSRASARSPYSLGASPAAPAFGGSPASSMEDASEVIRRAKQDLERLKKKEVRQRRKSPEKEAFKKRAKLQQENSEETDENEAEEEEEERDESGCEEEEGREDEDEDSGSEESLVDSDSDPEEKEVNFQADLADLTCEIEIKQKLIDELENSQRRLQTLKHQYEEKLILLQNKIRDTQLERDRVLQNLSTMECYTEEKANKIKADYEKRLREMNRDLQKLQAAQKEHARLLKNQSRYERELKKLQAEVAEMKKAKVALMKQMREEQQRRRLVETKRNREIAQLKKEQRRQEFQIRALESQKRQQEMVLRRKTQEVSALRRLAKPMSERVAGRAGLKPPMLDSGAEVSASTTSSEAESGARSVSSIVRQWNRKINHFLGDHPAPTVNGTRPARKKFQKKGASQSFSKAARLKWQSLERRIIDIVMQRMTIVNLEADMERLIKKREELFLLQEALRRKRERLQAESPEEEKGLQELAEEIEVLAANIDYINDGITDCQATIVQLEETKEELDSTDTSVVISSCSLAEARLLLDNFLKASIDKGLQVAQKEAQIRLLEGRLRQTDMAGSSQNHLLLDALREKAEAHPELQALIYNVQQENGYASTDEEISEFSEGSFSQSFTMKGSTSHDDFKFKSEPKLSAQMKAVSAECLGPPLDISTKNITKSLASLVEIKEDGVGFSVRDPYYRDRVSRTVSLPTRGSTFPRQSRATETSPLTRRKSYDRGQPIRSTDVGFTPPSSPPTRPRNDRNVFSRLTSNQSQGSALDKSDDSDSSLSEVLRGIISPVGGAKGARTAPLQCVSMAEGHTKPILCLDATDELLFTGSKDRSCKMWNLVTGQEIAALKGHPNNVVSIKYCSHSGLVFSVSTSYIKVWDIRDSAKCIRTLTSSGQVISGDACAATSTRAITSAQGEHQINQIALSPSGTMLYAASGNAVRIWELSRFQPVGKLTGHIGPVMCLTVTQTASQHDLVVTGSKDHYVKMFELGECVTGTIGPTHNFEPPHYDGIECLAIQGDILFSGSRDNGIKKWDLDQQELIQQIPNAHKDWVCALAFIPGRPMLLSACRAGVIKVWNVDNFTPIGEIKGHDSPINAICTNAKHIFTASSDLTVKFWSVRRLPHSGPP

SEQ ID NO: 44280 - protein, 665 aa, Homo sapiens
  Payload ID: 9028
  Gene Symbol: KIF22
  Gene Name: kinesin family member 22
  Uniprot ID: Q14807
  ENSP ID: ENSP00000160827
MAAGGSTQQRRREMAAASAAAISGAGRCRLSKIGATRRPPPARVRVAVRLRPFVDGTAGASDPPCVRGMDSCSLEIANWRNHQETLKYQFDAFYGERSTQQDIYAGSVQPILRHLLEGQNASVLAYGPTGAGKTHTMLGSPEQPGVIPRALMDLLQLTREEGAEGRPWALSVTMSYLEIYQEKVLDLLDPASGDLVIREDCRGNILIPGLSQKPISSFADFERHFLPASRNRTVGATRLNQRSSRSHAVLLVKVDQRERLAPFRQREGKLYLIDLAGSEDNRRTGNKGLRLKESGAINTSLFVLGKVVDALNQGLPRVPYRDSKLTRLLQDSLGGSAHSILIANIAPERRFYLDTVSALNFAARSKEVINRPFTNESLQPHALGPVKLSQKELLGPPEAKRARGPEEEEIGSPEPMAAPASASQKLSPLQKLSSMDPAMLERLLSLDRLLASQGSQGAPLLSTPKRERMVLMKTVEEKDLEIERLKTKQKELEAKMLAQKAEEKENHCPTMLRPLSHRTVTGAKPLKKAVVMPLQLIQEQAASPNAEIHILKNKGRKRKLESLDALEPEEKAEDCWELQISPELLAHGRQKILDLLNEGSARDLRSLQRIGPKKAQLIVGWRELHGPFSQVEDLERVEGITGKQMESFLKANILGLAAGQRCGAS

SEQ ID NO: 44281 - protein, 597 aa, Homo sapiens
  Payload ID: 9028
  Gene Symbol: KIF22
  Gene Name: kinesin family member 22
  Uniprot ID: Q14807
  ENSP ID: ENSP00000383562
MDSCSLEIANWRNHQETLKYQFDAFYGERSTQQDIYAGSVQPILRHLLEGQNASVLAYGPTGAGKTHTMLGSPEQPGVIPRALMDLLQLTREEGAEGRPWALSVTMSYLEIYQEKVLDLLDPASGDLVIREDCRGNILIPGLSQKPISSFADFERHFLPASRNRTVGATRLNQRSSRSHAVLLVKVDQRERLAPFRQREGKLYLIDLAGSEDNRRTGNKGLRLKESGAINTSLFVLGKVVDALNQGLPRVPYRDSKLTRLLQDSLGGSAHSILIANIAPERRFYLDTVSALNFAARSKEVINRPFTNESLQPHALGPVKLSQKELLGPPEAKRARGPEEEEIGSPEPMAAPASASQKLSPLQKLSSMDPAMLERLLSLDRLLASQGSQGAPLLSTPKRERMVLMKTVEEKDLEIERLKTKQKELEAKMLAQKAEEKENHCPTMLRPLSHRTVTGAKPLKKAVVMPLQLIQEQAASPNAEIHILKNKGRKRKLESLDALEPEEKAEDCWELQISPELLAHGRQKILDLLNEGSARDLRSLQRIGPKKAQLIVGWRELHGPFSQVEDLERVEGITGKQMESFLKANILGLAAGQRCGAS

SEQ ID NO: 44282 - protein, 597 aa, Homo sapiens; identical to SEQ ID NO: 44281
  Payload ID: 9028
  Gene Symbol: KIF22
  Gene Name: kinesin family member 22
  Uniprot ID: Q14807
  ENSP ID: ENSP00000454957

SEQ ID NO: 44283 - protein, 89 aa, Homo sapiens
  Payload ID: 9028
  Gene Symbol: KIF22
  Gene Name: kinesin family member 22
  ENSP ID: ENSP00000455702
MAAGGSTQQRRREMAAASAAAISGAGRCRLSKIGATRRPPPARVRVAVRLRPFVDGTAGASDPPCVRGMDSCSLEIANWRNHQETLKYQ

SEQ ID NO: 44284 - protein, 611 aa, Homo sapiens
  Payload ID: 9028
  Gene Symbol: KIF22
  Gene Name: kinesin family member 22
  ENSP ID: ENSP00000456165
MDSCSLEIANWRNHQETLKYQFDAFYGERSTQQDIYAGSVQPILRHLLEGQNASVLAYGPTGAGKTHTMLGSPEQPGVIPRALMDLLQLTREEGAEGRPWALSVTMSYLEIYQEKVLDLLDPASGDLVIREDCRGNILIPGLSQKPISSFADFERHFLPASRNRTVGATRLNQRSSRSHAVLLVKVDQRERLAPFRQREGKLYLIDLAGSEDNRRTGNKGLRLKESGAINTSLFVLGKVVDALNQGLPRVPYRDSKLTRLLQDSLGGSAHSILIANIAPERRFYLDTVSALNFAARSKEVINRPFTNESLQPHALGPVKLSQKELLGPPEAKRARGPEEEEIGSPEPMAAPASASQKLSPLQKLSSMDPAMLERLLSLDRLLASQGSQGAPLLSTPKRERMVLMKTVEEKDLEIERLKTKQKELEAKMLAQKAEEKENHCPTMLRPLSHRTVTGAKPLKKAVVMPLQLIQEQAASPNAEIHILKNKGRKRKVKVAGGLGYTWSPELESLDALEPEEKAEDCWELQISPELLAHGRQKILDLLNEGSARDLRSLQRIGPKKAQLIVGWRELHGPFSQVEDLERVEGITGKQMESFLKANILGLAAGQRCGAS

SEQ ID NO: 44285 - protein, 185 aa, Homo sapiens
  Payload ID: 9028
  Gene Symbol: KIF22
  Gene Name: kinesin family member 22
  ENSP ID: ENSP00000457176
MDSCSLEIANWRNHQETLKYQFDAFYGERSTQQDIYAGSVQPILRHLLEGQNASVLAYGPTGAGKTHTMLGSPEQPGVIPRALMDLLQLTREEGAEGRPWALSVTMSYLEIYQEKVLDLLDPASGDLVIREDCRGNILIPGLSQKPISSFADFERHFLPASRNRTVGATRLNQRSSRSHAVLLVK

SEQ ID NO: 44286 - protein, 72 aa, Homo sapiens
  Payload ID: 9028
  Gene Symbol: KIF22
  Gene Name: kinesin family member 22
  ENSP ID: ENSP00000460077
AEEKENHCPTMLRPLSHRTVTGAKPLKKAVVMPLQLIQEQAASPNAEIHILKNKGRKRKQLHEKGANITTGY

SEQ ID NO: 44287 - protein, 960 aa, Homo sapiens
  Payload ID: 9029
  Gene Symbol: KIF23
  Gene Name: kinesin family member 23
  Uniprot ID: Q02241
  ENSP ID: ENSP00000260363
MKSARAKTPRKPTVKKGSQTNLKDPVGVYCRVRPLGFPDQECCIEVINNTTVQLHTPEGYRLNRNGDYKETQYSFKQVFGTHTTQKELFDVVANPLVNDLIHGKNGLLFTYGVTGSGKTHTMTGSPGEGGLLPRCLDMIFNSIGSFQAKRYVFKSNDRNSMDIQCEVDALLERQKREAMPNPKTSSSKRQVDPEFADMITVQEFCKAEEVDEDSVYGVFVSYIEIYNNYIYDLLEEVPFDPIKPKPPQSKLLREDKNHNMYVAGCTEVEVKSTEEAFEVFWRGQKKRRIANTHLNRESSRSHSVFNIKLVQAPLDADGDNVLQEKEQITISQLSLVDLAGSERTNRTRAEGNRLREAGNINQSLMTLRTCMDVLRENQMYGTNKMVPYRDSKLTHLFKNYFDGEGKVRMIVCVNPKAEDYEENLQVMRFAEVTQEVEVARPVDKAICGLTPGRRYRNQPRGPVGNEPLVTDVVLQSFPPLPSCEILDINDEQTLPRLIEALEKRHNLRQMMIDEFNKQSNAFKALLQEFDNAVLSKENHMQGKLNEKEKMISGQKLEIERLEKKNKTLEYKIEILEKTTTIYEEDKRNLQQELETQNQKLQRQFSDKRRLEARLQGMVTETTMKWEKECERRVAAKQLEMQNKLWVKDEKLKQLKAIVTEPKTEKPERPSRERDREKVTQRSVSPSPVPLSSNYIAQISNGQQLMSQPQLHRRSNSCSSISVASCISEWEQKIPTYNTPLKVTSIARRRQQEPGQSKTCIVSDRRRGMYWTEGREVVPTFRNEIEIEEDHCGRLLFQPDQNAPPIRLRHRRSRSAGDRWVDHKPASNMQTETVMQPHVPHAITVSVANEKALAKCEKYMLTHQELASDGEIETKLIKGDIYKTRGGGQSVQFTDIETLKQESPNGSRKRRSSTVAPAQPDGAESEWTDVETRCSVAVEMRAGSQLGPGYQHHAQPKRKKP

SEQ ID NO: 44288 - protein, 856 aa, Homo sapiens
  Payload ID: 9029
  Gene Symbol: KIF23
  Gene Name: kinesin family member 23
  Uniprot ID: Q02241
  ENSP ID: ENSP00000304978
MKSARAKTPRKPTVKKGSQTNLKDPVGVYCRVRPLGFPDQECCIEVINNTTVQLHTPEGYRLNRNGDYKETQYSFKQVFGTHTTQKELFDVVANPLVNDLIHGKNGLLFTYGVTGSGKTHTMTGSPGEGGLLPRCLDMIFNSIGSFQAKRYVFKSNDRNSMDIQCEVDALLERQKREAMPNPKTSSSKRQVDPEFADMITVQEFCKAEEVDEDSVYGVFVSYIEIYNNYIYDLLEEVPFDPIKPKPPQSKLLREDKNHNMYVAGCTEVEVKSTEEAFEVFWRGQKKRRIANTHLNRESSRSHSVFNIKLVQAPLDADGDNVLQEKEQITISQLSLVDLAGSERTNRTRAEGNRLREAGNINQSLMTLRTCMDVLRENQMYGTNKMVPYRDSKLTHLFKNYFDGEGKVRMIVCVNPKAEDYEENLQVMRFAEVTQEVEVARPVDKAICGLTPGRRYRNQPRGPVGNEPLVTDVVLQSFPPLPSCEILDINDEQTLPRLIEALEKRHNLRQMMIDEFNKQSNAFKALLQEFDNAVLSKENHMQGKLNEKEKMISGQKLEIERLEKKNKTLEYKIEILEKTTTIYEEDKRNLQQELETQNQKLQRQFSDKRRLEARLQGMVTETTMKWEKECERRVAAKQLEMQNKLWVKDEKLKQLKAIVTEPKTEKPERPSRERDREKVTQRSVSPSPVPLLFQPDQNAPPIRLRHRRSRSAGDRWVDHKPASNMQTETVMQPHVPHAITVSVANEKALAKCEKYMLTHQELASDGEIETKLIKGDIYKTRGGGQSVQFTDIETLKQESPNGSRKRRSSTVAPAQPDGAESEWTDVETRCSVAVEMRAGSQLGPGYQHHAQPKRKKP

SEQ ID NO: 44289 - protein, 952 aa, Homo sapiens
  Payload ID: 9029
  Gene Symbol: KIF23
  Gene Name: kinesin family member 23
  ENSP ID: ENSP00000378790
MKSARAKTPRKPTVKKGSQTNLKDPVGVYCRVRPLGFPDQECCIEVINNTTVQLHTPEGYRLNRNGDYKETQYSFKQVFGTHTTQKELFDVVANPLVNDLIHGKNGLLFTYGVTGSGKTHTMTGSPGEGGLLPRCLDMIFNSIGSFQAKRYVFKSNDRNSMDIQCEVDALLERQKREAMPNPKTSSSKRQVDPEFADMITVQEFCKAEEVDEDSVYGVFVSYIEIYNNYIYDLLEEVPFDPIKPKPPQSKLLREDKNHNMYVAGCTEVEVKSTEEAFEVFWRGQKKRRIANTHLNRESSRSHSVFNIKLVQAPLDADGDNVLQEKEQITISQLSLVDLAGSERTNRTRAEGNRLREAGNINQSLMTLRTCMDVLRENQMYGTNKMVPYRDSKLTHLFKNYFDGEGKVRMIVCVNPKAEDYEENLQVMRFAEVTQEVEVARPVDKAICGLTPGRRYRNQPRGPVGNEPLVTDVVLQSFPPLPSCEILDINDEQTLPRLIEALEKRHNLRQMMIDEFNKQSNAFKALLQEFDNAVLSKENHMQGKLNEKEKMISGQKLEIERLEKKNKTLEYKIEILEKTTTIYEEDKRNLQQELETQNQKLQRQFSDKRRLEARLQGMVTETTMKWEKECERRVAAKQLEMQNKLWVKDEKLKQLKAIVTEPKTEKPERPSRERDREKVTQRSVSPSPVPLSSNYIAQISNGQQLMSQPQLHRRSNSCSSISVASCISEWEQKIPTYNTPLKVTSIARRRQQEPGQSKTCIVSDRRRGMYWTEGREVVPTFRNEIEIEEDHCGRNAPPIRLRHRRSRSAGDRWVDHKPASNMQTETVMQPHVPHAITVSVANEKALAKCEKYMLTHQELASDGEIETKLIKGDIYKTRGGGQSVQFTDIETLKQESPNGRKRRSSTVAPAQPDGAESEWTDVETRCSVAVEMRAGSQLGPGYQHHAQPKRKKP

SEQ ID NO: 44290 - protein, 267 aa, Homo sapiens
  Payload ID: 9029
  Gene Symbol: KIF23
  Gene Name: kinesin family member 23
  ENSP ID: ENSP00000452901
MITVQEFCKAEEVDEDSVYGVFVSYIEIYNNYIYDLLEEVPFDPIKPKPPQSKLLREDKNHNMYVAGCTEVEVKSTEEAFEVFWRGQKKRRIANTHLNRESSRSHSVFNIKLVQAPLDADGDNVLQEKEQITISQLSLVDLAGSERTNRTRAEGNRLREAGNINQSLMTLRTCMDVLRENQMYGTNKMVPYRDSKLTHLFKNYFDGEGKVRMIVCVNPKAEDYEENLVILIFAEVTQEVEVARPVDKAICGLTPGRRYRNQPRGPVG

SEQ ID NO: 44291 - protein, 673 aa, Homo sapiens
  Payload ID: 9029
  Gene Symbol: KIF23
  Gene Name: kinesin family member 23
  Uniprot ID: Q02241
  ENSP ID: ENSP00000453102
MITVQEFCKAEEVDEDSVYGVFVSYIEIYNNYIYDLLEEVPFDPIKPKWNSCSTPMRNTDFVPPQSKLLREDKNHNMYVAGCTEVEVKSTEEAFEVFWRGQKKRRIANTHLNRESSRSHSVFNIKLVQAPLDADGDNVLQEKEQITISQLSLVDLAGSERTNRTRAEGNRLREAGNINQSLMTLRTCMDVLRENQMYGTNKMVPYRDSKLTHLFKNYFDGEGKVRMIVCVNPKAEDYEENLQVMRFAEVTQEVEVARPVDKAICGLTPGRRYRNQPRGPVGNEPLVTDVVLQSFPPLPSCEILDINDEQTLPRLIEALEKRHNLRQMMIDEFNKQSNAFKALLQEFDNAVLSKENHMQGKLNEKEKMISGQKLEIERLEKKNKTLEYKIEILEKTTTIYEEDKRNLQQELETQNQKLQRQFSDKRRLEARLQGMVTETTMKWEKECERRVAAKQLEMQNKLWVKDEKLKQLKAIVTEPKTEKPERPSRERDREKVTQRSVSPSPVPLLFQPDQNAPPIRLRHRRSRSAGDRWVDHKPASNMQTETVMQPHVPHAITVSVANEKALAKCEKYMLTHQELASDGEIETKLIKGDIYKTRGGGQSVQFTDIETLKQESPNGSRKRRSSTVAPAQPDGAESEWTDVETRCSVAVEMRAGSQLGPGYQHHAQPKRKKP

SEQ ID NO: 44292 - protein, 856 aa, Homo sapiens; identical to SEQ ID NO: 44288
  Payload ID: 9029
  Gene Symbol: KIF23
  Gene Name: kinesin family member 23
  Uniprot ID: Q02241
  ENSP ID: ENSP00000453386

SEQ ID NO: 44293 - protein, 371 aa, Homo sapiens
  Payload ID: 9029
  Gene Symbol: KIF23
  Gene Name: kinesin family member 23
  ENSP ID: ENSP00000453576
MKSARAKTPRKPTVKKGSQTNLKDPVGVYCRVRPLGFPDQECCIEVINNTTVQLHTPEGYRLNRNGDYKETQYSFKQVFGTHTTQKELFDVVANPLVNDLIHGKNGLLFTYGVTGSGKTHTMTGSPGEGGLLPRCLDMIFNSIGSFQAKRYVFKSNDRNSMDIQCEVDALLERQKREAMPNPKTSSSKRQVDPEFADMITVQEFCKAEEVDEDSVYGVFVSYIEIYNNYIYDLLEEVPFDPIKPKWNSCSTPMRNTDFVPPQSKLLREDKNHNMYVAGCTEVEVKSTEEAFEVFWRGQKKRRIANTHLNRESSRSHSVFNIKLVQAPLDADGDNVLQFWEAGYRILEPEFCCEKSLQIFKNPFGRSDKIRL

SEQ ID NO: 44294 - protein, 109 aa, Homo sapiens
  Payload ID: 9029
  Gene Symbol: KIF23
  Gene Name: kinesin family member 23
  ENSP ID: ENSP00000453629
MKSARAKTPRKPTVKKGSQTNLKDPVGVYCRVRPLGFPDQECCIEVINNTTVQLHTPEGYRLNRNGDYKETQYSFKQVFGTHTTQKELFDVVANPLVNDLIHGKNGFQI

SEQ ID NO: 44295 - protein, 1368 aa, Homo sapiens
  Payload ID: 9030
  Gene Symbol: KIF24
  Gene Name: kinesin family member 24
  Uniprot ID: Q5T7B8
  ENSP ID: ENSP00000368464
MASWLYECLCEAELAQYYSHFTALGLQKIDELAKITMKDYSKLGVHDMNDRKRLFQLIKIIKIMQEEDKAVSIPERHLQTSSLRIKSQELRSGPRRQLNFDSPADNKDRNASNDGFEMCSLSDFSANEQKSTYLKVLEHMLPDDSQYHTKTGILNATAGDSYVQTEISTSLFSPNYLSAILGDCDIPIIQRISHVSGYNYGIPHSCIRQNTSEKQNPWTEMEKIRVCVRKRPLGMREVRRGEINIITVEDKETLLVHEKKEAVDLTQYILQHVFYFDEVFGEACTNQDVYMKTTHPLIQHIFNGGNATCFAYGQTGAGKTYTMIGTHENPGLYALAAKDIFRQLEVSQPRKHLFVWISFYEIYCGQLYDLLNRRKRLFAREDSKHMVQIVGLQELQVDSVELLLEVILKGSKERSTGATGVNADSSRSHAVIQIQIKDSAKRTFGRISFIDLAGSERAADARDSDRQTKMEGAEINQSLLALKECIRALDQEHTHTPFRQSKLTQVLKDSFIGNAKTCMIANISPSHVATEHTLNTLRYADRVKELKKGIKCCTSVTSRNRTSGNSSPKRIQSSPGALSEDKCSPKKVKLGFQQSLTVAAPGSTRGKVHPLTSHPPNIPFTSAPKVSGKRGGSRGSPSQEWVIHASPVKGTVRSGHVAKKKPEESAPLCSEKNRMGNKTVLGWESRASGPGEGLVRGKLSTKCKKVQTVQPVQKQLVSRVELSFGNAHHRAEYSQDSQRGTPARPASEAWTNIPPHQKEREEHLRFYHQQFQQPPLLQQKLKYQPLKRSLRQYRPPEGQLTNETPPLFHSYSENHDGAQVEELDDSDFSEDSFSHISSQRATKQRNTLENSEDSFFLHQTWGQGPEKQVAERQQSLFSSPRTGDKKDLTKSWVDSRDPINHRRAALDHSCSPSKGPVDWSRENSTSSGPSPRDSLAEKPYCSQVDFIYRQERGGGSSFDLRKDASQSEVSGENEGNLPSPEEDGFTISLSHVAVPGSPDQRDTVTTPLREVSADGPIQVTSTVKNGHAVPGEDPRGQLGTHAEYASGLMSPLTMSLLENPDNEGSPPSEQLVQDGATHSLVAESTGGPVVSHTVPSGDQEAALPVSSATRHLWLSSSPPDNKPGGDLPALSPSPIRQHPADKLPSREADLGEACQSRETVLFSHEHMGSEQYDADAEETGLDGSWGFPGKPFTTIHMGVPHSGPTLTPRTGSSDVADQLWAQERKHPTRLGWQEFGLSTDPIKLPCNSENVTWLKPRPISRCLARPSSPLVPSCSPKTAGTLRQPTLEQAQQVVIRAHQEQLDEMAELGFKEETLMSQLASNDFEDFVTQLDEIMVLKSKCIQSLRSQLQLYLTCHGPTAAPEGTVPS

SEQ ID NO: 44296 - protein, 1234 aa, Homo sapiens
  Payload ID: 9030
  Gene Symbol: KIF24
  Gene Name: kinesin family member 24
  Uniprot ID: Q5T7B8
  ENSP ID: ENSP00000368472
MASWLYECLCEAELAQYYSHFTALGLQKIDELAKITMKDYSKLGVHDMNDRKRLFQLIKIIKIMQEEDKAVSIPERHLQTSSLRIKSQELRSGPRRQLNFDSPADNKDRNASNDGFEMCSLSDFSANEQKSTYLKVLEHMLPDDSQYHTKTGILNATAGDSYVQTEISTSLFSPNYLSAILGDCDIPIIQRISHVSGYNYGIPHSCIRQNTSEKQNPWTEMEKIRVCVRKRPLGMREVRRGEINIITVEDKETLLVHEKKEAVDLTQYILQVILKGSKERSTGATGVNADSSRSHAVIQIQIKDSAKRTFGRISFIDLAGSERAADARDSDRQTKMEGAEINQSLLALKECIRALDQEHTHTPFRQSKLTQVLKDSFIGNAKTCMIANISPSHVATEHTLNTLRYADRVKELKKGIKCCTSVTSRNRTSGNSSPKRIQSSPGALSEDKCSPKKVKLGFQQSLTVAAPGSTRGKVHPLTSHPPNIPFTSAPKVSGKRGGSRGSPSQEWVIHASPVKGTVRSGHVAKKKPEESAPLCSEKNRMGNKTVLGWESRASGPGEGLVRGKLSTKCKKVQTVQPVQKQLVSRVELSFGNAHHRAEYSQDSQRGTPARPASEAWTNIPPHQKEREEHLRFYHQQFQQPPLLQQKLKYQPLKRSLRQYRPPEGQLTNETPPLFHSYSENHDGAQVEELDDSDFSEDSFSHISSQRATKQRNTLENSEDSFFLHQTWGQGPEKQVAERQQSLFSSPRTGDKKDLTKSWVDSRDPINHRRAALDHSCSPSKGPVDWSRENSTSSGPSPRDSLAEKPYCSQVDFIYRQERGGGSSFDLRKDASQSEVSGENEGNLPSPEEDGFTISLSHVAVPGSPDQRDTVTTPLREVSADGPIQVTSTVKNGHAVPGEDPRGQLGTHAEYASGLMSPLTMSLLENPDNEGSPPSEQLVQDGATHSLVAESTGGPVVSHTVPSGDQEAALPVSSATRHLWLSSSPPDNKPGGDLPALSPSPIRQHPADKLPSREADLGEACQSRETVLFSHEHMGSEQYDADAEETGLDGSWGFPGKPFTTIHMGVPHSGPTLTPRTGSSDVADQLWAQERKHPTRLGWQEFGLSTDPIKLPCNSENVTWLKPRPISRCLARPSSPLVPSCSPKTAGTLRQPTLEQAQQVVIRAHQEQLDEMAELGFKEETLMSQLASNDFEDFVTQLDEIMVLKSKCIQSLRSQLQLYLTCHGPTAAPEGTVPS

SEQ ID NO: 44297 - protein, 1368 aa, Homo sapiens; identical to SEQ ID NO: 44295
  Payload ID: 9030
  Gene Symbol: KIF24
  Gene Name: kinesin family member 24
  Uniprot ID: Q5T7B8
  ENSP ID: ENSP00000384433

SEQ ID NO: 44298 - protein, 332 aa, Homo sapiens
  Payload ID: 9031
  Gene Symbol: KIF25
  Gene Name: kinesin family member 25
  Uniprot ID: Q9UIL4
  ENSP ID: ENSP00000252688
MTWTSGQLQREKQARPGSGAVLAFPDDKDLRVYGPAESQSAVFGDVCPLLTSLLDGYNVCVMAYGQTGSGKSYTMLGRHSDDGPVLPLDPQSDLGIIPRVAEELFRLILENTSRSPKVEVSIVEVYNNDIFDLLAKDSIAAVSGVKREVVTAKDGRTEVALLASEAVGSASKLMELVHGGLQLRAKHPTLVHADSSRSHLIITVTLTTASCSDSTADQACSATLPREQTEAGRAGRSRRASQGALAPQLVPGNPAGHAEQVQARLQLVDSAGSECVGGDAKLLVILCISPSQRHLAQTLQGLGFGIRARQVQRGPARKKPPSSQTEGKRRPD

SEQ ID NO: 44299 - protein, 384 aa, Homo sapiens
  Payload ID: 9031
  Gene Symbol: KIF25
  Gene Name: kinesin family member 25
  Uniprot ID: Q9UIL4
  ENSP ID: ENSP00000346401
MTWTSGQLQREKQARPGSGAVLAFPDDKDLRVYGPAESQSAVFGDVCPLLTSLLDGYNVCVMAYGQTGSGKSYTMLGRHSDDGPVLPLDPQSDLGIIPRVAEELFRLILENTSRSPKVEVSIVEVYNNDIFDLLAKDSIAAVSGVKREVVTAKDGRTEVALLASEAVGSASKLMELVHGGLQLRAKHPTLVHADSSRSHLIITVTLTTASCSDSTADQACSATLPREQTEAGRAGRSRRASQGALAPQLVPGNPAGHAEQVQARLQLVDSAGSECVGVSGVTGLALREMACISRSLAALAGVLGALLEHRGHAPYRNSRLTHLLQDCLGGDAKLLVILCISPSQRHLAQTLQGLGFGIRARQVQRGPARKKPPSSQTEGKRRPD

SEQ ID NO: 44300 - protein, 384 aa, Homo sapiens; identical to SEQ ID NO: 44299
  Payload ID: 9031
  Gene Symbol: KIF25
  Gene Name: kinesin family member 25
  Uniprot ID: Q9UIL4
  ENSP ID: ENSP00000388878

SEQ ID NO: 44301 - protein, 14 aa, Homo sapiens
  Payload ID: 9031
  Gene Symbol: KIF25
  Gene Name: kinesin family member 25
  ENSP ID: ENSP00000427464
  MOD_RES (1)..(1): Any amino acid
XIIPRVAEELFRAQ

SEQ ID NO: 44302 - protein, 1743 aa, Homo sapiens
  Payload ID: 9032
  Gene Symbol: KIF26A
  Gene Name: kinesin family member 26A
  ENSP ID: ENSP00000325452
MHLLQAPASHEDLDAPHGGPSLAPPSTTTSSRDTPGPAGPAGRQPGRAGPDRTKGLAWSPGPSVQVSVAPAGLGGALSTVTIQAQQCLEGMWSVSRVNSFLPPACLAEAAVAAVAVADTVRECPPVAGPDGLSKAWGRGGVCTSALVTPTPGSVGGSTGPSAAASFFIRAMQKLSLASKRKKPHPPPPPATRGTSTYPTDFSGVLQLWPPPAPPCLLRAASKTKDNPGSIGKVKVMLRIWPAQGAQRSAEAMSFLKVDPRKKQVILYDPAAGPPGSAGPRRAATAAVPKMFAFDAVFPQDSEQAEVCSGTVADVLQSVVSGADGCIFSFGHMSLGKSYTMIGKDSSPQSLGIVPCAISWLFRLIEERRERTGTRFSVRVSAVEVCGRDQSLRDLLAEVAPGSLQDTQSPGVYLREDPVCGAQLQNQSELRAPTAEKAAFYLDAALAARSTSRAGCGEDARRSSHMLFTLHVYQYRMEKCGRGGMSGGRSRLHLIDLGSCEAAAGRAGEAAGGPLCLSLSALGSVILALVNGAKHVPYRDHRLTMLLRESLATAGCRTTMIAHVSDAPAQHAETLSTVQLAARIHRLRRKKAKYASSSSGGESSCEEGRARRPPHLRPFHPRTVALDPDRTPPCLPGDPDYSSSSEQSCDTVIYVGPGGAALSDRELTDNEGPPDFVPIIPALSRHRPSKGPRDADHFRCSTFAELQERLECMDGNEGPSGGPGGTDGAQASPARGGRKPSPPEAASPRKAVGTPMAASTPRGSSGPDTHQGTPEPCKAIVWGDQREDSSAWPELLVPEKAAVSGGRRPLPSPAPPPPQLLEACRAPEEPGGGGTDGVARTPPVGMSGQVAGSPMLPGATCPRLAAGSRCPERGLLTTTVTLQRPVELNGEDELVFTVVEELSLGALAGAGRPTSLASFDSDCSLRALASGSRPVSIISSINDEFDAYTSQAPEGGPLEGAAWAGSSHGSSISSWLSEVSVCTADSRDPTPQPRFSPDSLAGLDPGGPPALDGSLGDGSSGFLGPDRPDSPGPTWGPCPGEVAAVAPSRPGREPQAGPSRWASAAQTIHSSLPRKPRTASATTRVGCARLGQSPPGRGGLFEDPWLLRVGECDTQAASAGRAPSPTLGSPRLPEAQVMLACAQRVVDGCEVAARAARRPEAVARIPPLRRGATTLGVTTPAVSWGDAPTEVVACSGSLKASPTSKKGLAPKAGFLPRPSGAAPPAPPTRKSSLEQRSSPASAPPHAVNPARVGAAAVLRGEEEPRPSSRADHSVPRATSSLKARASKVEAAHRLAGHASLERYEGLAHSSSKGREAPGRPPRAVPKLGVPPSSPTHGPAPACRSGAAKAVGAPKPPVGGGKGRGLVAGGSRALGPSVKLSTASVTGRSPGGPVAGPRAAPRAGPSVGAKAGRGTVMGTKQALRAAHSRVHELSASGAPGRGGSSWGSADSDSGHDSGVNVGEERPPTGPALPSPYSKVTAPRRPQRYSSGHGSDNSSVLSGELPPAMGRTALFHHSGGSSGYESLRRDSEATGSASSAPDSMSESGAASPGARTRSLKSPKKRATGLQRRRLIPAPLPDTTALGRKPSLPGQWVDLPPPLAGSLKEPFEIKVYEIDDVERLQRPRPTPREAPTQGLACVSTRLRLAERRQQRLREVQAKHKHLCEELAETQGRLMLEPGRWLEQFEVDPELEPESAEYLAALERATAALEQCVNLCKAHVMMVTCFDISVAASAAIPGPQEVDV

SEQ ID NO: 44303 - protein, 1882 aa, Homo sapiens
  Payload ID: 9032
  Gene Symbol: KIF26A
  Gene Name: kinesin family member 26A
  Uniprot ID: Q9ULI4
  ENSP ID: ENSP00000388241
MVGRGVPLCAAQPAVAEGGPAREPPPLLEVSPRKRLPAGPDQDPCGSRPAPEGAGAGPEQGHSAGGGGWCRHCHTKLVELKRQAWKLVSGPGTTLRDPCLSALLLDKLPAPGALPACRPEAERRCDVCATHLQQLTREAMHLLQAPASHEDLDAPHGGPSLAPPSTTTSSRDTPGPAGPAGRQPGRAGPDRTKGLAWSPGPSVQVSVAPAGLGGALSTVTIQAQQCLEGMWSVSRVNSFLPPACLAEAAVAAVAVADTVRECPPVAGPDGLSKAWGRGGVCTSALVTPTPGSVGGSTGPSAAASFFIRAMQKLSLASKRKKPHPPPPPATRGTSTYPTDFSGVLQLWPPPAPPCLLRAASKTKDNPGSIGKVKVMLRIWPAQGAQRSAEAMSFLKVDPRKKQVILYDPAAGPPGSAGPRRAATAAVPKMFAFDAVFPQDSEQAEVCSGTVADVLQSVVSGADGCIFSFGHMSLGKSYTMIGKDSSPQSLGIVPCAISWLFRLIEERRERTGTRFSVRVSAVEVCGRDQSLRDLLAEVAPGSLQDTQSPGVYLREDPVCGAQLQNQSELRAPTAEKAAFYLDAALAARSTSRAGCGEDARRSSHMLFTLHVYQYRMEKCGRGGMSGGRSRLHLIDLGSCEAAAGRAGEAAGGPLCLSLSALGSVILALVNGAKHVPYRDHRLTMLLRESLATAGCRTTMIAHVSDAPAQHAETLSTVQLAARIHRLRRKKAKYASSSSGGESSCEEGRARRPPHLRPFHPRTVALDPDRTPPCLPGDPDYSSSSEQSCDTVIYVGPGGAALSDRELTDNEGPPDFVPIIPALSRHRPSKGPRDADHFRCSTFAELQERLECMDGNEGPSGGPGGTDGAQASPARGGRKPSPPEAASPRKAVGTPMAASTPRGSSGPDTHQGTPEPCKAIVWGDQREDSSAWPELLVPEKAAVSGGRRPLPSPAPPPPQLLEACRAPEEPGGGGTDGVARTPPVGMSGQVAGSPMLPGATCPRLAAGSRCPERGLLTTTVTLQRPVELNGEDELVFTVVEELSLGALAGAGRPTSLASFDSDCSLRALASGSRPVSIISSINDEFDAYTSQAPEGGPLEGAAWAGSSHGSSISSWLSEVSVCTADSRDPTPQPRFSPDSLAGLDPGGPPALDGSLGDGSSGFLGPDRPDSPGPTWGPCPGEVAAVAPSRPGREPQAGPSRWASAAQTIHSSLPRKPRTASATTRVGCARLGQSPPGRGGLFEDPWLLRVGECDTQAASAGRAPSPTLGSPRLPEAQVMLACAQRVVDGCEVAARAARRPEAVARIPPLRRGATTLGVTTPAVSWGDAPTEVVACSGSLKASPTSKKGLAPKAGFLPRPSGAAPPAPPTRKSSLEQRSSPASAPPHAVNPARVGAAAVLRGEEEPRPSSRADHSVPRATSSLKARASKVEAAHRLAGHASLERYEGLAHSSSKGREAPGRPPRAVPKLGVPPSSPTHGPAPACRSGAAKAVGAPKPPVGGGKGRGLVAGGSRALGPSVKLSTASVTGRSPGGPVAGPRAAPRAGPSVGAKAGRGTVMGTKQALRAAHSRVHELSASGAPGRGGSSWGSADSDSGHDSGVNVGEERPPTGPALPSPYSKVTAPRRPQRYSSGHGSDNSSVLSGELPPAMGRTALFHHSGGSSGYESLRRDSEATGSASSAPDSMSESGAASPGARTRSLKSPKKRATGLQRRRLIPAPLPDTTALGRKPSLPGQWVDLPPPLAGSLKEPFEIKVYEIDDVERLQRPRPTPREAPTQGLACVSTRLRLAERRQQRLREVQAKHKHLCEELAETQGRLMLEPGRWLEQFEVDPELEPESAEYLAALERATAALEQCVNLCKAHVMMVTCFDISVAASAAIPGPQEVDV

SEQ ID NO: 44304 - protein, 1727 aa, Homo sapiens
  Payload ID: 9033
  Gene Symbol: KIF26B
  Gene Name: kinesin family member 26B
  ENSP ID: ENSP00000355475
MMMDWKAVAAQKLNLSSKKKKHRPSTSSAAEPPLFATSFSGILQTSPPPAPPCLLRAVNKVKDTPGLGKVKVMLRICSTLARDTSESSSFLKVDPRKKQITLYDPLTCGGQNAFQKRGNQVPPKMFAFDAVFPQDASQAEVCAGTVAEVIQSVVNGADGCVFCFGHAKLGKSYTMIGKDDSMQNLGIIPCAISWLFKLINERKEKTGARFSVRVSAVEVWGKEENLRDLLSEVATGSLQDGQSPGVYLCEDPICGTQLQNQSELRAPTAEKAAFFLDAAIASRRSHQQDCDEDDHRNSHVFFTLHIYQYRMEKSGKGGMSGGRSRLHLIDLGSCVKALSKNREGGSGLCLSLSALGNVILALVNGSKHIPYKESKLAMLLRESLGNMNCRTTMIAHISAAVGSYAETLSTIQIASRVLRMKKKKTKYTSSSSGGESSCEEGRMRRPTQLRPFHTRATVDPDFPIAHLSSDPDYSSSSEQSCDTVIYIGPNGTALSDKELTDNEGPPDFVPIVPALQKTRGDSRPAEAGEAAAGKSERDCLKCNTFAELQERLDCIDGSEEPSSFPFEELPAQFGPEQASRGPRLSQAAGASPLSESDKEDNGSEGQLTNREGPELPASKMQRSHSPVPAAAPAHSPSPASPRSVPGSSSQHSASPLVQSPSLQSSRESLNSCGFVEGKPRPMGSPRLGIASLSKTSEYKPPSSPSQRCKVYTQKGVLPSPAPLPPSSKDSGVASRESLLQPEVRTPPVGMSPQVLKKSMSAGSEGFPETPVDDEQQAATPSESKKEILSTTMVTVQQPLELNGEDELVFTLVEELTISGVLDSGRPTSIISFNSDCSARALASGSRPVSIISSISEDLECYSSTAPVSEVSITQFLPLPKMSLDEKAQDAGSRRSSISSWLSEMSAGSEGEQSCHSFIAQTCFGHGEAMAEPVASEFVSSLQNTAVVCREKPKASPDNLLILSEMGDDSFNKAAPIKGCKISTVSKAMVTISNTANLSSCEGYIPMKTNITVYPCIAMSPRNIQEPEAPTATPKAGPTLAQSRESKENSAKKEMKFEDPWLKREEEVKKETAHPNEEGMMRCETATGPSNAETRAEQEQDGKPSPGDRLSSSSGEVSASPVTDNFRRVVDGCEMALPGLATQSPVHPNKSVKSSSLPRAFQKASRQEEPDSLSYYCAAETNGVGAASGTPPSKATLEGKVASPKHCVLARPKGTPPLPPVRKSSLDQKNRASPQHSASGSGTSSPLNQPAAFPAGLPDEPSGKTKDASSSSKLFSAKLEQLASRSNSLGRATVSHYECLSLERAESLSSVSSRLHAGKDGTMPRAGRSLGRSAGTSPPSSGASPKAGQSKISAVSRLLLASPRARGPSASTTKTLSFSTKSLPQAVGQGSSSPPGGKHTPWSTQSLSRNRSSGLASKLPLRAVSGRISELLQGGAGARGLQLRAGPEAEARGGALAEDEPAAAHLLPSPYSKITPPRRPHRCSSGHGSDNSSVLSGELPPAMGKTALFYHSGGSSGYESVMRDSEATGSASSAQDSTSENSSSVGGRCRSLKTPKKRSNPGSQRRRLIPALSLDTSSPVRKPPNSTGVRWVDGPLRSSPRGLGEPFEIKVYEIDDVERLQRRRGGASKEAMCFNAKLKILEHRQQRIAEVRAKYEWLMKELEATKQYLMLDPNKWLSEFDLEQVWELDSLEYLEALECVTERLESRVNFCKAHLMMITCFDITSRRR

SEQ ID NO: 44305 - protein, 2108 aa, Homo sapiens
  Payload ID: 9033
  Gene Symbol: KIF26B
  Gene Name: kinesin family member 26B
  Uniprot ID: Q2KJY2
  ENSP ID: ENSP00000385545
MNSVAGNKERLAVSTRGKKYGVNEVCSPTKPAAPFSPESWYRKAYEESRAGSRPTPEGAGSALGSSGTPSPGSGTSSPSSFTGSPGPASPGIGTSSPGSLGGSPGFGTGSPGSGSGGGSSPGSDRGVWCENCNARLVELKRQALRLLLPGPFPGKDPAFSAVIHDKLQVPNTIRKAWNDRDNRCDICATHLNQLKQEAIQMVLTLEQAAGSEHYDASPCSPPPLSNIPTLVGSRHVGGLQQPRDWAFVPAPCATSNYTGFANKHGSKPSSLGVSNGAEKKSGSPTHQAKVSLQMATSPSNGNILNSVAIQAHQYLDGTWSLSRTNGVTLYPYQISQLMTESSREGLTEAVLNRYNADKPSACSVPASQGSCVASETSTGTSVAASFFARAAQKLNLSSKKKKHRPSTSSAAEPPLFATSFSGILQTSPPPAPPCLLRAVNKVKDTPGLGKVKVMLRICSTLARDTSESSSFLKVDPRKKQITLYDPLTCGGQNAFQKRGNQVPPKMFAFDAVFPQDASQAEVCAGTVAEVIQSVVNGADGCVFCFGHAKLGKSYTMIGKDDSMQNLGIIPCAISWLFKLINERKEKTGARFSVRVSAVEVWGKEENLRDLLSEVATGSLQDGQSPGVYLCEDPICGTQLQNQSELRAPTAEKAAFFLDAAIASRRSHQQDCDEDDHRNSHVFFTLHIYQYRMEKSGKGGMSGGRSRLHLIDLGSCVKALSKNREGGSGLCLSLSALGNVILALVNGSKHIPYKESKLAMLLRESLGNMNCRTTMIAHISAAVGSYAETLSTIQIASRVLRMKKKKTKYTSSSSGGESSCEEGRMRRPTQLRPFHTRATVDPDFPIAHLSSDPDYSSSSEQSCDTVIYIGPNGTALSDKELTDNEGPPDFVPIVPALQKTRGDSRPAEAGEAAAGKSERDCLKCNTFAELQERLDCIDGSEEPSSFPFEELPAQFGPEQASRGPRLSQAAGASPLSESDKEDNGSEGQLTNREGPELPASKMQRSHSPVPAAAPAHSPSPASPRSVPGSSSQHSASPLVQSPSLQSSRESLNSCGFVEGKPRPMGSPRLGIASLSKTSEYKPPSSPSQRCKVYTQKGVLPSPAPLPPSSKDSGVASRESLLQPEVRTPPVGMSPQVLKKSMSAGSEGFPETPVDDEQQAATPSESKKEILSTTMVTVQQPLELNGEDELVFTLVEELTISGVLDSGRPTSIISFNSDCSARALASGSRPVSIISSISEDLECYSSTAPVSEVSITQFLPLPKMSLDEKAQDAGSRRSSISSWLSEMSAGSEGEQSCHSFIAQTCFGHGEAMAEPVASEFVSSLQNTAVVCREKPKASPDNLLILSEMGDDSFNKAAPIKGCKISTVSKAMVTISNTANLSSCEGYIPMKTNITVYPCIAMSPRNIQEPEAPTATPKAGPTLAQSRESKENSAKKEMKFEDPWLKREEEVKKETAHPNEEGMMRCETATGPSNAETRAEQEQDGKPSPGDRLSSSSGEVSASPVTDNFRRVVDGCEMALPGLATQSPVHPNKSVKSSSLPRAFQKASRQEEPDSLSYYCAAETNGVGAASGTPPSKATLEGKVASPKHCVLARPKGTPPLPPVRKSSLDQKNRASPQHSASGSGTSSPLNQPAAFPAGLPDEPSGKTKDASSSSKLFSAKLEQLASRSNSLGRATVSHYECLSLERAESLSSVSSRLHAGKDGTMPRAGRSLGRSAGTSPPSSGASPKAGQSKISAVSRLLLASPRARGPSASTTKTLSFSTKSLPQAVGQGSSSPPGGKHTPWSTQSLSRNRSSGLASKLPLRAVSGRISELLQGGAGARGLQLRAGPEAEARGGALAEDEPAAAHLLPSPYSKITPPRRPHRCSSGHGSDNSSVLSGELPPAMGKTALFYHSGGSSGYESVMRDSEATGSASSAQDSTSENSSSVGGRCRSLKTPKKRSNPGSQRRRLIPALSLDTSSPVRKPPNSTGVRWVDGPLRSSPRGLGEPFEIKVYEIDDVERLQRRRGGASKEAMCFNAKLKILEHRQQRIAEVRAKYEWLMKELEATKQYLMLDPNKWLSEFDLEQVWELDSLEYLEALECVTERLESRVNFCKAHLMMITCFDITSRRR

SEQ ID NO: 44306 - protein, 1954 aa, Homo sapiens
  Payload ID: 9033
  Gene Symbol: KIF26B
  Gene Name: kinesin family member 26B
  ENSP ID: ENSP00000486478
  MOD_RES (1)..(1): Any amino acid
XDPAFSAVIHDKLQVPNTIRKAWNDRDNRCDICATHLNQLKQEAIQMVLTLEQAAGSEHYDASPCSPPPLSNIPTLVGSRHVGGLQQPRDWAFVPAPCATSNYTGFANKHGSKPSSLGVSNGAEKKSGSPTHQAKVSLQMATSPSNGNILNSVAIQAHQYLDGTWSLSRTNGVTLYPYQISQLMTESSREGLTEAVLNRYNADKPSACSVPASQGSCVASETSTGTSVAASFFARAAQKLNLSSKKKKHRPSTSSAAEPPLFATSFSGILQTSPPPAPPCLLRAVNKVKDTPGLGKVKVMLRICSTLARDTSESSSFLKVDPRKKQITLYDPLTCGGQNAFQKRGNQVPPKMFAFDAVFPQDASQAEVCAGTVAEVIQSVVNGADGCVFCFGHAKLGKSYTMIGKDDSMQNLGIIPCAISWLFKLINERKEKTGARFSVRVSAVEVWGKEENLRDLLSEVATGSLQDGQSPGVYLCEDPICGTQLQNQSELRAPTAEKAAFFLDAAIASRRSHQQDCDEDDHRNSHVFFTLHIYQYRMEKSGKGGMSGGRSRLHLIDLGSCVKALSKNREGGSGLCLSLSALGNVILALVNGSKHIPYKESKLAMLLRESLGNMNCRTTMIAHISAAVGSYAETLSTIQIASRVLRMKKKKTKYTSSSSGGESSCEEGRMRRPTQLRPFHTRATVDPDFPIAHLSSDPDYSSSSEQSCDTVIYIGPNGTALSDKELTDNEGPPDFVPIVPALQKTRGDSRPAEAGEAAAGKSERDCLKCNTFAELQERLDCIDGSEEPSSFPFEELPAQFGPEQASRGPRLSQAAGASPLSESDKEDNGSEGQLTNREGPELPASKMQRSHSPVPAAAPAHSPSPASPRSVPGSSSQHSASPLVQSPSLQSSRESLNSCGFVEGKPRPMGSPRLGIASLSKTSEYKPPSSPSQRCKVYTQKGVLPSPAPLPPSSKDSGVASRESLLQPEVRTPPVGMSPQVLKKSMSAGSEGFPETPVDDEQQAATPSESKKEILSTTMVTVQQPLELNGEDELVFTLVEELTISGVLDSGRPTSIISFNSDCSARALASGSRPVSIISSISEDLECYSSTAPVSEVSITQFLPLPKMSLDEKAQDAGSRRSSISSWLSEMSAGSEGEQSCHSFIAQTCFGHGEAMAEPVASEFVSSLQNTAVVCREKPKASPDNLLILSEMGDDSFNKAAPIKGCKISTVSKAMVTISNTANLSSCEGYIPMKTNITVYPCIAMSPRNIQEPEAPTATPKAGPTLAQSRESKENSAKKEMKFEDPWLKREEEVKKETAHPNEEGMMRCETATGPSNAETRAEQEQDGKPSPGDRLSSSSGEVSASPVTDNFRRVVDGCEMALPGLATQSPVHPNKSVKSSSLPRAFQKASRQEEPDSLSYYCAAETNGVGAASGTPPSKATLEGKVASPKHCVLARPKGTPPLPPVRKSSLDQKNRASPQHSASGSGTSSPLNQPAAFPAGLPDEPSGKTKDASSSSKLFSAKLEQLASRSNSLGRATVSHYECLSLERAESLSSVSSRLHAGKDGTMPRAGRSLGRSAGTSPPSSGASPKAGQSKISAVSRLLLASPRARGPSASTTKTLSFSTKSLPQAVGQGSSSPPGGKHTPWSTQSLSRNRSSGLASKLPLRAVSGRISELLQGGAGARGLQLRAGPEAEARGGALAEDEPAAAHLLPSPYSKITPPRRPHRCSSGHGSDNSSVLSGELPPAMGKTALFYHSGGSSGYESVMRDSEATGSASSAQDSTSENSSSVGGRCRSLKTPKKRSNPGSQRRRLIPALSLDTSSPVRKPPNSTGVRWVDGPLRSSPRGLGEPFEIKVYEIDDVERLQRRRGGASKEAMCFNAKLKILEHRQQRIAEVRAKYEWLMKELEATKQYLMLDPNKWLSEFDLEQVWELDSLEYLEALECVTERLESRVNFCKAHLMMITCFDITSRRR

SEQ ID NO: 44307 - protein, 1401 aa, Homo sapiens
  Payload ID: 9034
  Gene Symbol: KIF27
  Gene Name: kinesin family member 27
  Uniprot ID: Q86VH2
  ENSP ID: ENSP00000297814
MEEIPVKVAVRIRPLLCKEALHNHQVCVRVIPNSQQVIIGRDRVFTFDFVFGKNSTQDEVYNTCIKPLVLSLIEGYNATVFAYGQTGSGKTYTIGGGHIASVVEGQKGIIPRAIQEIFQSISEHPSIDFNVKVSYIEVYKEDLRDLLELETSMKDLHIREDEKGNTVIVGAKECHVESAGEVMSLLEMGNAARHTGTTQMNEHSSRSHAIFTISICQVHKNMEAAEDGSWYSPRHIVSKFHFVDLAGSERVTKTGNTGERFKESIQINSGLLALGNVISALGDPRRKSSHIPYRDAKITRLLKDSLGGSAKTVMITCVSPSSSNFDESLNSLKYANRARNIRNKPTVNFSPESDRIDEMEFEIKLLREALQSQQAGVSQTTQINREGSPDTNRIHSLEEQVAQLQGECLGYQCCVEEAFTFLVDLKDTVRLNEKQQHKLQEWFNMIQEVRKAVLTSFRGIGGTASLEEGPQHVTVLQLKRELKKCQCVLAADEVVFNQKELEVKELKNQVQMMVQENKGHAVSLKEAQKVNRLQNEKIIEQQLLVDQLSEELTKLNLSVTSSAKENCGDGPDARIPERRPYTVPFDTHLGHYIYIPSRQDSRKVHTSPPMYSLDRIFAGFRTRSQMLLGHIEEQDKVLHCQFSDNSDDEESEGQEKSGTRCRSRSWIQKPDSVCSLVELSDTQDETQKSDLENEDLKIDCLQESQELNLQKLKNSERILTEAKQKMRELTINIKMKEDLIKELIKTGNDAKSVSKQYSLKVTKLEHDAEQAKVELIETQKQLQELENKDLSDVAMKVKLQKEFRKKMDAAKLRVQVLQKKQQDSKKLASLSIQNEKRANELEQSVDHMKYQKIQLQRKLREENEKRKQLDAVIKRDQQKIKEIQLKTGQEEGLKPKAEDLDACNLKRRKGSFGSIDHLQKLDEQKKWLDEEVEKVLNQRQELEELEADLKKREAIVSKKEALLQEKSHLENKKLRSSQALNTDSLKISTRLNLLEQELSEKNVQLQTSTAEEKTKISEQVEVLQKEKDQLQKRRHNVDEKLKNGRVLSPEEEHVLFQLEEGIEALEAAIEYRNESIQNRQKSLRASFHNLSRGEANVLEKLACLSPVEIRTILFRYFNKVVNLREAERKQQLYNEEMKMKVLERDNMVRELESALDHLKLQCDRRLTLQQKEHEQKMQLLLHHFKEQDGEGIMETFKTYEDKIQQLEKDLYFYKKTSRDHKKKLKELVGEAIRRQLAPSEYQEAGDGVLKPEGGGMLSEELKWASRPESMKLSGREREMDSSASSLRTQPNPQKLWEDIPELPPIHSSLAPPSGHMLGNENKTETDDNQFTKSHSRLSSQIQVVGNVGRLHGVTPVKLCRKELRQISALELSLRRSSLGVGIGSMAADSIEVSRKPRDLKT

SEQ ID NO: 44308 - protein, 1304 aa, Homo sapiens
  Payload ID: 9034
  Gene Symbol: KIF27
  Gene Name: kinesin family member 27
  Uniprot ID: Q86VH2
  ENSP ID: ENSP00000333928
MEEIPVKVAVRIRPLLCKEALHNHQVCVRVIPNSQQVIIGRDRVFTFDFVFGKNSTQDEVYNTCIKPLVLSLIEGYNATVFAYGQTGSGKTYTIGGGHIASVVEGQKGIIPRAIQEIFQSISEHPSIDFNVKVSYIEVYKEDLRDLLELETSMKDLHIREDEKGNTVIVGAKECHVESAGEVMSLLEMGNAARHTGTTQMNEHSSRSHAIFTISICQVHKNMEAAEDGSWYSPRHIVSKFHFVDLAGSERVTKTGNTGERFKESIQINSGLLALGNVISALGDPRRKSSHIPYRDAKITRLLKDSLGGSAKTVMITCVSPSSSNFDESLNSLKYANRARNIRNKPTVNFSPESDRIDEMEFEIKLLREALQSQQAGVSQTTQINREGSPDTNRIHSLEEQVAQLQGECLGYQCCVEEAFTFLVDLKDTVRLNEKQQHKLQEWFNMIQEVRKAVLTSFRGIGGTASLEEGPQHVTVLQLKRELKKCQCVLAADEVVFNQKELEVKELKNQVQMMVQENKGHAVSLKEAQKVNRLQNEKIIEQQLLVDQLSEELTKLNLSVTSSAKENCGDGPDARIPERRPYTVPFDTHLGHYIYIPSRQDSRKVHTSPPMYSLDRIFAGFRTRSQMLLGHIEEQDKVLHCQFSDNSDDEESEGQEKSGTRCRSRSWIQKPDSVCSLVELSDTQDETQKSDLENEDLKIDCLQESQELNLQKLKNSERILTEAKQKMRELTINIKMKEDLIKELIKTGNDAKSVSKQYSLKVTKLEHDAEQAKVELIETQKQLQELENKDLSDVAMKVKLQKEFRKKMDAAKLRVQVLQKKQQDSKKLASLSIQNEKRANELEQSVDHMKYQKIQLQRKLREENEKRKQLDAVIKRDQQKIKALNTDSLKISTRLNLLEQELSEKNVQLQTSTAEEKTKISEQVEVLQKEKDQLQKRRHNVDEKLKNGRVLSPEEEHVLFQLEEGIEALEAAIEYRNESIQNRQKSLRASFHNLSRGEANVLEKLACLSPVEIRTILFRYFNKVVNLREAERKQQLYNEEMKMKVLERDNMVRELESALDHLKLQCDRRLTLQQKEHEQKMQLLLHHFKEQDGEGIMETFKTYEDKIQQLEKDLYFYKKTSRDHKKKLKELVGEAIRRQLAPSEYQEAGDGVLKPEGGGMLSEELKWASRPESMKLSGREREMDSSASSLRTQPNPQKLWEDIPELPPIHSSLAPPSGHMLGNENKTETDDNQFTKSHSRLSSQIQVVGNVGRLHGVTPVKLCRKELRQISALELSLRRSSLGVGIGSMAADSIEVSRKPRDLKT

SEQ ID NO: 44309 - protein, 286 aa, Homo sapiens
  Payload ID: 9034
  Gene Symbol: KIF27
  Gene Name: kinesin family member 27
  Uniprot ID: Q86VH2
  ENSP ID: ENSP00000365525
MYSLDRIFAGFRTRSQMLLGHIEEQDKVLHCQFSDNSDDEESEGQEKSGTRCRSRSWIQKPDSVCSLVELSDTQDETQKSDLENEDLKIDCLQESQELNLQKLKNSERILTEAKQKMRELTINIKMKEDLIKELIKTGNDAKSVSKQYSLKVTKLEHDAEQAKVELIETQKQLQELENKDLSDVAMKVKLQKEFRKKMDAAKLRVQVLQKKQQDSKKLASLSIQNEKRANELEQSVDHMKYQKIQLQRKLREENEKRKQLDAVIKRDQQKIKVILSYIPAKYNMKC

SEQ ID NO: 44310 - protein, 1335 aa, Homo sapiens
  Payload ID: 9034
  Gene Symbol: KIF27
  Gene Name: kinesin family member 27
  Uniprot ID: Q86VH2
  ENSP ID: ENSP00000401688
MEEIPVKVAVRIRPLLCKEALHNHQVCVRVIPNSQQVIIGRDRVFTFDFVFGKNSTQDEVYNTCIKPLVLSLIEGYNATVFAYGQTGSGKTYTIGGGHIASVVEGQKGIIPRAIQEIFQSISEHPSIDFNVKVSYIEVYKEDLRDLLELETSMKDLHIREDEKGNTVIVGAKECHVESAGEVMSLLEMGNAARHTGTTQMNEHSSRSHAIFTISICQVHKNMEAAEDGSWYSPRHIVSKFHFVDLAGSERVTKTGNTGERFKESIQINSGLLALGNVISALGDPRRKSSHIPYRDAKITRLLKDSLGGSAKTVMITCVSPSSSNFDESLNSLKYANRARNIRNKPTVNFSPESDRIDEMEFEIKLLREALQSQQAGVSQTTQINREGSPDTNRIHSLEEQVAQLQGECLGYQCCVEEAFTFLVDLKDTVRLNEKQQHKLQEWFNMIQEVRKAVLTSFRGIGGTASLEEGPQHVTVLQLKRELKKCQCVLAADEVVFNQKELEVKELKNQVQMMVQENKGHAVSLKEAQKVNRLQNEKIIEQQLLVDQLSEELTKLNLSVTSSAKENCGDGPDARIPERRPYTVPFDTHLGHYIYIPSRQDSRKVHTSPPMYSLDRIFAGFRTRSQMLLGHIEEQDKVLHCQFSDNSDDEESEGQEKSGTRCRSRSWIQKPDSVCSLVELSDTQDETQKSDLENEDLKIDCLQESQELNLQKLKNSERILTEAKQKMRELTINIKMKEDLIKELIKTGNDAKSVSKQYSLKVTKLEHDAEQAKVELIETQKQLQELENKDLSDVAMKVKLQKEFRKKMDAAKLRVQEIQLKTGQEEGLKPKAEDLDACNLKRRKGSFGSIDHLQKLDEQKKWLDEEVEKVLNQRQELEELEADLKKREAIVSKKEALLQEKSHLENKKLRSSQALNTDSLKISTRLNLLEQELSEKNVQLQTSTAEEKTKISEQVEVLQKEKDQLQKRRHNVDEKLKNGRVLSPEEEHVLFQLEEGIEALEAAIEYRNESIQNRQKSLRASFHNLSRGEANVLEKLACLSPVEIRTILFRYFNKVVNLREAERKQQLYNEEMKMKVLERDNMVRELESALDHLKLQCDRRLTLQQKEHEQKMQLLLHHFKEQDGEGIMETFKTYEDKIQQLEKDLYFYKKTSRDHKKKLKELVGEAIRRQLAPSEYQEAGDGVLKPEGGGMLSEELKWASRPESMKLSGREREMDSSASSLRTQPNPQKLWEDIPELPPIHSSLAPPSGHMLGNENKTETDDNQFTKSHSRLSSQIQVVGNVGRLHGVTPVKLCRKELRQISALELSLRRSSLGVGIGSMAADSIEVSRKPRDLKT

SEQ ID NO: 44311 - protein, 171 aa, Homo sapiens
  Payload ID: 9034
  Gene Symbol: KIF27
  Gene Name: kinesin family member 27
  ENSP ID: ENSP00000431390
MEEIPVKVAVRIRPLLCKEALHNHQVCVRVIPNSQQVIIGRDRVFTFDFVFGKNSTQDEVYNTCIKPLVLSLIEGYNATVFAYGQTGSGKTYTIGGGHIASVVEGQKGIIPRAIQEIFQSISEHPSIDFNVKVSYIEVYKEDLRDLLELETSMKDLHIREDEKGNTVCACC

SEQ ID NO: 44312 - protein, 673 aa, Homo sapiens
  Payload ID: 9035
  Gene Symbol: KIF2B
  Gene Name: kinesin family member 2B
  Uniprot ID: Q8N4N8
  ENSP ID: ENSP00000268919
MASQFCLPESPCLSPLKPLKPHFGDIQEGIYVAIQRSDKRIHLAVVTEINRENYWVTVEWVEKAVKKGKKIDLETILLLNPALDSAEHPMPPPPLSPLALAPSSAIRDQRTATKWVAMIPQKNQTASGDSLDVRVPSKPCLMKQKKSPCLWEIQKLQEQREKRRRLQQEIRARRALDVNTRNPNYEIMHMIEEYRRHLDSSKISVLEPPQEHRICVCVRKRPLNQRETTLKDLDIITVPSDNVVMVHESKQKVDLTRYLQNQTFCFDHAFDDKASNELVYQFTAQPLVESIFRKGMATCFAYGQTGSGKTYTMGGDFSGTAQDCSKGIYALVAQDVFLLLRNSTYEKLDLKVYGTFFEIYGGKVYDLLNWKKKLQVLEDGNQQIQVVGLQEKEVCCVEEVLNLVEIGNSCRTSRQTPVNAHSSRSHAVFQIILKSGRIMHGKFSLVDLAGNERGADTTKASRKRQLEGAEINKSLLALKECILALGQNKPHTPFRASKLTLVLRDSFIGQNSSTCMIATISPGMTSCENTLNTLRYANRVKKLNVDVRPYHRGHYPIGHEAPRMLKSHIGNSEMSLQRDEFIKIPYVQSEEQKEIEEVETLPTLLGKDTTISGKGSSQWLENIQERAGGVHHDIDFCIARSLSILEQKIDALTEIQKKLKLLLADLHVKSKVE

SEQ ID NO: 44313 - protein, 671 aa, Homo sapiens
  Payload ID: 9036
  Gene Symbol: KIF2C
  Gene Name: kinesin family member 2C
  Uniprot ID: Q99661
  ENSP ID: ENSP00000361291
MIDFDDVAAINPELLQLLPLHPKDNLPLQENVTIQKQKRRSVNSKIPAPKESLRSRSTRMSTVSELRITAQENDMEVELPAAANSRKQFSVPPAPTRPSCPAVAEIPLRMVSEEMEEQVHSIRGSSSANPVNSVRRKSCLVKEVEKMKNKREEKKAQNSEMRMKRAQEYDSSFPNWEFARMIKEFRATLECHPLTMTDPIEEHRICVCVRKRPLNKQELAKKEIDVISIPSKCLLLVHEPKLKVDLTKYLENQAFCFDFAFDETASNEVVYRFTARPLVQTIFEGGKATCFAYGQTGSGKTHTMGGDLSGKAQNASKGIYAMASRDVFLLKNQPCYRKLGLEVYVTFFEIYNGKLFDLLNKKAKLRVLEDGKQQVQVVGLQEHLVNSADDVIKMIDMGSACRTSGQTFANSNSSRSHACFQIILRAKGRMHGKFSLVDLAGNERGADTSSADRQTRMEGAEINKSLLALKECIRALGQNKAHTPFRESKLTQVLRDSFIGENSRTCMIATISPGISSCEYTLNTLRYADRVKELSPHSGPSGEQLIQMETEEMEACSNGALIPGNLSKEEEELSSQMSSFNEAMTQIRELEEKAMEELKEIIQQGPDWLELSEMTEQPDYDLETFVNKAESALAQQAKHFSALRDVIKALRLAMQLEEQASRQISSKKRPQ

SEQ ID NO: 44314 - protein, 725 aa, Homo sapiens
  Payload ID: 9036
  Gene Symbol: KIF2C
  Gene Name: kinesin family member 2C
  Uniprot ID: Q99661
  ENSP ID: ENSP00000361298
MAMDSSLQARLFPGLAIKIQRSNGLIHSANVRTVNLEKSCVSVEWAEGGATKGKEIDFDDVAAINPELLQLLPLHPKDNLPLQENVTIQKQKRRSVNSKIPAPKESLRSRSTRMSTVSELRITAQENDMEVELPAAANSRKQFSVPPAPTRPSCPAVAEIPLRMVSEEMEEQVHSIRGSSSANPVNSVRRKSCLVKEVEKMKNKREEKKAQNSEMRMKRAQEYDSSFPNWEFARMIKEFRATLECHPLTMTDPIEEHRICVCVRKRPLNKQELAKKEIDVISIPSKCLLLVHEPKLKVDLTKYLENQAFCFDFAFDETASNEVVYRFTARPLVQTIFEGGKATCFAYGQTGSGKTHTMGGDLSGKAQNASKGIYAMASRDVFLLKNQPCYRKLGLEVYVTFFEIYNGKLFDLLNKKAKLRVLEDGKQQVQVVGLQEHLVNSADDVIKMIDMGSACRTSGQTFANSNSSRSHACFQIILRAKGRMHGKFSLVDLAGNERGADTSSADRQTRMEGAEINKSLLALKECIRALGQNKAHTPFRESKLTQVLRDSFIGENSRTCMIATISPGISSCEYTLNTLRYADRVKELSPHSGPSGEQLIQMETEEMEACSNGALIPGNLSKEEEELSSQMSSFNEAMTQIRELEEKAMEELKEIIQQGPDWLELSEMTEQPDYDLETFVNKAESALAQQAKHFSALRDVIKALRLAMQLEEQASRQISSKKRPQ

SEQ ID NO: 44315 - protein, 287 aa, Homo sapiens
  Payload ID: 9036
  Gene Symbol: KIF2C
  Gene Name: kinesin family member 2C
  ENSP ID: ENSP00000395050
MVRSGVPRSRGLVSGLIHSANVRTVNLEKSCVSVEWAEGGATKGKEIDFDDVAAINPELLQLLPLHPKDNLPLQENVTIQKQKRRSVNSKIPAPKESLRSRSTRMSTVSELRITAQENDMEVELPAAANSRKQFSVPPAPTRPSCPAVAEIPLRMVSEEMEEQVHSIRGSSSANPVNSVRRKSCLVKEVEKMKNKREEKKAQNSEMRMKRAQEYDSSFPNWEFARMIKEFRATLECHPLTMTDPIEEHRICVCVRKRPLNKQELAKKEIDVISIPSKCLLLVHEPKL

SEQ ID NO: 44316 - protein, 107 aa, Homo sapiens
  Payload ID: 9036
  Gene Symbol: KIF2C
  Gene Name: kinesin family member 2C
  ENSP ID: ENSP00000402172
  MOD_RES (1)..(1): Any amino acid
XKECIRALGQNKAHTPFRESKLTQVLRDSFIGENSRTCMIATISPGISSCEYTLNTLRYADRQGCHSIPLEPQASKPGRCHIPLLSKEEEELSSQMSSFNEAMTQIR

SEQ ID NO: 44317 - protein, 336 aa, Homo sapiens
  Payload ID: 9036
  Gene Symbol: KIF2C
  Gene Name: kinesin family member 2C
  ENSP ID: ENSP00000410346
MAMDSSLQARLFPGLAIKIQRSNGLIHSANVRTVNLEKSCVSVEWAEGGATKGKEIDFDDVAAINPELLQLLPLHPKDNLPLQENVTIQKQKRRSVNSKIPAPKESLRSRSTRMSTVSELRITAQENDMEVELPAAANSRKQFSVPLRRKSCLVKEVEKMKNKREEKKAQNSEMRMKRAQEYDSSFPNWEFARMIKEFRATLECHPLTMTDPIEEHRICVCVRKRPLNKQELAKKEIDVISIPSKCLLLVHEPKLKVDLTKYLENQAFCFDFAFDETASNEVVYRFTARPLVQTIFEGGKATCFAYGQTGSGKTHTMGGDLSGKAQNASKGIYAMA

SEQ ID NO: 44318 - protein, 702 aa, Homo sapiens
  Payload ID: 9037
  Gene Symbol: KIF3A
  Gene Name: kinesin family member 3A
  ENSP ID: ENSP00000368009
MPINKSEKPESCDNVKVVVRCRPLNEREKSMCYKQAVSVDEMRGTITVHKTDSSNEPPKTFTFDTVFGPESKQLDVYNLTARPIIDSVLEGYNGTIFAYGQTGTGKTFTMEGVRAIPELRGIIPNSFAHIFGHIAKAEGDTRFLVRVSYLEIYNEEVRDLLGKDQTQRLEVKERPDVGVYIKDLSAYVVNNADDMDRIMTLGHKNRSVGATNMNEHSSRSHAIFTITIECSEKGIDGNMHVRMGKLHLVDLAGSERQAKTGATGQRLKEATKINLSLSTLGNVISALVDGKSTHVPYRNSKLTRLLQDSLGGNSKTMMCANIGPADYNYDETISTLRYANRAKNIKNKARINEDPKDALLRQFQKEIEELKKKLEEGEEISGSDISGSEEDDDEEGEVGEDGEKRKKRRDQAGKKKVSPDKMIEMQAKIDEERKALETKLDMEEEERNKARAELEKREKDLLKAQQEHQSLLEKLSALEKKVIVGGVDLLAKAEEQEKLLEESNMELEERRKRAEQLRRELEEKEQERLDIEEKYTSLQEEAQGKTKKLKKVWTMLMAAKSEMADLQQEHQREIEGLLENIRQLSRELRLQMLIIDNFIPRDYQEMIENYVHWNEDIGEWQLKCVAYTGNNMRKQTPVPDKKEKDPFEVDLSHVYLAYTEESLRQSLMKLERPRTSKGKARPKTGRRKRSAKPETVIDSLLQ

SEQ ID NO: 44319 - protein, 699 aa, Homo sapiens
  Payload ID: 9037
  Gene Symbol: KIF3A
  Gene Name: kinesin family member 3A
  Uniprot ID: Q9Y496
  ENSP ID: ENSP00000368020
MPINKSEKPESCDNVKVVVRCRPLNEREKSMCYKQAVSVDEMRGTITVHKTDSSNEPPKTFTFDTVFGPESKQLDVYNLTARPIIDSVLEGYNGTIFAYGQTGTGKTFTMEGVRAIPELRGIIPNSFAHIFGHIAKAEGDTRFLVRVSYLEIYNEEVRDLLGKDQTQRLEVKERPDVGVYIKDLSAYVVNNADDMDRIMTLGHKNRSVGATNMNEHSSRSHAIFTITIECSEKGIDGNMHVRMGKLHLVDLAGSERQAKTGATGQRLKEATKINLSLSTLGNVISALVDGKSTHVPYRNSKLTRLLQDSLGGNSKTMMCANIGPADYNYDETISTLRYANRAKNIKNKARINEDPKDALLRQFQKEIEELKKKLEEGEEISGSDISGSEEDDDEEGEVGEDGEKRKKRRGKKKVSPDKMIEMQAKIDEERKALETKLDMEEEERNKARAELEKREKDLLKAQQEHQSLLEKLSALEKKVIVGGVDLLAKAEEQEKLLEESNMELEERRKRAEQLRRELEEKEQERLDIEEKYTSLQEEAQGKTKKLKKVWTMLMAAKSEMADLQQEHQREIEGLLENIRQLSRELRLQMLIIDNFIPRDYQEMIENYVHWNEDIGEWQLKCVAYTGNNMRKQTPVPDKKEKDPFEVDLSHVYLAYTEESLRQSLMKLERPRTSKGKARPKTGRRKRSAKPETVIDSLLQ

SEQ ID NO: 44320 - protein, 726 aa, Homo sapiens
  Payload ID: 9037
  Gene Symbol: KIF3A
  Gene Name: kinesin family member 3A
  ENSP ID: ENSP00000385808
MPINKSEKPESCDNVKVVVRCRPLNEREKSMCYKQAVSVDEMRGTITVHKTDSSNEPPKTFTFDTVFGPESKQLDVYNLTARPIIDSVLEGYNGTIFAYGQTGTGKTFTMEGVRAIPELRGIIPNSFAHIFGHIAKAEGDTRFLVRVSYLEIYNEEVRDLLGKDQTQRLEVKERPDVGVYIKDLSAYVVNNADDMDRIMTLGHKNRSVGATNMNEHSSRSHAIFTITIECSEKGIDGNMHVRMGKLHLVDLAGSERQAKTGATGQRLKEATKINLSLSTLGNVISALVDGKSTHVPYRNSKLTRLLQDSLGGNSKTMMCANIGPADYNYDETISTLRYANRAKNIKNKARINEDPKDALLRQFQKEIEELKKKLEEGEEISGSDISGSEEDDDEEGEVGEDGEKRKKRRGSSSSSSSDSTCSVIEKPLDKFLPNQAGKKKVSPDKMIEMQAKIDEERKALETKLDMEEEERNKARAELEKREKDLLKAQQEHQSLLEKLSALEKKVIVGGVDLLAKAEEQEKLLEESNMELEERRKRAEQLRRELEEKEQERLDIEEKYTSLQEEAQGKTKKLKKVWTMLMAAKSEMADLQQEHQREIEGLLENIRQLSRELRLQMLIIDNFIPRDYQEMIENYVHWNEDIGEWQLKCVAYTGNNMRKQTPVPDKKEKDPFEVDLSHVYLAYTEESLRQSLMKLERPRTSKGKARPKTGRRKRSAKPETVIDSLLQ

SEQ ID NO: 44321 - protein, 169 aa, Homo sapiens
  Payload ID: 9037
  Gene Symbol: KIF3A
  Gene Name: kinesin family member 3A
  ENSP ID: ENSP00000391863
MINKSEKPESCDNVKVVVRCRPLNEREKSMCYKQAVSVDEMRGTITVHKTDSSNEPPKTFTFDTVFGPESKQLDVYNLTARPIIDSVLEGYNGTIFAYGQTGTGKTFTMEGVRAIPELRGIIPNSFAHIFGHIAKAEGDTRFLVRVSYLEIYNEEVRDLLGKDQTQRLE

SEQ ID NO: 44322 - protein, 185 aa, Homo sapiens
  Payload ID: 9037
  Gene Symbol: KIF3A
  Gene Name: kinesin family member 3A
  ENSP ID: ENSP00000405619
SALEKKVIVGGVDLLAKAEEQEKLLEESNMELEERRKRAEQLRRELEEKEQERLDIEEKYTSLQEEAQGKTKKLKKVWTMLMAAKSEEMIENYVHWNEDIGEWQLKCVAYTGNNMRKQTPVPDKKEKDPFEVDLSHVYLAYTEESLRQSLMKLERPRTSKGKARPKTGRRKRSAKPETVIDSLLQ

SEQ ID NO: 44323 - protein, 725 aa, Homo sapiens
  Payload ID: 9037
  Gene Symbol: KIF3A
  Gene Name: kinesin family member 3A
  ENSP ID: ENSP00000483023
MPINKSEKPESCDNVKVVVRCRPLNEREKSMCYKQAVSVDEMRGTITVHKTDSSNEPPKTFTFDTVFGPESKQLDVYNLTARPIIDSVLEGYNGTIFAYGQTGTGKTFTMEGVRAIPELRGIIPNSFAHIFGHIAKAEGDTRFLVRVSYLEIYNEEVRDLLGKDQTQRLEVKERPDVGVYIKDLSAYVVNNADDMDRIMTLGHKNRSVGATNMNEHSSRSHAIFTITIECSEKGIDGNMHVRMGKLHLVDLAGSERQAKTGATGQRLKEATKINLSLSTLGNVISALVDGKSTHVPYRNSKLTRLLQDSLGGNSKTMMCANIGPADYNYDETISTLRYANRAKNIKNKARINEDPKDALLRQFQKEIEELKKKLEEEEISGSDISGSEEDDDEEGEVGEDGEKRKKRRGNSSSSSSDSTCSVIEKPLDKFLPNQAGKKKVSPDKMIEMQAKIDEERKALETKLDMEEEERNKARAELEKREKDLLKAQQEHQSLLEKLSALEKKVIVGGVDLLAKAEEQEKLLEESNMELEERRKRAEQLRRELEEKEQERLDIEEKYTSLQEEAQGKTKKLKKVWTMLMAAKSEMADLQQEHQREIEGLLENIRQLSRELRLQMLIIDNFIPRDYQEMIENYVHWNEDIGEWQLKCVAYTGNNMRKQTPVPDKKEKDPFEVDLSHVYLAYTEESLRQSLMKLERPRTSKGKARPKTGRRKRSAKPETVIDSLLQ

SEQ ID NO: 44324 - protein, 747 aa, Homo sapiens
  Payload ID: 9038
  Gene Symbol: KIF3B
  Gene Name: kinesin family member 3B
  Uniprot ID: O15066
  ENSP ID: ENSP00000364864
MSKLKSSESVRVVVRCRPMNGKEKAASYDKVVDVDVKLGQVSVKNPKGTAHEMPKTFTFDAVYDWNAKQFELYDETFRPLVDSVLQGFNGTIFAYGQTGTGKTYTMEGIRGDPEKRGVIPNSFDHIFTHISRSQNQQYLVRASYLEIYQEEIRDLLSKDQTKRLELKERPDTGVYVKDLSSFVTKSVKEIEHVMNVGNQNRSVGATNMNEHSSRSHAIFVITIECSEVGLDGENHIRVGKLNLVDLAGSERQAKTGAQGERLKEATKINLSLSALGNVISALVDGKSTHIPYRDSKLTRLLQDSLGGNAKTVMVANVGPASYNVEETLTTLRYANRAKNIKNKPRVNEDPKDALLREFQEEIARLKAQLEKRSIGRRKRREKRREGGGSGGGGEEEEEEGEEGEEEGDDKDDYWREQQEKLEIEKRAIVEDHSLVAEEKMRLLKEKEKKMEDLRREKDAAEMLGAKIKAMESKLLVGGKNIVDHTNEQQKILEQKRQEIAEQKRREREIQQQMESRDEETLELKETYSSLQQEVDIKTKKLKKLFSKLQAVKAEIHDLQEEHIKERQELEQTQNELTRELKLKHLIIENFIPLEEKSKIMNRAFFDEEEDHWKLHPITRLENQQMMKRPVSAVGYKRPLSQHARMSMMIRPEARYRAENIVLLELDMPSRTTRDYEGPAIAPKVQAALDAALQDEDEIQVDASSFESTANKKSKARPKSGRKSGSSSSSSGTPASQLYPQSRGLVPK

SEQ ID NO: 44325 - protein, 793 aa, Homo sapiens
  Payload ID: 9039
  Gene Symbol: KIF3C
  Gene Name: kinesin family member 3C
  Uniprot ID: O14782
  ENSP ID: ENSP00000264712
MASKTKASEALKVVARCRPLSRKEEAAGHEQILTMDVKLGQVTLRNPRAAPGELPKTFTFDAVYDASSKQADLYDETVRPLIDSVLQGFNGTVFAYGQTGTGKTYTMQGTWVEPELRGVIPNAFEHIFTHISRSQNQQYLVRASYLEIYQEEIRDLLSKEPGKRLELKENPETGVYIKDLSSFVTKNVKEIEHVMNLGNQTRAVGSTHMNEVSSRSHAIFIITVECSERGSDGQDHIRVGKLNLVDLAGSERQNKAGPNTAGGAATPSSGGGGGGGGSGGGAGGERPKEASKINLSLSALGNVIAALAGNRSTHIPYRDSKLTRLLQDSLGGNAKTIMVATLGPASHSYDESLSTLRFANRAKNIKNKPRVNEDPKDTLLREFQEEIARLKAQLEKRGMLGKRPRRKSSRRKKAVSAPPGYPEGPVIEAWVAEEEDDNNNNHRPPQPILESALEKNMENYLQEQKERLEEEKAAIQDDRSLVSEEKQKLLEEKEKMLEDLRREQQATELLAAKYKAMESKLLIGGRNIMDHTNEQQKMLELKRQEIAEQKRREREMQQEMMLRDEETMELRGTYTSLQQEVEVKTKKLKKLYAKLQAVKAEIQDQHDEYIRVRQDLEEAQNEQTRELKLKYLIIENFIPPEEKNKIMNRLFLDCEEEQWKFQPLVPAGVSSSQMKKRPTSAVGYKRPISQYARVAMAMGSHPRYRAENIMFLELDVSPPAVFEMEFSHDQEQDPRALHMERLMRLDSFLERPSTSKVRKSRSWCQSPQRPPPSTTHASLASASLRPATVADHE

SEQ ID NO: 44326 - protein, 793 aa, Homo sapiens; identical to SEQ ID NO: 44325
  Payload ID: 9039
  Gene Symbol: KIF3C
  Gene Name: kinesin family member 3C
  Uniprot ID: O14782
  ENSP ID: ENSP00000385030

SEQ ID NO: 44327 - protein, 685 aa, Homo sapiens
  Payload ID: 9039
  Gene Symbol: KIF3C
  Gene Name: kinesin family member 3C
  ENSP ID: ENSP00000393676
MASKTKASEALKVVARCRPLSRKEEAAGHEQILTMDVKLGQVTLRNPRAAPGELPKTFTFDAVYDASSKQADLYDETVRPLIDSVLQGFNGTVFAYGQTGTGKTYTMQGTWVEPELRGVIPNAFEHIFTHISRSQNQQYLVRASYLEIYQEEIRDLLSKEPGKRLELKENPETGVYIKDLSSFVTKNVKEIEHVMNLGNQTRAVGSTHMNEVSSRSHAIFIITVECSERGSDGQDHIRVGKLNLVDLAGSERQNKAGPNTAGGAATPSSGGGGGGGGSGGGAGGERPKEASKINLSLSALGNVIAALAGNRSTHIPYRDSKLTRLLQDSLGGNAKTIMVATLGPASHSYDESLSTLRFANRAKNIKNKPRVNEDPKDTLLREFQEEIARLKAQLEKRGMLGKRPRRKSSRRKKAVSAPPGYPEGPVIEAWVAEEEDDNNNNHRPPQPILESALEKNMENYLQEQKERLEEEKAAIQDDRSLVSEEKQKLLEEKEKMLEDLRREQQATELLAAKYKAMESKLLIGGRNIMDHTNEQQKMLELKRQEIAEQKRREREMQQEMMLRDEETMELRGTYTSLQQEVEVKTKKLKKLYAKLQAVKAEIQDQHDEYIRVRQDLEEAQNEQTRELKLKYLIIENFIPPEEKNKIMNRLFLDCEEEQWKFQPLVPAGVLTLSPRLKCSGTISAH

SEQ ID NO: 44328 - protein, 672 aa, Homo sapiens
  Payload ID: 9039
  Gene Symbol: KIF3C
  Gene Name: kinesin family member 3C
  ENSP ID: ENSP00000410407
MASKTKASEALKVVARCRPLSRKEEAAGHEQILTMDVKLGQVTLRNPRAAPGELPKTFTFDAVYDASSKQADLYDETVRPLIDSVLQGFNGTVFAYGQTGTGKTYTMQGTWVEPELRGVIPNAFEHIFTHISRSQNQQYLVRASYLEIYQEEIRDLLSKEPGKRLELKENPETGVYIKDLSSFVTKNVKEIEHVMNLGNQTRAVGSTHMNEVSSRSHAIFIITVECSERGSDGQDHIRVGKLNLVDLAGSERQNKAGPNTAGGAATPSSGGGGGGGGSGGGAGGERPKEASKINLSLSALGNVIAALAGNRSTHIPYRDSKLTRLLQDSLGGNAKTIMVATLGPASHSYDESLSTLRFANRAKNIKNKPRVNEDPKDTLLREFQEEIARLKAQLEKRGMLGKRPRRKSSRRKKAVSAPPGYPEGPVIEAWVAEEEDDNNNNHRPPQPILESALEKNMENYLQEQKERLEEEKAAIQDDRSLVSEEKQKLLEEKEKMLEDLRREQQATELLAAKYKAMESKLLIGGRNIMDHTNEQQKMLELKRQEIAEQKRREREMQQEMMLRDEETMELRGTYTSLQQEVEVKTKKLKKLYAKLQAVKAEIQDQHDEYIRVRQDLEEAQNEQTRELKLKYLIIENFIPPEEKNKIMNRLFLDCEEEQWKFQPLVPAGVYFM

SEQ ID NO: 44329 - protein, 792 aa, Homo sapiens
  Payload ID: 9039
  Gene Symbol: KIF3C
  Gene Name: kinesin family member 3C
  ENSP ID: ENSP00000480682
MASKTKASEALKVVARCRPLSRKEEAAGHEQILTMDVKLGQVTLRNPRAAPGELPKTFTFDAVYDASSKQADLYDEREPLIDSVLQGFNGTVFAYGQTGTGKTYTMQGTWVEPELRGVIPNAFEHIFTHISRSQNQQYLVRASYLEIYQEEIRDLLSKEPGKRLELKENPETGVYIKDLSSFVTKNVKEIEHVMNLGNQTRAVGSTHMNEVSSRSHAIFIITVECSERGSDGQDHIRVGKLNLVDLAGSERQNKAGPNTAGGAATPSSGGGGGGGGSGGGAGGERPKEASKINLSLSALGNVIAALAGNRSTHIPYRDSKLTRLLQDSLGGNAKTIMVATLGPASHSYDESLSTLRFANRAKNIKNKPRVNEDPKDTLLREFQEEIARLKAQLEKRGMLGKRPRRKSSRRKKAVSAPPGYPEGPVIEAWVAEEEDDNNNNHRPPQPILESALEKNMENYLQEQKERLEEEKAAIQDDRSLVSEEKQKLLEEKEKMLEDLRREQQATELLAAKYKAMESKLLIGGRNIMDHTNEQQKMLELKRQEIAEQKRREREMQQEMMLRDEETMELRGTYTSLQQEVEVKTKKLKKLYAKLQAVKAEIQDQHDEYIRVRQDLEEAQNEQTRELKLKYLIIENFIPPEEKNKIMNRLFLDCEEEQWKFQPLVPAGVSSSQMKKRPTSAVGYKRPISQYARVAMAMGSHPRYRAENIMFLELDVSPPAVFEMEFSHDQEQDPRALHMERLMRLDSFLERPSTSKVRKSRSWCQSPQRPPPSTTHASLASASLRPATVADHE

SEQ ID NO: 44330 - protein, 1232 aa, Homo sapiens
  Payload ID: 9040
  Gene Symbol: KIF4A
  Gene Name: kinesin family member 4A
  Uniprot ID: O95239
  ENSP ID: ENSP00000363524
MKEEVKGIPVRVALRCRPLVPKEISEGCQMCLSFVPGEPQVVVGTDKSFTYDFVFDPSTEQEEVFNTAVAPLIKGVFKGYNATVLAYGQTGSGKTYSMGGAYTAEQENEPTVGVIPRVIQLLFKEIDKKSDFEFTLKVSYLEIYNEEILDLLCPSREKAQINIREDPKEGIKIVGLTEKTVLVALDTVSCLEQGNNSRTVASTAMNSQSSRSHAIFTISLEQRKKSDKNSSFRSKLHLVDLAGSERQKKTKAEGDRLKEGININRGLLCLGNVISALGDDKKGGFVPYRDSKLTRLLQDSLGGNSHTLMIACVSPADSNLEETLNTLRYADRARKIKNKPIVNIDPQTAELNHLKQQVQQLQVLLLQAHGGTLPGSITVEPSENLQSLMEKNQSLVEENEKLSRGLSEAAGQTAQMLERIILTEQANEKMNAKLEELRQHAACKLDLQKLVETLEDQELKENVEIICNLQQLITQLSDETVACMAAAIDTAVEQEAQVETSPETSRSSDAFTTQHALRQAQMSKELVELNKALALKEALARKMTQNDSQLQPIQYQYQDNIKELELEVINLQKEKEELVLELQTAKKDANQAKLSERRRKRLQELEGQIADLKKKLNEQSKLLKLKESTERTVSKLNQEIRMMKNQRVQLMRQMKEDAEKFRQWKQKKDKEVIQLKERDRKRQYELLKLERNFQKQSNVLRRKTEEAAAANKRLKDALQKQREVADKRKETQSRGMEGTAARVKNWLGNEIEVMVSTEEAKRHLNDLLEDRKILAQDVAQLKEKKESGENPPPKLRRRTFSLTEVRGQVSESEDSITKQIESLETEMEFRSAQIADLQQKLLDAESEDRPKQRWENIATILEAKCALKYLIGELVSSKIQVSKLESSLKQSKTSCADMQKMLFEERNHFAEIETELQAELVRMEQQHQEKVLYLLSQLQQSQMAEKQLEESVSEKEQQLLSTLKCQDEELEKMREVCEQNQQLLRENEIIKQKLTLLQVASRQKHLPKDTLLSPDSSFEYVPPKPKPSRVKEKFLEQSMDIEDLKYCSEHSVNEHEDGDGDDDEGDDEEWKPTKLVKVSRKNIQGCSCKGWCGNKQCGCRKQKSDCGVDCCCDPTKCRNRQQGKDSLGTVERTQDSEGSFKLEDPTEVTPGLSFFNPVCATPNSKILKEMCDVEQVLSKKTPPAPSPFDLPELKHVATEYQENKAPGKKKKRALASNTSFFSGCSPIEEEAH

SEQ ID NO: 44331 - protein, 1234 aa, Homo sapiens
  Payload ID: 9041
  Gene Symbol: KIF4B
  Gene Name: kinesin family member 4B
  Uniprot ID: Q2VIQ3
  ENSP ID: ENSP00000387875
MKEEVKGIPVRVALRCRPLVPKEISEGCQMCLSFVPGETQVVVGTDKSFTYDFVFDPCTEQEEVFNKAVAPLIKGIFKGYNATVLAYGQTGSGKTYSMGGAYTAEQENEPTVGIIPRVIQLLFKEIDKKSDFEFTLKVSYLEIYNEEILDLLCPSREKAQINIREDPKEGIKIVGLTEKTVLVALDTVSCLEQGNNSRTVASTAMNSQSSRSHAIFTISIEQRKKSDKNCSFRSKLHLVDLAGSERQKKTKAEGDRLKEGININRGLLCLGNVISALGDDKKGSFVPYRDSKLTRLLQDSLGGNSHTLMIACVSPADSNLEETLSTLRYADRARKIKNKPIVNIDPHTAELNHLKQQVQQLQVLLLQAHGGTLPGSINAEPSENLQSLMEKNQSLVEENEKLSRCLSKAAGQTAQMLERIILTEQVNEKLNAKLEELRQHVACKLDLQKLVETLEDQELKENVEIICNLQQLITQLSDETVACTAAAIDTAVEEEAQVETSPETSRSSDAFTTQHALHQAQMSKEVVELNNALALKEALVRKMTQNDNQLQPIQFQYQDNIKNLELEVINLQKEKEELVRELQTAKKNVNQAKLSEHRHKLLQELEGQIADLKKKLNEQSKLLKLKESTERTVSKLNQEIWMMKNQRVQLMRQMKEDAEKFRQWKQKKDKEVIQLKERDRKRQYELLKLERNFQKQSSVLRRKTEEAAAANKRLKDALQKQREVTDKRKETQSHGKEGIAARVRNWLGNEIEVMVSTEEAKRHLNDLLEDRKILAQDVVQLKEKKESRENPPPKLRKCTFSLSEVHGQVLESEDCITKQIESLETEMELRSAQIADLQQKLLDAESEDRPKQCWENIATILEAKCALKYLIGELVSSKIHVTKLENSLRQSKASCADMQKMLFEEQNHFSEIETELQAELVRMEQQHQEKVLYLVSQLQESQMAEKQLEKSASEKEQQLVSTLQCQDEELEKMREVCEQNQQLLQENEIIKQKLILLQVASRQKHLPNDTLLSPDSSFEYIPPKPKPSRVKEKFLEQSMDIEDLKYCSEHSVNEHEDGDGDGDSDEGDDEEWKPTKLVKVSRKNIQGCSCKGWCGNKQCGCRKQKSDCGVDCSCDPTKCRNRQQGKDSLGTVEQTQDSEGSFKLEDPTEVTPGLSFFNPVCATPNSKILKEMCDMEQVLSKKTAPAPSPFDLPESKHGATEYQQNKPPGKKKKRALASNTSFFSGCSPIEEEAH

SEQ ID NO: 44332 - protein, 943 aa, Homo sapiens
  Payload ID: 9042
  Gene Symbol: KIF5A
  Gene Name: kinesin family member 5A
  ENSP ID: ENSP00000286452
MAETNNECSIKVLCRFRPLNQAEILRGDKFIPIFQGDDSVVIGVSYFEIYLDKIRDLLDVTKTNLSVHEDKNRVPFVKGCTERFVSSPEEILDVIDEGKSNRHVAVTNMNEHSSRSHSIFLINIKQENMETEQKLSGKLYLVDLAGSEKVSKTGAEGAVLDEAKNINKSLSALGNVISALAEGTKSYVPYRDSKMTRILQDSLGGNCRTTMFICCSPSSYNDAETKSTLMFGQRAKTIKNTASVNLELTAEQWKKKYEKEKEKTKAQKETIAKLEAELSRWRNGENVPETERLAGEEAALGAELCEETPVNDNSSIVVRIAPEERQKYEEEIRRLYKQLDDKDDEINQQSQLIEKLKQQMLDQEELLVSTRGDNEKVQRELSHLQSENDAAKDEVKEVLQALEELAVNYDQKSQEVEEKSQQNQLLVDELSQKVATMLSLESELQRLQEVSGHQRKRIAEVLNGLMKDLSEFSVIVGNGEIKLPVEISGAIEEEFTVARLYISKIKSEVKSVVKRCRQLENLQVECHRKMEVTGRELSSCQLLISQHEAKIRSLTEYMQSVELKKRHLEESYDSLSDELAKLQAQETVHEVALKDKEPDTQDADEVKKALELQMESHREAHHRQLARLRDEINEKQKTIDELKDLNQKLQLELEKLQADYEKLKSEEHEKSTKLQELTFLYERHEQSKQDLKGLEETVARELQTLHNLRKLFVQDVTTRVKKSAEMEPEDSGGIHSQKQKISFLENNLEQLTKVHKQLVRDNADLRCELPKLEKRLRATAERVKALEGALKEAKEGAMKDKRRYQQEVDRIKEAVRYKSSGKRGHSAQIAKPVRPGHYPASSPTNPYGTRSPECISYTNSLFQNYQNLYLQATPSSTSDMYFANSCTSSGATSSGGPLASYQKANMDNGNATDINDNRSDLPCGYEAEDQAKLFPLHQETAAS

SEQ ID NO: 44333 - protein, 1032 aa, Homo sapiens
  Payload ID: 9042
  Gene Symbol: KIF5A
  Gene Name: kinesin family member 5A
  Uniprot ID: Q12840
  ENSP ID: ENSP00000408979
MAETNNECSIKVLCRFRPLNQAEILRGDKFIPIFQGDDSVVIGGKPYVFDRVFPPNTTQEQVYHACAMQIVKDVLAGYNGTIFAYGQTSSGKTHTMEGKLHDPQLMGIIPRIARDIFNHIYSMDENLEFHIKVSYFEIYLDKIRDLLDVTKTNLSVHEDKNRVPFVKGCTERFVSSPEEILDVIDEGKSNRHVAVTNMNEHSSRSHSIFLINIKQENMETEQKLSGKLYLVDLAGSEKVSKTGAEGAVLDEAKNINKSLSALGNVISALAEGTKSYVPYRDSKMTRILQDSLGGNCRTTMFICCSPSSYNDAETKSTLMFGQRAKTIKNTASVNLELTAEQWKKKYEKEKEKTKAQKETIAKLEAELSRWRNGENVPETERLAGEEAALGAELCEETPVNDNSSIVVRIAPEERQKYEEEIRRLYKQLDDKDDEINQQSQLIEKLKQQMLDQEELLVSTRGDNEKVQRELSHLQSENDAAKDEVKEVLQALEELAVNYDQKSQEVEEKSQQNQLLVDELSQKVATMLSLESELQRLQEVSGHQRKRIAEVLNGLMKDLSEFSVIVGNGEIKLPVEISGAIEEEFTVARLYISKIKSEVKSVVKRCRQLENLQVECHRKMEVTGRELSSCQLLISQHEAKIRSLTEYMQSVELKKRHLEESYDSLSDELAKLQAQETVHEVALKDKEPDTQDADEVKKALELQMESHREAHHRQLARLRDEINEKQKTIDELKDLNQKLQLELEKLQADYEKLKSEEHEKSTKLQELTFLYERHEQSKQDLKGLEETVARELQTLHNLRKLFVQDVTTRVKKSAEMEPEDSGGIHSQKQKISFLENNLEQLTKVHKQLVRDNADLRCELPKLEKRLRATAERVKALEGALKEAKEGAMKDKRRYQQEVDRIKEAVRYKSSGKRGHSAQIAKPVRPGHYPASSPTNPYGTRSPECISYTNSLFQNYQNLYLQATPSSTSDMYFANSCTSSGATSSGGPLASYQKANMDNGNATDINDNRSDLPCGYEAEDQAKLFPLHQETAAS

SEQ ID NO: 44334 - protein, 963 aa, Homo sapiens
  Payload ID: 9043
  Gene Symbol: KIF5B
  Gene Name: kinesin family member 5B
  Uniprot ID: P33176
  ENSP ID: ENSP00000307078
MADLAECNIKVMCRFRPLNESEVNRGDKYIAKFQGEDTVVIASKPYAFDRVFQSSTSQEQVYNDCAKKIVKDVLEGYNGTIFAYGQTSSGKTHTMEGKLHDPEGMGIIPRIVQDIFNYIYSMDENLEFHIKVSYFEIYLDKIRDLLDVSKTNLSVHEDKNRVPYVKGCTERFVCSPDEVMDTIDEGKSNRHVAVTNMNEHSSRSHSIFLINVKQENTQTEQKLSGKLYLVDLAGSEKVSKTGAEGAVLDEAKNINKSLSALGNVISALAEGSTYVPYRDSKMTRILQDSLGGNCRTTIVICCSPSSYNESETKSTLLFGQRAKTIKNTVCVNVELTAEQWKKKYEKEKEKNKILRNTIQWLENELNRWRNGETVPIDEQFDKEKANLEAFTVDKDITLTNDKPATAIGVIGNFTDAERRKCEEEIAKLYKQLDDKDEEINQQSQLVEKLKTQMLDQEELLASTRRDQDNMQAELNRLQAENDASKEEVKEVLQALEELAVNYDQKSQEVEDKTKEYELLSDELNQKSATLASIDAELQKLKEMTNHQKKRAAEMMASLLKDLAEIGIAVGNNDVKQPEGTGMIDEEFTVARLYISKMKSEVKTMVKRCKQLESTQTESNKKMEENEKELAACQLRISQHEAKIKSLTEYLQNVEQKKRQLEESVDALSEELVQLRAQEKVHEMEKEHLNKVQTANEVKQAVEQQIQSHRETHQKQISSLRDEVEAKAKLITDLQDQNQKMMLEQERLRVEHEKLKATDQEKSRKLHELTVMQDRREQARQDLKGLEETVAKELQTLHNLRKLFVQDLATRVKKSAEIDSDDTGGSAAQKQKISFLENNLEQLTKVHKQLVRDNADLRCELPKLEKRLRATAERVKALESALKEAKENASRDRKRYQQEVDRIKEAVRSKNMARRGHSAQIAKPIRPGQHPAASPTHPSAIRGGGAFVQNSQPVAVRGGGGKQV

SEQ ID NO: 44335 - protein, 76 aa, Homo sapiens
  Payload ID: 9044
  Gene Symbol: KIF5C
  Gene Name: kinesin family member 5C
  ENSP ID: ENSP00000393270
MTRILQDSLGGNCRTTIVICCSPSVFNEAETKSTLMFGQRAKTIKNTVSVNLELTAEEWKKKYEKEKEKNKTLKNV

SEQ ID NO: 44336 - protein, 957 aa, Homo sapiens
  Payload ID: 9044
  Gene Symbol: KIF5C
  Gene Name: kinesin family member 5C
  Uniprot ID: O60282
  ENSP ID: ENSP00000393379
MADPAECSIKVMCRFRPLNEAEILRGDKFIPKFKGDETVVIGQGKPYVFDRVLPPNTTQEQVYNACAKQIVKDVLEGYNGTIFAYGQTSSGKTHTMEGKLHDPQLMGIIPRIAHDIFDHIYSMDENLEFHIKVSYFEIYLDKIRDLLDVSKTNLAVHEDKNRVPYVKGCTERFVSSPEEVMDVIDEGKANRHVAVTNMNEHSSRSHSIFLINIKQENVETEKKLSGKLYLVDLAGSEKVSKTGAEGAVLDEAKNINKSLSALGNVISALAEGTKTHVPYRDSKMTRILQDSLGGNCRTTIVICCSPSVFNEAETKSTLMFGQRAKTIKNTVSVNLELTAEEWKKKYEKEKEKNKTLKNVIQHLEMELNRWRNGEAVPEDEQISAKDQKNLEPCDNTPIIDNIAPVVAGISTEEKEKYDEEISSLYRQLDDKDDEINQQSQLAEKLKQQMLDQDELLASTRRDYEKIQEELTRLQIENEAAKDEVKEVLQALEELAVNYDQKSQEVEDKTRANEQLTDELAQKTTTLTTTQRELSQLQELSNHQKKRATEILNLLLKDLGEIGGIIGTNDVKTLADVNGVIEEEFTMARLYISKMKSEVKSLVNRSKQLESAQMDSNRKMNASERELAACQLLISQHEAKIKSLTDYMQNMEQKRRQLEESQDSLSEELAKLRAQEKMHEVSFQDKEKEHLTRLQDAEEMKKALEQQMESHREAHQKQLSRLRDEIEEKQKIIDEIRDLNQKLQLEQEKLSSDYNKLKIEDQEREMKLEKLLLLNDKREQAREDLKGLEETVSRELQTLHNLRKLFVQDLTTRVKKSVELDNDDGGGSAAQKQKISFLENNLEQLTKVHKQLVRDNADLRCELPKLEKRLRATAERVKALESALKEAKENAMRDRKRYQQEVDRIKEAVRAKNMARRAHSAQIAKPIRPGHYPASSPTAVHAIRGGGGSSSNSTHYQK

SEQ ID NO: 44337 - protein, 860 aa, Homo sapiens
  Payload ID: 9044
  Gene Symbol: KIF5C
  Gene Name: kinesin family member 5C
  ENSP ID: ENSP00000480293
GKLHDPQLMGIIPRIAHDIFDHIYSMDENLEFHIKVSYFEIYLDKIRDLLDVSKTNLAVHEDKNRVPYVKGCTERFVSSPEEVMDVIDEGKANRHVAVTNMNEHSSRSHSIFLINIKQENVETEKKLSGKLYLVDLAGSEKVSKTGAEGAVLDEAKNINKSLSALGNVISALAEGTKTHVPYRDSKMTRILQDSLGGNCRTTIVICCSPSVFNEAETKSTLMFGQRAKTIKNTVSVNLELTAEEWKKKYEKEKEKNKTLKNVIQHLEMELNRWRNGEAVPEDEQISAKDQKNLEPCDNTPIIDNIAPVVAGISTEEKEKYDEEISSLYRQLDDKDDEINQQSQLAEKLKQQMLDQDELLASTRRDYEKIQEELTRLQIENEAAKDEVKEVLQALEELAVNYDQKSQEVEDKTRANEQLTDELAQKTTTLTTTQRELSQLQELSNHQKKRATEILNLLLKDLGEIGGIIGTNDVKTLADVNGVIEEEFTMARLYISKMKSEVKSLVNRSKQLESAQMDSNRKMNASERELAACQLLISQHEAKIKSLTDYMQNMEQKRRQLEESQDSLSEELAKLRAQEKMHEVSFQDKEKEHLTRLQDAEEMKKALEQQMESHREAHQKQLSRLRDEIEEKQKIIDEIRDLNQKLQLEQEKLSSDYNKLKIEDQEREMKLEKLLLLNDKREQAREDLKGLEETVSRELQTLHNLRKLFVQDLTTRVKKSVELDNDDGGGSAAQKQKISFLENNLEQLTKVHKQLVRDNADLRCELPKLEKRLRATAERVKALESALKEAKENAMRDRKRYQQEVDRIKEAVRAKNMARRAHSAQIAKPIRPGHYPASSPTAVHAIRGGGGSSSNSTHYQK

SEQ ID NO: 44338 - protein, 265 aa, Homo sapiens
  Payload ID: 9045
  Gene Symbol: KIF6
  Gene Name: kinesin family member 6
  Uniprot ID: Q6ZMV9
  ENSP ID: ENSP00000229913
MREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSSGGWEVQDQGTGRFDVCDVNARKILPSPCPSPHSQKQSSTSTPLEDSIPKRPVSSIPLTGDSQTDSDIIAFIKARQSILQKQCLGSN

SEQ ID NO: 44339 - protein, 814 aa, Homo sapiens
  Payload ID: 9045
  Gene Symbol: KIF6
  Gene Name: kinesin family member 6
  Uniprot ID: Q6ZMV9
  ENSP ID: ENSP00000287152
MVKQTIQIFARVKPPVRKHQQGIYSIDEDEKLIPSLEIILPRDLADGFVNNKRESYKFKFQRIFDQDANQETVFENIAKPVAGSVLAGYNGTIFAYGQTGSGKTFTITGGAERYSDRGIIPRTLSYIFEQLQKDSSKIYTTHISYLEIYNECGYDLLDPRHEASSLEDLPKVTILEDPDQNIHLKNLTLHQATTEEEALNLLFLGDTNRMIAETPMNQASTRSHCIFTIHLSSKEPGSATVRHAKLHLVDLAGSERVAKTGVGGHLLTEAKYINLSLHYLEQVIIALSEKHRSHIPYRNSMMTSVLRDSLGGNCMTTMIATLSLEKRNLDESISTCRFAQRVALIKNEAVLNEEINPRLVIKRLQKEIQELKDELAMVTGEQRTEALTEAELLQLEKLITSFLEDQDSDSRLEVGADMRKVHHCFHHLKKLLNDKKILENNTVSSESKDQDCQEPLKEEEYRKLRDILKQRDNEINILVNMLKKEKKKAQEALHLAGMDRREFRQSQSPPFRLGNPEEGQRMRLSSAPSQAQDFSILGKRSSLLHKKIGMREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSSGGWEVQDQGTGRFDVCDVNARKILPSPCPSPHSQKQSSTSTPLEDSIPKRPVSSIPLTGDSQTDSDIIAFIKARQSILQKQCLGSN

SEQ ID NO: 44340 - protein, 248 aa, Homo sapiens
  Payload ID: 9045
  Gene Symbol: KIF6
  Gene Name: kinesin family member 6
  ENSP ID: ENSP00000377889
MREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSDVNARKILPSPCPSPHSQKQSSTSTPLEDSIPKRPVSSIPLTGDSQTDSDIIAFIKARQSILQKQCLGSN

SEQ ID NO: 44341 - protein, 161 aa, Homo sapiens
  Payload ID: 9045
  Gene Symbol: KIF6
  Gene Name: kinesin family member 6
  ENSP ID: ENSP00000404856
TPMNQASTRSHCIFTIHLSSKEPGSATVRHAKLHLVDLAGSERVAKTGVGGHLLTEAKYINLSLHYLEQVIIALSEKHRSHIPYRNSMMTSVLRDSLGGNCMTTMIATLSLEKRNLDESISTCRFAQRVALIKNEAVLNEEINPRLKAPSSSDGVLFCRNQ

SEQ ID NO: 44342 - protein, 689 aa, Homo sapiens
  Payload ID: 9045
  Gene Symbol: KIF6
  Gene Name: kinesin family member 6
  ENSP ID: ENSP00000409417
  MOD_RES (1)..(1): Any amino acid
XGAERYSDRGIIPRTLSYIFEQLQKDSSKIYTTHISYLEIYNECGYDLLDPRHEASSLEDLPKVTILEDPDQNIHLKNLTLHQATTEEEALNLLFLGDTNRMIAETPMNQASTRSHCIFTIHLSSKEPGSATVRHAKLHLVDLAGSERVAKTGVGGHLLTEAKYINLSLHYLEQVIIALSEKHRSHIPYRNSMMTSVLRDSLGGNCMTTMIATLSLEKRNLDESISTCRFAQRVALIKNEAVLNEEINPRLVIKRLQKEIQELKDELAMVTGEQRTEALTEAELLQLEKLITSFLEDQDSDSRLEVGADMRKVHHCFHHLKKLLNDKKILENNTVSSESKDQDCQEPLKEEEYRKLRDILKQRDNEINILVNMLKKEKKKAQEALHLAGMDRREFRQSQSPPFRLGNPEEGQRMRLSSAPSQAQDFSILGKRSSLLHKKIGMREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSDVNARKILPSPCPSPHSQKQSSTSTPLEDSIPKRPVSSIPLTGDSQTDSDIIAFIKARQSILQKQCLGSN

SEQ ID NO: 44343 - protein, 293 aa, Homo sapiens
  Payload ID: 9045
  Gene Symbol: KIF6
  Gene Name: kinesin family member 6
  ENSP ID: ENSP00000441435
MREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSSGGWEVQDQGTGRFDVCDVNARKILPSPCPSPHSQKQSSTSTPLEDSIPKRPVSSIPLTGDSQTDSDIIAFIKARQSILQKQYLQLLCSLFPKSAVSSAQASTNRKGLSDVLVTR

SEQ ID NO: 44344 - protein, 1343 aa, Homo sapiens
  Payload ID: 9046
  Gene Symbol: KIF7
  Gene Name: kinesin family member 7
  Uniprot ID: Q2M1P5
  ENSP ID: ENSP00000377934
MGLEAQRLPGAEEAPVRVALRVRPLLPKELLHGHQSCLQVEPGLGRVTLGRDRHFGFHVVLAEDAGQEAVYQACVQPLLEAFFEGFNATVFAYGQTGSGKTYTMGEASVASLLEDEQGIVPRAMAEAFKLIDENDLLDCLVHVSYLEVYKEEFRDLLEVGTASRDIQLREDERGNVVLCGVKEVDVEGLDEVLSLLEMGNAARHTGATHLNHLSSRSHTVFTVTLEQRGRAPSRLPRPAPGQLLVSKFHFVDLAGSERVLKTGSTGERLKESIQINSSLLALGNVISALGDPQRRGSHIPYRDSKITRILKDSLGGNAKTVMIACVSPSSSDFDETLNTLNYASRAQNIRNRATVNWRPEAERPPEETASGARGPPRHRSETRIIHRGRRAPGPATASAAAAMRLGAECARYRACTDAAYSLLRELQAEPGLPGAAARKVRDWLCAVEGERSALSSASGPDSGIESASVEDQAAQGAGGRKEDEGAQQLLTLQNQVARLEEENRDFLAALEDAMEQYKLQSDRLREQQEEMVELRLRLELVRPGWGGPRLLNGLPPGSFVPRPHTAPLGGAHAHVLGMVPPACLPGDEVGSEQRGEQVTNGREAGAELLTEVNRLGSGSSAASEEEEEEEEPPRRTLHLRRNRISNCSQRAGARPGSLPERKGPELCLEELDAAIPGSRAVGGSKARVQARQVPPATASEWRLAQAQQKIRELAINIRMKEELIGELVRTGKAAQALNRQHSQRIRELEQEAEQVRAELSEGQRQLRELEGKELQDAGERSRLQEFRRRVAAAQSQVQVLKEKKQATERLVSLSAQSEKRLQELERNVQLMRQQQGQLQRRLREETEQKRRLEAEMSKRQHRVKELELKHEQQQKILKIKTEEIAAFQRKRRSGSNGSVVSLEQQQKIEEQKKWLDQEMEKVLQQRRALEELGEELHKREAILAKKEALMQEKTGLESKRLRSSQALNEDIVRVSSRLEHLEKELSEKSGQLRQGSAQSQQQIRGEIDSLRQEKDSLLKQRLEIDGKLRQGSLLSPEEERTLFQLDEAIEALDAAIEYKNEAITCRQRVLRASASLLSQCEMNLMAKLSYLSSSETRALLCKYFDKVVTLREEQHQQQIAFSELEMQLEEQQRLVYWLEVALERQRLEMDRQLTLQQKEHEQNMQLLLQQSRDHLGEGLADSRRQYEARIQALEKELGRYMWINQELKQKLGGVNAVGHSRGGEKRSLCSEGRQAPGNEDELHLAPELLWLSPLTEGAPRTREETRDLVHAPLPLTWKRSSLCGEEQGSPEELRQREAAEPLVGRVLPVGEAGLPWNFGPLSKPRRELRRASPGMIDVRKNPL

SEQ ID NO: 44345 - protein, 147 aa, Homo sapiens
  Payload ID: 9046
  Gene Symbol: KIF7
  Gene Name: kinesin family member 7
  ENSP ID: ENSP00000395906
MGLEAQRLPGAEEAPVRVALRVRPLLPKELLHGHQSCLQVEPGLGRVTLGRDRHFGFHVVLAEDAGQEAVYQACVQPLLEAFFEGFNATVFAYGQTGSGKTYTMGEASVEHHPPALAGAYELPGLGAMGRVQLKWQEALRCLPSLPP

SEQ ID NO: 44346 - protein, 790 aa, Homo sapiens
  Payload ID: 9047
  Gene Symbol: KIF9
  Gene Name: kinesin family member 9
  Uniprot ID: Q9HAQ2
  ENSP ID: ENSP00000265529
MGTRKKVHAFVRVKPTDDFAHEMIRYGDDKRSIDIHLKKDIRRGVVNNQQTDWSFKLDGVLHDASQDLVYETVAKDVVSQALDGYNGTIMCYGQTGAGKTYTMMGATENYKHRGILPRALQQVFRMIEERPTHAITVRVSYLEIYNESLFDLLSTLPYVGPSVTPMTIVENPQGVFIKGLSVHLTSQEEDAFSLLFEGETNRIIASHTMNKNSSRSHCIFTIYLEAHSRTLSEEKYITSKINLVDLAGSERLGKSGSEGQVLKEATYINKSLSFLEQAIIALGDQKRDHIPFRQCKLTHALKDSLGGNCNMVLVTNIYGEAAQLEETLSSLRFASRMKLVTTEPAINEKYDAERMVKNLEKELALLKQELAIHDSLTNRTFVTYDPMDEIQIAEINSQVRRYLEGTLDEIDIISLRQIKEVFNQFRVVLSQQEQEVESTLRRKYTLIDRNDFAAISAIQKAGLVDVDGHLVGEPEGQNFGLGVAPFSTKPGKKAKSKKTFKEPLSSLARKEGASSPVNGKDLDYVSTSKTQLVPSSKDGDVKDMLSRDRETSSIEPLPSDSPKEELRPIRPDTPPSKPVAFEEFKNEQGSEINRIFKENKSILNERRKRASETTQHINAIKREIDVTKEALNFQKSLREKQGKYENKGLMIIDEEEFLLILKLKDLKKQYRSEYQDLRDLRAEIQYCQHLVDQCRHRLLMEFDIWYNESFVIPEDMQMALKPGGSIRPGMVPVNRIVSLGEDDQDKFSQLQQRVLPEGPDSISFYNAKVKIEQKHNYLKTMMGLQQAHRK

SEQ ID NO: 44347 - protein, 790 aa, Homo sapiens; identical to SEQ ID NO: 44346
  Payload ID: 9047
  Gene Symbol: KIF9
  Gene Name: kinesin family member 9
  Uniprot ID: Q9HAQ2
  ENSP ID: ENSP00000333942

SEQ ID NO: 44348 - protein, 159 aa, Homo sapiens
  Payload ID: 9047
  Gene Symbol: KIF9
  Gene Name: kinesin family member 9
  ENSP ID: ENSP00000387959
MGTRKKVHAFVRVKPTDDFAHEMIRYGDDKRSIDIHLKKDIRRGVVNNQQTDWSFKLDGVLHDASQDLVYETVAKDVVSQALDGYNGTIMCYGQTGAGKTYTMMGATENYKHRGILPRALQQGETNRIIASHTMNKNSSRSHCIFTIYLEAHSRTLSEE

SEQ ID NO: 44349 - protein, 91 aa, Homo sapiens
  Payload ID: 9047
  Gene Symbol: KIF9
  Gene Name: kinesin family member 9
  ENSP ID: ENSP00000391099
MGTRKKVHAFVRVKPTDDFAHEMIRYGDDKRSIDIHLKKDIRRGVVNNQQTDWSFKLDGVLHDASQDLVYETVAKDVVSQALDGYNGNLIN

SEQ ID NO: 44350 - protein, 790 aa, Homo sapiens; identical to SEQ ID NO: 44346
  Payload ID: 9047
  Gene Symbol: KIF9
  Gene Name: kinesin family member 9
  Uniprot ID: Q9HAQ2
  ENSP ID: ENSP00000391100

SEQ ID NO: 44351 - protein, 333 aa, Homo sapiens
  Payload ID: 9047
  Gene Symbol: KIF9
  Gene Name: kinesin family member 9
  ENSP ID: ENSP00000405774
MGTRKKVHAFVRVKPTDDFAHEMIRYGDDKRSIDIHLKKDIRRGVVNNQQTDWSFKLDGVLHDASQDLVYETVAKDVVSQALDGYNGTIMCYGQTGAGKTYTMMGATENYKHRGILPRALQQVFRMIEERPTHAITVRVSYLEIYNESLFDLLSTLPYVGPSVTPMTIVENPQGVFIKGLSVHLTSQEEDAFSLLFEGETNRIIASHTMNKNSSRSHCIFTIYLEAHSRTLSEEKYITSKINLVDLAGSERLGKSGSEGQVLKEATYINKSLSFLEQAIIALGDQKRDHIPFRQCKLTHALKDSLGGNCNMVLVTNIYGEAAQLEETGSRLWL

SEQ ID NO: 44352 - protein, 105 aa, Homo sapiens
  Payload ID: 9047
  Gene Symbol: KIF9
  Gene Name: kinesin family member 9
  ENSP ID: ENSP00000406603
MKRRKNGNKQYFTRMGTRKKVHAFVRVKPTDDFAHEMIRYGDDKRSIDIHLKKDIRRGVVNNQQTDWSFKLDGVLHDASQDLVYETVAKDVVSQALDGYNGNLIN

SEQ ID NO: 44353 - protein, 91 aa, Homo sapiens; identical to SEQ ID NO: 44349
  Payload ID: 9047
  Gene Symbol: KIF9
  Gene Name: kinesin family member 9
  ENSP ID: ENSP00000406815

SEQ ID NO: 44354 - protein, 725 aa, Homo sapiens
  Payload ID: 9047
  Gene Symbol: KIF9
  Gene Name: kinesin family member 9
  Uniprot ID: Q9HAQ2
  ENSP ID: ENSP00000414987
MGTRKKVHAFVRVKPTDDFAHEMIRYGDDKRSIDIHLKKDIRRGVVNNQQTDWSFKLDGVLHDASQDLVYETVAKDVVSQALDGYNGTIMCYGQTGAGKTYTMMGATENYKHRGILPRALQQVFRMIEERPTHAITVRVSYLEIYNESLFDLLSTLPYVGPSVTPMTIVENPQGVFIKGLSVHLTSQEEDAFSLLFEGETNRIIASHTMNKNSSRSHCIFTIYLEAHSRTLSEEKYITSKINLVDLAGSERLGKSGSEGQVLKEATYINKSLSFLEQAIIALGDQKRDHIPFRQCKLTHALKDSLGGNCNMVLVTNIYGEAAQLEETLSSLRFASRMKLVTTEPAINEKYDAERMVKNLEKELALLKQELAIHDSLTNRTFVTYDPMDEIQIAEINSQVRRYLEGTLDEIDIISLRQIKEVFNQFRVVLSQQEQEVESTLRRKYTLIDRNDFAAISAIQKAGLVDVDGHLVGEPEGQNFGLGVAPFSTKPGKKAKSKKTFKEPLRPDTPPSKPVAFEEFKNEQGSEINRIFKENKSILNERRKRASETTQHINAIKREIDVTKEALNFQKSLREKQGKYENKGLMIIDEEEFLLILKLKDLKKQYRSEYQDLRDLRAEIQYCQHLVDQCRHRLLMEFDIWYNESFVIPEDMQMALKPGGSIRPGMVPVNRIVSLGEDDQDKFSQLQQRVLPEGPDSISFYNAKVKIEQKHNYLKTMMGLQQAHRK

SEQ ID NO: 44355 - protein, 673 aa, Homo sapiens
  Payload ID: 9048
  Gene Symbol: KIFC1
  Gene Name: kinesin family member C1
  Uniprot ID: Q9BW19
  ENSP ID: ENSP00000363647
MDPQRSPLLEVKGNIELKRPLIKAPSQLPLSGSRLKRRPDQMEDGLEPEKKRTRGLGATTKITTSHPRVPSLTTVPQTQGQTTAQKVSKKTGPRCSTAIATGLKNQKPVPAVPVQKSGTSGVPPMAGGKKPSKRPAWDLKGQLCDLNAELKRCRERTQTLDQENQQLQDQLRDAQQQVKALGTERTTLEGHLAKVQAQAEQGQQELKNLRACVLELEERLSTQEGLVQELQKKQVELQEERRGLMSQLEEKERRLQTSEAALSSSQAEVASLRQETVAQAALLTEREERLHGLEMERRRLHNQLQELKGNIRVFCRVRPVLPGEPTPPPGLLLFPSGPGGPSDPPTRLSLSRSDERRGTLSGAPAPPTRHDFSFDRVFPPGSGQDEVFEEIAMLVQSALDGYPVCIFAYGQTGSGKTFTMEGGPGGDPQLEGLIPRALRHLFSVAQELSGQGWTYSFVASYVEIYNETVRDLLATGTRKGQGGECEIRRAGPGSEELTVTNARYVPVSCEKEVDALLHLARQNRAVARTAQNERSSRSHSVFQLQISGEHSSRGLQCGAPLSLVDLAGSERLDPGLALGPGERERLRETQAINSSLSTLGLVIMALSNKESHVPYRNSKLTYLLQNSLGGSAKMLMFVNISPLEENVSESLNSLRFASKVNQCVIGTAQANRK

SEQ ID NO: 44356 - protein, 673 aa, Homo sapiens; identical to SEQ ID NO: 44355
  Payload ID: 9048
  Gene Symbol: KIFC1
  Gene Name: kinesin family member C1
  Uniprot ID: Q9BW19
  ENSP ID: ENSP00000393963

SEQ ID NO: 44357 - protein, 203 aa, Homo sapiens
  Payload ID: 9048
  Gene Symbol: KIFC1
  Gene Name: kinesin family member C1
  ENSP ID: ENSP00000400323
MDPQRSPLLEVKGNIELKRPLIKAPSQLPLSGSRLKRRPDQMEDGLEPEKKRTRGLGATTKITTSHPRVPSLTTVPQTQGQTTGPSSHPLPWQCHHQPFLVTDPGGRSWGPGQKWHRLHLWCTSAQKVSKKTGPRCSTAIATGLKNQKPVPAVPVQKSGTSGVPPMAGGKKPSKRPAWDLKGQLCDLNAELKRCRERTQTLDQ

SEQ ID NO: 44358 - protein, 673 aa, Homo sapiens; identical to SEQ ID NO: 44355
  Payload ID: 9048
  Gene Symbol: KIFC1
  Gene Name: kinesin family member C1
  Uniprot ID: Q9BW19
  ENSP ID: ENSP00000407885

SEQ ID NO: 44359 - protein, 203 aa, Homo sapiens
  Payload ID: 9048
  Gene Symbol: KIFC1
  Gene Name: kinesin family member C1
  ENSP ID: ENSP00000409539
MDPQRSPLLEVKGNIELKRPLIKAPSQLPLSGSRLKRRPDQMEDGLEPEKKRTRGLGATTKITTSHPRVPSLTTVPQTQGQTTGPSSHPLPWQCHHQPFLETDPGGRSWGPGQKWHRLHLWCTSAQKVSKKTGPRCSTAIATGLKNQKPVPAVPVQKSGTSGVPPMAGGKKPSKRPAWDLKGQLCDLNAELKRCRERTQTLDQ

SEQ ID NO: 44360 - protein, 203 aa, Homo sapiens; identical to SEQ ID NO: 44359
  Payload ID: 9048
  Gene Symbol: KIFC1
  Gene Name: kinesin family member C1
  ENSP ID: ENSP00000415907

SEQ ID NO: 44361 - protein, 154 aa, Homo sapiens
  Payload ID: 9048
  Gene Symbol: KIFC1
  Gene Name: kinesin family member C1
  ENSP ID: ENSP00000484508
  MOD_RES (1)..(1): Any amino acid
XQNRAVARTAQNERSSRSHSVFQLQISGEHSSRGLQCGAPLSLVDLAGSERLDPGLALGPGERERLRETQAINSSLSTLGLVIMALSNKESHVPYRNSKLTYLLQNSLGGSAKMLMFVNISPLEENVSESLNSLRFASKVRLPPVSLVRTRGWL

SEQ ID NO: 44362 - protein, 838 aa, Homo sapiens
  Payload ID: 9049
  Gene Symbol: KIFC2
  Gene Name: kinesin family member C2
  Uniprot ID: Q96AC6
  ENSP ID: ENSP00000301332
MYAFYSLLIYIFYSLFRRDGGAAAAAEPGDPAQRARKPRGRRRPDLPAPELWTELTGLAASSEPEDGSEGAAEGRAAAVSLEEALLRLAEFLSVQLGAEESCGGPADLGQSGEVPSLLTVTSQLLALLAWLRSPRGRQALLQGTQPAPRVRPPSPDGSTSQEESPSHFTAVPGEPLGDETQGQQPLQLEEDQRAWQRLEQLILGQLEELKQQLEQQEEELGRLRLGVGATDSEKRVQHLTLENEALKQSLSLMRDLLLHWGPGPPIRAPQEEAEALLELQGRLQEAQDTTEALRAQLGVQEVQLQGLQGALQQLQQETEQNCRRELQQMHGQLAGLRARMASLRQGCGDLRGLVSTFTQSCQGSLSEARGQVSWALGALSSGGPGTQLPEGQQGPPAGCPGRLPELKGNIRVLCRLRPGTSSSLVSVEPGPGGTVTTCYRGRHRRFRLDWVFPPDASQEEVFRELEPAVLSCLRGYSVCIFTYGQTGTGKTYSMEGPPEDPGIVPRALQSLFREMGAGRQHRVTLSMVEIYNEAVRDLLAPGPPERLAVRQGPEGQGGIQVAGLTHWDVPNLETLHQMLKLGRSNRATAATAMNQRSSRSHALVTLTLRAASPPRAPGTAGTLHLVDLAGSERARKAGAAGPPRGDPDGARRLREAQTINRSLLALGGVMAALRAHRPHVPFRDSQLTRLLQPALGPGTTAVLLLQVGAGAGQVCACRSPPTRARPPAPLARRSPRGRRISGRQSAPSSSPTEWVKWSWGQPGAAGSRAPPGRLLPSAPTLRSPGPPAPLRRPLAVLHAPVPTTARARLSRPQRACPSSPGSRPCPWGLRPGLCWQRR

SEQ ID NO: 44363 - protein, 833 aa, Homo sapiens
  Payload ID: 9050
  Gene Symbol: KIFC3
  Gene Name: kinesin family member C3
  Uniprot ID: Q9BVG8
  ENSP ID: ENSP00000368976
MVPSRRTWNLGATPSLRGLWRVGRAPEPEPGMARPAPAPASPAARPFPHTGPGRLRTGRGKDTPVCGDEDSSARSAARPALAQCRALSVDWAGPGSPHGLYLTLQVEHLKEKLISQAQEVSRLRSELGGTDLEKHRDLLMVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDVFQEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQGHVPFRNSKLTYLLQDSLSGDSKTLMVVQVSPVEKNTSETLYSLKFAERVRSVELGPGLRRAELGSWSSQEHLEWEPACQTPQPSARAHSAPSSGTSSRPGSIRRKLQPSGKSRPLPV

SEQ ID NO: 44364 - protein, 687 aa, Homo sapiens
  Payload ID: 9050
  Gene Symbol: KIFC3
  Gene Name: kinesin family member C3
  Uniprot ID: Q9BVG8
  ENSP ID: ENSP00000396399
MVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDVFQEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQGHVPFRNSKLTYLLQDSLSGDSKTLMVVQVSPVEKNTSETLYSLKFAERVRSVELGPGLRRAELGSWSSQEHLEWEPACQTPQPSARAHSAPSSGTSSRPGSIRRKLQPSA

SEQ ID NO: 44365 - protein, 826 aa, Homo sapiens
  Payload ID: 9050
  Gene Symbol: KIFC3
  Gene Name: kinesin family member C3
  Uniprot ID: Q9BVG8
  ENSP ID: ENSP00000401696
MVPSRRTWNLGATPSLRGLWRVGRAPEPEPGMARPAPAPASPAARPFPHTGPGRLRTGRGKDTPVCGDEDSSARSAARPALAQCRALSVDWAGPGSPHGLYLTLQVEHLKEKLISQAQEVSRLRSELGGTDLEKHRDLLMVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDVFQEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQGHVPFRNSKLTYLLQDSLSGDSKTLMVVQVSPVEKNTSETLYSLKFAERVRSVELGPGLRRAELGSWSSQEHLEWEPACQTPQPSARAHSAPSSGTSSRPGSIRRKLQPSA

SEQ ID NO: 44366 - protein, 724 aa, Homo sapiens
  Payload ID: 9050
  Gene Symbol: KIFC3
  Gene Name: kinesin family member C3
  ENSP ID: ENSP00000438805
MIKVEHLKEKLISQAQEVSRLRSELGGTDLEKHRDLLMVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDVFQEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQGHVPFRNSKLTYLLQDSLSGDSKTLMVVQVSPVEKNTSETLYSLKFAERVRSVELGPGLRRAELGSWSSQEHLEWEPACQTPQPSARAHSAPSSGTSSRPGSIRRKLQPSA

SEQ ID NO: 44367 - protein, 848 aa, Homo sapiens
  Payload ID: 9050
  Gene Symbol: KIFC3
  Gene Name: kinesin family member C3
  Uniprot ID: Q9BVG8
  ENSP ID: ENSP00000442008
MCASACKDTAAWCPEEAAEPQAMVPSRRTWNLGATPSLRGLWRVGRAPEPEPGMARPAPAPASPAARPFPHTGPGRLRTGRGKDTPVCGDEDSSARSAARPALAQCRALSVDWAGPGSPHGLYLTLQVEHLKEKLISQAQEVSRLRSELGGTDLEKHRDLLMVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDVFQEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQGHVPFRNSKLTYLLQDSLSGDSKTLMVVQVSPVEKNTSETLYSLKFAERVRSVELGPGLRRAELGSWSSQEHLEWEPACQTPQPSARAHSAPSSGTSSRPGSIRRKLQPSA

SEQ ID NO: 44368 - protein, 684 aa, Homo sapiens
  Payload ID: 9050
  Gene Symbol: KIFC3
  Gene Name: kinesin family member C3
  ENSP ID: ENSP00000444012
MVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQGHVPFRNSKLTYLLQDSLSGDSKTLMVVQVSPVEKNTSETLYSLKFAERVRSVELGPGLRRAELGSWSSQEHLEWEPACQTPQPSARAHSAPSSGTSSRPGSIRRKLQPSA

SEQ ID NO: 44369 - protein, 59 aa, Homo sapiens
  Payload ID: 9050
  Gene Symbol: KIFC3
  Gene Name: kinesin family member C3
  ENSP ID: ENSP00000454403
MVENERLRQEMRRCEAELQELRTKPAGPCPGCEHSQESAQLRDKLSQLQLEMAESKGML

SEQ ID NO: 44370 - protein, 167 aa, Homo sapiens
  Payload ID: 9050
  Gene Symbol: KIFC3
  Gene Name: kinesin family member C3
  ENSP ID: ENSP00000454493
MVLRMVEAMSQLQDEKTQLQEELVVLQERLALRDSDQQATSTQLQNQVEHLKEKLISQAQEVSRLRSELGGTDLEKHRDLLMVENERLRQEMRRCEAELQELRTKPAGPCPGCEHSQESAQLRDKLSQLQLEMAESKGMLSELNLEVQQKTDRLAEVELRLKDCLAE

SEQ ID NO: 44371 - protein, 70 aa, Homo sapiens
  Payload ID: 9050
  Gene Symbol: KIFC3
  Gene Name: kinesin family member C3
  ENSP ID: ENSP00000454501
MVENERLRQEMRRCEAELQELRTKPAGPCPGCEHSQESAQLRDKLSQLQLEMAESKGMLSELNLEVQQKT

SEQ ID NO: 44372 - protein, 88 aa, Homo sapiens
  Payload ID: 9050
  Gene Symbol: KIFC3
  Gene Name: kinesin family member C3
  ENSP ID: ENSP00000454615
MVLRMVEAMSQLQDEKTQLQEELVVLQERLALRDSDQQATSTQLQNQVEHLKEKLISQAQEVSRLRSELGGTDLEKHRDLLMVENERL

SEQ ID NO: 44373 - protein, 5 aa, Homo sapiens
  Payload ID: 9050
  Gene Symbol: KIFC3
  Gene Name: kinesin family member C3
  ENSP ID: ENSP00000454632
MVENE

SEQ ID NO: 44374 - protein, 687 aa, Homo sapiens; identical to SEQ ID NO: 44364
  Payload ID: 9050
  Gene Symbol: KIFC3
  Gene Name: kinesin family member C3
  Uniprot ID: Q9BVG8
  ENSP ID: ENSP00000454659

SEQ ID NO: 44375 - protein, 105 aa, Homo sapiens
  Payload ID: 9050
  Gene Symbol: KIFC3
  Gene Name: kinesin family member C3
  ENSP ID: ENSP00000455067
MVPSRRTWNLGATPSLRGLWRVGRAPEPEPGMARPAPAPASPAARPFPHTGPGRLRTGRGKDTPVCGDEDSSARSAARPALAQCRALSVDWAGPGSPHGLYLTLQ

SEQ ID NO: 44376 - protein, 132 aa, Homo sapiens
  Payload ID: 9050
  Gene Symbol: KIFC3
  Gene Name: kinesin family member C3
  ENSP ID: ENSP00000455276
MVPSRRTWNLGATPSLRGLWRVGRAPEPEPGMARPAPAPASPAARPFPHTGPGRLRTGRGKDTPVCGDEDSSARSAARPALAQCRALSVDWAGPGSPHGLYLTLQVEHLKEKLISQAQEVSRLRSELGGTDL

SEQ ID NO: 44377 - protein, 687 aa, Homo sapiens; identical to SEQ ID NO: 44364
  Payload ID: 9050
  Gene Symbol: KIFC3
  Gene Name: kinesin family member C3
  Uniprot ID: Q9BVG8
  ENSP ID: ENSP00000456239

SEQ ID NO: 44378 - protein, 154 aa, Homo sapiens
  Payload ID: 9050
  Gene Symbol: KIFC3
  Gene Name: kinesin family member C3
  ENSP ID: ENSP00000456354
MAQMEFLFRKNTLTAAWKPRHQETLRLEAGVPEQCKAAWCPEEAAEPQAMVPSRRTWNLGATPSLRGLWRVGRAPEPEPGMARPAPAPASPAARPFPHTGPGRLRTGRGKDTPVCGDEDSSARSAARPALAQCRALSVDWAGPGSPHGLYLTLQ

SEQ ID NO: 44379 - protein, 5 aa, Homo sapiens
  Payload ID: 9050
  Gene Symbol: KIFC3
  Gene Name: kinesin family member C3
  ENSP ID: ENSP00000456402
MVENE

SEQ ID NO: 44380 - protein, 190 aa, Homo sapiens
  Payload ID: 9050
  Gene Symbol: KIFC3
  Gene Name: kinesin family member C3
  ENSP ID: ENSP00000456780
MLPLFGRQRTEWLLQAAWCPEEAAEPQAMVPSRRTWNLGATPSLRGLWRVGRAPEPEPGMARPAPAPASPAARPFPHTGPGRLRTGRGKDTPVCGDEDSSARSAARPALAQCRALSVDWAGPGSPHGLYLTLQVEHLKEKLISQAQEVSRLRSELGGTDLEKHRDLLMVENERLRQEMRRCEAELQELRT

SEQ ID NO: 44381 - protein, 165 aa, Homo sapiens
  Payload ID: 9050
  Gene Symbol: KIFC3
  Gene Name: kinesin family member C3
  ENSP ID: ENSP00000457144
MCASACKDTAAWCPEEAAEPQAMVPSRRTWNLGATPSLRGLWRVGRAPEPEPGMARPAPAPASPAARPFPHTGPGRLRTGRGKDTPVCGDEDSSARSAARPALAQCRALSVDWAGPGSPHGLYLTLQQALQDKGCKSQSQGTKEEKLWKRQAPAPRRAREAREAG

SEQ ID NO: 44382 - protein, 280 aa, Homo sapiens
  Payload ID: 9050
  Gene Symbol: KIFC3
  Gene Name: kinesin family member C3
  ENSP ID: ENSP00000457232
MEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQGHVPFRNSKLTYLLQDSLSGDSKTLMVVQVSPVEKNTSETLYSLKFAERVRSVELGPGLRRAELGSWSSQEHLEWEPACQTPQPSARAHSAPSSGTSSRPGS

SEQ ID NO: 44383 - protein, 60 aa, Homo sapiens
  Payload ID: 9050
  Gene Symbol: KIFC3
  Gene Name: kinesin family member C3
  ENSP ID: ENSP00000457247
MVENERLRQEMRRCEAELQELRTKPAGPCPGCEHSQESAQLRDKLSQLQLEMAESKGMLS

SEQ ID NO: 44384 - protein, 147 aa, Homo sapiens
  Payload ID: 9050
  Gene Symbol: KIFC3
  Gene Name: kinesin family member C3
  ENSP ID: ENSP00000457326
MVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQV

SEQ ID NO: 44385 - protein, 196 aa, Homo sapiens
  Payload ID: 9050
  Gene Symbol: KIFC3
  Gene Name: kinesin family member C3
  ENSP ID: ENSP00000457568
  MOD_RES (1)..(1): Any amino acid
XLVDLAGSERVGKSGAEGSRLREAQHINKSLSALGDVIAALRSRQGHVPFRNSKLTYLLQDSLSGDSKTLMVVQGSRGHCLCDGCDPAGPEAGPSLACPCCSARTPGGRGESGGSSSAPSPLKDEKHVQKETVSLGCGSECKLHGRKGGGGCSSWQAWAISELGPVRRAGVWRRVGLSPRLSRPLSSACRAGQPPP

SEQ ID NO: 44386 - protein, 104 aa, Homo sapiens
  Payload ID: 9050
  Gene Symbol: KIFC3
  Gene Name: kinesin family member C3
  ENSP ID: ENSP00000457948
MIKVEHLKEKLISQAQEVSRLRSELHRDLLMVENERLRQEMRRCEAELQELRTKPAGPCPGCEHSQESAQLRDKLSQLQLEMAESKGMLSELNLEVQQKTDRLA

SEQ ID NO: 44387 - protein, 498 aa, Homo sapiens
  Payload ID: 9050
  Gene Symbol: KIFC3
  Gene Name: kinesin family member C3
  ENSP ID: ENSP00000458009
MVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDVFQEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVWRREPLTTATLL

SEQ ID NO: 44388 - protein, 686 aa, Homo sapiens
  Payload ID: 9051
  Gene Symbol: KIF2A
  Gene Name: kinesin heavy chain member 2A
  Uniprot ID: O00139
  ENSP ID: ENSP00000370493
MGRIHQAMVTSLNEDNESVTVEWIENGDTKGKEIDLESIFSLNPDLVPDEEIEPSPETPPPPASSAKVNKIVKNRRTVASIKNDPPSRDNRVVGSARARPSQFPEQSSSAQQNGSVSDISPVQAAKKEFGPPSRRKSNCVKEVEKLQEKREKRRLQQQELREKRAQDVDATNPNYEIMCMIRDFRGSLDYRPLTTADPIDEHRICVCVRKRPLNKKETQMKDLDVITIPSKDVVMVHEPKQKVDLTRYLENQTFRFDYAFDDSAPNEMVYRFTARPLVETIFERGMATCFAYGQTGSGKTHTMGGDFSGKNQDCSKGIYALAARDVFLMLKKPNYKKLELQVYATFFEIYSGKVFDLLNRKTKLRVLEDGKQQVQVVGLQEREVKCVEDVLKLIDIGNSCRTSGQTSANAHSSRSHAVFQIILRRKGKLHGKFSLIDLAGNERGADTSSADRQTRLEGAEINKSLLALKECIRALGRNKPHTPFRASKLTQVLRDSFIGENSRTCMIATISPGMASCENTLNTLRYANRVKELTVDPTAAGDVRPIMHHPPNQIDDLETQWGVGSSPQRDDLKLLCEQNEEEVSPQLFTFHEAVSQMVEMEEQVVEDHRAVFQESIRWLEDEKALLEMTEEVDYDVDSYATQLEAILEQKIDILTELRDKVKSFRAALQEEEQASKQINPKRPRAL

SEQ ID NO: 44389 - protein, 744 aa, Homo sapiens
  Payload ID: 9051
  Gene Symbol: KIF2A
  Gene Name: kinesin heavy chain member 2A
  Uniprot ID: O00139
  ENSP ID: ENSP00000385000
MATANFGKIQIGIYVEIKRSDGRIHQAMVTSLNEDNESVTVEWIENGDTKGKEIDLESIFSLNPDLVPDEEIEPSPETPPPPASSAKVNKIVKNRRTVASIKNDPPSRDNRVVGSARARPSQFPEQSSSAQQNGSVSDISPVQAAKKEFGPPSRRKSNCVKEVEKLQEKREKRRLQQQELREKRAQDVDATNPNYEIMCMIRDFRGSLDYRPLTTADPIDEHRICVCVRKRPLNKKETQMKDLDVITIPSKDVVMVHEPKQKVDLTRYLENQTFRFDYAFDDSAPNEMVYRFTARPLVETIFERGMATCFAYGQTGSGKTHTMGGDFSGKNQDCSKGIYALAARDVFLMLKKPNYKKLELQVYATFFEIYSGKVFDLLNRKTKLRVLEDGKQQVQVVGLQEREVKCVEDVLKLIDIGNSCRTSGQTSANAHSSRSHAVFQIILRRKGKLHGKFSLIDLAGNERGADTSSADRQTRLEGAEINKSLLALKECIRALGRNKPHTPFRASKLTQVLRDSFIGENSRTCMIATISPGMASCENTLNTLRYANRVKEFGISPSDIPFSQGSGSRPDLSPSYEYDDFSPSVTRVKELTVDPTAAGDVRPIMHHPPNQIDDLETQWGVGSSPQRDDLKLLCEQNEEEVSPQLFTFHEAVSQMVEMEEQVVEDHRAVFQESIRWLEDEKALLEMTEEVDYDVDSYATQLEAILEQKIDILTELRDKVKSFRAALQEEEQASKQINPKRPRAL

SEQ ID NO: 44390 - protein, 706 aa, Homo sapiens
  Payload ID: 9051
  Gene Symbol: KIF2A
  Gene Name: kinesin heavy chain member 2A
  Uniprot ID: O00139
  ENSP ID: ENSP00000385622
MATANFGKIQIGIYVEIKRSDGRIHQAMVTSLNEDNESVTVEWIENGDTKGKEIDLESIFSLNPDLVPDEEIEPSPETPPPPASSAKVNKIVKNRRTVASIKNDPPSRDNRVVGSARARPSQFPEQSSSAQQNGSVSDISPVQAAKKEFGPPSRRKSNCVKEVEKLQEKREKRRLQQQELREKRAQDVDATNPNYEIMCMIRDFRGSLDYRPLTTADPIDEHRICVCVRKRPLNKKETQMKDLDVITIPSKDVVMVHEPKQKVDLTRYLENQTFRFDYAFDDSAPNEMVYRFTARPLVETIFERGMATCFAYGQTGSGKTHTMGGDFSGKNQDCSKGIYALAARDVFLMLKKPNYKKLELQVYATFFEIYSGKVFDLLNRKTKLRVLEDGKQQVQVVGLQEREVKCVEDVLKLIDIGNSCRTSGQTSANAHSSRSHAVFQIILRRKGKLHGKFSLIDLAGNERGADTSSADRQTRLEGAEINKSLLALKECIRALGRNKPHTPFRASKLTQVLRDSFIGENSRTCMIATISPGMASCENTLNTLRYANRVKELTVDPTAAGDVRPIMHHPPNQIDDLETQWGVGSSPQRDDLKLLCEQNEEEVSPQLFTFHEAVSQMVEMEEQVVEDHRAVFQESIRWLEDEKALLEMTEEVDYDVDSYATQLEAILEQKIDILTELRDKVKSFRAALQEEEQASKQINPKRPRAL

SEQ ID NO: 44391 - protein, 130 aa, Homo sapiens
  Payload ID: 9051
  Gene Symbol: KIF2A
  Gene Name: kinesin heavy chain member 2A
  ENSP ID: ENSP00000421041
GQTGSGKTHVFDLLNRKTKLRVLEDGKQQVQVVGLQEREVKCVEDVLKLIDIGNSCRVKELTVDPTAAGDVRPIMHHPPNQIDDLETQWGVGSSPQRDDLKLLCEQNEEEVSPQLFTFHEAVSQMVEMEE

SEQ ID NO: 44392 - protein, 284 aa, Homo sapiens
  Payload ID: 9051
  Gene Symbol: KIF2A
  Gene Name: kinesin heavy chain member 2A
  ENSP ID: ENSP00000423542
MATANFGKIQIGIYVEIKRSDGRIHQAMVTSLNEDNESVTVEWIENGDTKGKEIDLESIFSLNPDLVPDEEIEPSPETPPPPASSAKVNKIVKNRRTVASIKNDPPSRDNRVVGSARARPSQFPEQSSSAQQNARRKSNCVKEVEKLQEKREKRRLQQQELREKRAQDVDATNPNYEIMCMIRDFRGSLDYRPLTTADPIDEHRICVCVRKRPLNKKETQMKDLDVITIPSKDVVMVHEPKQKVDLTRYLENQTFRFDYAFDDSAPNEMVYRFTARPLVETIFE

SEQ ID NO: 44393 - protein, 660 aa, Homo sapiens
  Payload ID: 9051
  Gene Symbol: KIF2A
  Gene Name: kinesin heavy chain member 2A
  Uniprot ID: O00139
  ENSP ID: ENSP00000423772
MVTSLNEDNESVTVEWIENGDTKGKEIDLESIFSLNPDLVPDEEIEPSPETPPPPASSAKVNKIVKNRRTVASIKNDPPSRDNRVVGSARARPSQFPEQSSSAQQNARRKSNCVKEVEKLQEKREKRRLQQQELREKRAQDVDATNPNYEIMCMIRDFRGSLDYRPLTTADPIDEHRICVCVRKRPLNKKETQMKDLDVITIPSKDVVMVHEPKQKVDLTRYLENQTFRFDYAFDDSAPNEMVYRFTARPLVETIFERGMATCFAYGQTGSGKTHTMGGDFSGKNQDCSKGIYALAARDVFLMLKKPNYKKLELQVYATFFEIYSGKVFDLLNRKTKLRVLEDGKQQVQVVGLQEREVKCVEDVLKLIDIGNSCRTSGQTSANAHSSRSHAVFQIILRRKGKLHGKFSLIDLAGNERGADTSSADRQTRLEGAEINKSLLALKECIRALGRNKPHTPFRASKLTQVLRDSFIGENSRTCMIATISPGMASCENTLNTLRYANRVKELTVDPTAAGDVRPIMHHPPNQIDDLETQWGVGSSPQRDDLKLLCEQNEEEVSPQLFTFHEAVSQMVEMEEQVVEDHRAVFQESIRWLEDEKALLEMTEEVDYDVDSYATQLEAILEQKIDILTELRDKVKSFRAALQEEEQASKQINPKRPRAL

SEQ ID NO: 44394 - protein, 80 aa, Homo sapiens
  Payload ID: 9051
  Gene Symbol: KIF2A
  Gene Name: kinesin heavy chain member 2A
  ENSP ID: ENSP00000425411
MVTSLNEDNESVTVEWIENGDTKGKEIDLESIFSLNPDLVPDEEIEPSPETPPPPASSAKVNKIVKNRRTVASIKNDPPS

SEQ ID NO: 44395 - protein, 637 aa, Homo sapiens
  Payload ID: 9052
  Gene Symbol: KLC1
  Gene Name: kinesin light chain 1
  Uniprot ID: Q07866
  ENSP ID: ENSP00000246489
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEVSMSVEWNGDGTGSLKRSGSFSKLRASIRRSSEKLVRKLKGGSSRESEPKNPGMKRASSLNVLNVGGKAAEDRFQERNNCLADSRALSASHTDLAH

SEQ ID NO: 44396 - protein, 639 aa, Homo sapiens
  Payload ID: 9052
  Gene Symbol: KLC1
  Gene Name: kinesin light chain 1
  Uniprot ID: Q07866
  ENSP ID: ENSP00000334523
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEVSMSVEWNGDGTGSLKRSGSFSKLRASIRRSSEKLVRKLKGGSSRESEPKNPGMKRASSLNVLNVGGKAAEDRFQGVSGRASFCGKRQQQQWPGRRHR

SEQ ID NO: 44397 - protein, 628 aa, Homo sapiens
  Payload ID: 9052
  Gene Symbol: KLC1
  Gene Name: kinesin light chain 1
  Uniprot ID: Q07866
  ENSP ID: ENSP00000334618
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEDGTGSLKRSGSFSKLRASIRRSSEKLVRKLKGGSSRESEPKNPGMKRASSLNVLNVGGKAAEDRFQERNNCLADSRALSASHTDLAH

SEQ ID NO: 44398 - protein, 573 aa, Homo sapiens
  Payload ID: 9052
  Gene Symbol: KLC1
  Gene Name: kinesin light chain 1
  Uniprot ID: Q07866
  ENSP ID: ENSP00000341154
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEVSMSVEWNGGVSGRASFCGKRQQQQWPGRRHR

SEQ ID NO: 44399 - protein, 576 aa, Homo sapiens
  Payload ID: 9052
  Gene Symbol: KLC1
  Gene Name: kinesin light chain 1
  ENSP ID: ENSP00000369377
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQRSISEIPKKILSANGSNHFPLPGSQGLDNVHKQRVAEVLNDPENMEKRRSRESLNVDVVKYESGPDGGEEMRKMKLGLVN

SEQ ID NO: 44400 - protein, 560 aa, Homo sapiens
  Payload ID: 9052
  Gene Symbol: KLC1
  Gene Name: kinesin light chain 1
  Uniprot ID: Q07866
  ENSP ID: ENSP00000374394
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEVSMSVEWNGMRKMKLGLVN

SEQ ID NO: 44401 - protein, 549 aa, Homo sapiens
  Payload ID: 9052
  Gene Symbol: KLC1
  Gene Name: kinesin light chain 1
  ENSP ID: ENSP00000412693
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEMRKMKLGLVN

SEQ ID NO: 44402 - protein, 618 aa, Homo sapiens
  Payload ID: 9052
  Gene Symbol: KLC1
  Gene Name: kinesin light chain 1
  Uniprot ID: Q07866
  ENSP ID: ENSP00000414982
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEVSMSVEWNGDGTGSLKRSGSFSKLRASIRRSSEKLVRKLKGGSSRESEPKNPGASLAEPLFVENDSSSSGLEDATAN

SEQ ID NO: 44403 - protein, 268 aa, Homo sapiens
  Payload ID: 9052
  Gene Symbol: KLC1
  Gene Name: kinesin light chain 1
  ENSP ID: ENSP00000441347
  MOD_RES (1)..(1): Any amino acid
XKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQRSISEIPKKILSANGSNHFPLPGSQGLDNVHKQRVAEVLNDPENMEKRRSRESLNVDVVKYESGPDGGEEVSMSVEWNGDGTGSLKRSGSFSKLRASIRRSSEKLVRKLKGGSSRESEPKNPGMKRASSLNVLNVGGKAAEDRFQERNNCLADSRALSASHTDLAH

SEQ ID NO: 44404 - protein, 60 aa, Homo sapiens
  Payload ID: 9052
  Gene Symbol: KLC1
  Gene Name: kinesin light chain 1
  ENSP ID: ENSP00000442554
  MOD_RES (1)..(1): Any amino acid
XHKQRVAEVLNDPENMEKRRSRESLNVDVVKYESGPDGGEEVSMSVEWNGHEACQLSECP

SEQ ID NO: 44405 - protein, 560 aa, Homo sapiens; identical to SEQ ID NO: 44400
  Payload ID: 9052
  Gene Symbol: KLC1
  Gene Name: kinesin light chain 1
  Uniprot ID: Q07866
  ENSP ID: ENSP00000450616

SEQ ID NO: 44406 - protein, 551 aa, Homo sapiens
  Payload ID: 9052
  Gene Symbol: KLC1
  Gene Name: kinesin light chain 1
  ENSP ID: ENSP00000450617
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEVSMSVEWNGA

SEQ ID NO: 44407 - protein, 564 aa, Homo sapiens
  Payload ID: 9052
  Gene Symbol: KLC1
  Gene Name: kinesin light chain 1
  Uniprot ID: Q07866
  ENSP ID: ENSP00000450648
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEGVSGRASFCGKRQQQQWPGRRHR

SEQ ID NO: 44408 - protein, 150 aa, Homo sapiens
  Payload ID: 9052
  Gene Symbol: KLC1
  Gene Name: kinesin light chain 1
  ENSP ID: ENSP00000450786
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEF

SEQ ID NO: 44409 - protein, 609 aa, Homo sapiens
  Payload ID: 9052
  Gene Symbol: KLC1
  Gene Name: kinesin light chain 1
  ENSP ID: ENSP00000451242
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEDGTGSLKRSGSFSKLRASIRRSSEKLVRKLKGGSSRESEPKNPGASLAEPLFVENDSSSSGLEDATAN

SEQ ID NO: 44410 - protein, 44 aa, Homo sapiens
  Payload ID: 9052
  Gene Symbol: KLC1
  Gene Name: kinesin light chain 1
  ENSP ID: ENSP00000451691
  MOD_RES (1)..(1): Any amino acid
XMKRASSLNVLNVGGKAAEDRFQERNNCLADSRALSASHTDLAH

SEQ ID NO: 44411 - protein, 150 aa, Homo sapiens
  Payload ID: 9052
  Gene Symbol: KLC1
  Gene Name: kinesin light chain 1
  ENSP ID: ENSP00000451732
  MOD_RES (1)..(1): Any amino acid
XMHAEEREECKGKQKDGTSFGEYGGWYKACKVDSPTVTTTLKNLGALYRRQGKFEAAETLEEAAMRSRKQRSISEIPKKILSANGSNHFPLPGSQGLDNVHKQRVAEVLNDPENMEKRRSRESLNVDVVKYESGPDGGEEMRKMKLGLVN

SEQ ID NO: 44412 - protein, 161 aa, Homo sapiens
  Payload ID: 9052
  Gene Symbol: KLC1
  Gene Name: kinesin light chain 1
  ENSP ID: ENSP00000452095
  MOD_RES (1)..(1): Any amino acid
XIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEVSMSVEWNGVSTVHSGHVLREAPPSGACQAFLLSHVLDLLLFSN

SEQ ID NO: 44413 - protein, 131 aa, Homo sapiens
  Payload ID: 9052
  Gene Symbol: KLC1
  Gene Name: kinesin light chain 1
  ENSP ID: ENSP00000452167
  MOD_RES (1)..(1): Any amino acid
XENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEMRKMKLGLVN

SEQ ID NO: 44414 - protein, 630 aa, Homo sapiens
  Payload ID: 9052
  Gene Symbol: KLC1
  Gene Name: kinesin light chain 1
  ENSP ID: ENSP00000452481
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEDGTGSLKRSGSFSKLRASIRRSSEKLVRKLKGGSSRESEPKNPGMKRASSLNVLNVGGKAAEDRFQGVSGRASFCGKRQQQQWPGRRHR

SEQ ID NO: 44415 - protein, 560 aa, Homo sapiens; identical to SEQ ID NO: 44400
  Payload ID: 9052
  Gene Symbol: KLC1
  Gene Name: kinesin light chain 1
  Uniprot ID: Q07866
  ENSP ID: ENSP00000452487

SEQ ID NO: 44416 - protein, 584 aa, Homo sapiens
  Payload ID: 9052
  Gene Symbol: KLC1
  Gene Name: kinesin light chain 1
  ENSP ID: ENSP00000488938
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEMKRASSLNVLNVGGKAAEDRFQERNNCLADSRALSASHTDLAH

SEQ ID NO: 44417 - protein, 622 aa, Homo sapiens
  Payload ID: 9053
  Gene Symbol: KLC2
  Gene Name: kinesin light chain 2
  Uniprot ID: Q9H0B6
  ENSP ID: ENSP00000314837
MAMMVFPREEKLSQDEIVLGTKAVIQGLETLRGEHRALLAPLVAPEAGEAEPGSQERCILLRRSLEAIELGLGEAQVILALSSHLGAVESEKQKLRAQVRRLVQENQWLREELAGTQQKLQRSEQAVAQLEEEKQHLLFMSQIRKLDEDASPNEEKGDVPKDTLDDLFPNEDEQSPAPSPGGGDVSGQHGGYEIPARLRTLHNLVIQYASQGRYEVAVPLCKQALEDLEKTSGHDHPDVATMLNILALVYRDQNKYKEAAHLLNDALAIREKTLGKDHPAVAATLNNLAVLYGKRGKYKEAEPLCKRALEIREKVLGKFHPDVAKQLSNLALLCQNQGKAEEVEYYYRRALEIYATRLGPDDPNVAKTKNNLASCYLKQGKYQDAETLYKEILTRAHEKEFGSVNGDNKPIWMHAEEREESKDKRRDSAPYGEYGSWYKACKVDSPTVNTTLRSLGALYRRQGKLEAAHTLEDCASRNRKQGLDPASQTKVVELLKDGSGRRGDRRSSRDMAGGAGPRSESDLEDVGPTAEWNGDGSGSLRRSGSFGKLRDALRRSSEMLVKKLQGGTPQEPPNPRMKRASSLNFLNKSVEEPTQPGGTGLSDSRTLSSSSMDLSRRSSLVG

SEQ ID NO: 44418 - protein, 521 aa, Homo sapiens
  Payload ID: 9053
  Gene Symbol: KLC2
  Gene Name: kinesin light chain 2
  ENSP ID: ENSP00000377629
MSQIRKLDEDASPNEEKGDVPKDTLDDLFPNEDEQSPAPSPGGGDVSGQHGGYEIPARLRTLHNLVIQYASQGRYEVAVPLCKQALEDLEKTSGHDHPDVATMLNILALVYRDQNKYKEAAHLLNDALAIREKTLGKDHPAVAATLNNLAVLYGKRGKYKEAEPLCKRALEIREKVLGKFHPDVAKQLSNLALLCQNQGKAEEVEYYYRRALEIYATRLGPDDPNVAKTKNNLASCYLKQGKYQDAETLYKEILTRAHEKEFGSVNGDNKPIWMHAEEREESKDKRRDSAPYGEYGSWYKACKVDSPTVNTTLRSLGALYRRQGKLEAAHTLEDCASRNRKQGLDPASQTKVVELLKDGSGRRGDRRSSRDMAGGAGPRSESDLEDVGPTAEWNGDGSGSLRRSGSFGKLRDALRRSSEMLVKKLQGGTPQEPPNPRMKRASSLNFLNKSVEEPTQVGAGGCLGTGQLRPGLHACCQASLQHASSSSNSSWLCLRPTLGWTTGRHEGNPASPGGGRVNGQC

SEQ ID NO: 44419 - protein, 545 aa, Homo sapiens
  Payload ID: 9053
  Gene Symbol: KLC2
  Gene Name: kinesin light chain 2
  Uniprot ID: Q9H0B6
  ENSP ID: ENSP00000377630
MAMMVFPREEKLSQDEIVLGTKAVIQGLETLRGEHRALLAPLVAPEAGEAEPGSQERCILLRRSLEAIELGLGEAQEEKGDVPKDTLDDLFPNEDEQSPAPSPGGGDVSGQHGGYEIPARLRTLHNLVIQYASQGRYEVAVPLCKQALEDLEKTSGHDHPDVATMLNILALVYRDQNKYKEAAHLLNDALAIREKTLGKDHPAVAATLNNLAVLYGKRGKYKEAEPLCKRALEIREKVLGKFHPDVAKQLSNLALLCQNQGKAEEVEYYYRRALEIYATRLGPDDPNVAKTKNNLASCYLKQGKYQDAETLYKEILTRAHEKEFGSVNGDNKPIWMHAEEREESKDKRRDSAPYGEYGSWYKACKVDSPTVNTTLRSLGALYRRQGKLEAAHTLEDCASRNRKQGLDPASQTKVVELLKDGSGRRGDRRSSRDMAGGAGPRSESDLEDVGPTAEWNGDGSGSLRRSGSFGKLRDALRRSSEMLVKKLQGGTPQEPPNPRMKRASSLNFLNKSVEEPTQPGGTGLSDSRTLSSSSMDLSRRSSLVG

SEQ ID NO: 44420 - protein, 622 aa, Homo sapiens; identical to SEQ ID NO: 44417
  Payload ID: 9053
  Gene Symbol: KLC2
  Gene Name: kinesin light chain 2
  Uniprot ID: Q9H0B6
  ENSP ID: ENSP00000377631

SEQ ID NO: 44421 - protein, 333 aa, Homo sapiens
  Payload ID: 9053
  Gene Symbol: KLC2
  Gene Name: kinesin light chain 2
  ENSP ID: ENSP00000377641
MAMMVFPREEKLSQDEIVLGTKAVIQGLETLRGEHRALLAPLVAPEAGEAEPGSQERCILLRRSLEAIELGLGEAQVILALSSHLGAVESEKQKLRAQVRRLVQENQWLREELAGTQQKLQRSEQAVAQLEEEKQHLLFMSQIRKLDEDASPNEEKGDVPKDTLDDLFPNEDEQSPAPSPGGGDVSGQHGGYEIPARLRTLHNLVIQYASQGRYEVAVPLCKQALEDLEKTSGHDHPDVATMLNILALVYRFGPAGGAGWSLHHRLSGLASPDPRAKNTKHSPALRHPRPPSRLNPAVASVYREISYWPRASLQSTVLPGPPLVPLLVVPPRP

SEQ ID NO: 44422 - protein, 166 aa, Homo sapiens
  Payload ID: 9053
  Gene Symbol: KLC2
  Gene Name: kinesin light chain 2
  ENSP ID: ENSP00000396952
MAMMVFPREEKLSQDEIVLGTKAVIQGLETLRGEHRALLAPLVAPEAGEAEPGSQERCILLRRSLEAIELGLGEAQVILALSSHLGAVESEKQKLRAQVRRLVQENQWLREELAGTQQKLQRSEQAVAQLEEEKQHLLFMSQIRKLDEDASPNEEKGDVPKDTLDD

SEQ ID NO: 44423 - protein, 622 aa, Homo sapiens; identical to SEQ ID NO: 44417
  Payload ID: 9053
  Gene Symbol: KLC2
  Gene Name: kinesin light chain 2
  Uniprot ID: Q9H0B6
  ENSP ID: ENSP00000399403

SEQ ID NO: 44424 - protein, 545 aa, Homo sapiens; identical to SEQ ID NO: 44419
  Payload ID: 9053
  Gene Symbol: KLC2
  Gene Name: kinesin light chain 2
  Uniprot ID: Q9H0B6
  ENSP ID: ENSP00000408484

SEQ ID NO: 44425 - protein, 171 aa, Homo sapiens
  Payload ID: 9053
  Gene Symbol: KLC2
  Gene Name: kinesin light chain 2
  ENSP ID: ENSP00000431253
MAMMVFPREEKLSQDEIVLGTKAVIQGLETLRGEHRALLAPLVAPEAGEAEPGSQERCILLRRSLEAIELGLGEAQVILALSSHLGAVESEKQKLRAQVRRLVQENQWLREELAGTQQKLQRSEQAVAQLEEEKQHLLFMSQIRKLDEDASPNEEKGDVPKDTLDDLFPNE

SEQ ID NO: 44426 - protein, 189 aa, Homo sapiens
  Payload ID: 9053
  Gene Symbol: KLC2
  Gene Name: kinesin light chain 2
  ENSP ID: ENSP00000434538
MAMMVFPREEKLSQDEIVLGTKAVIQGLETLRGEHRALLAPLVAPEAGEAEPGSQERCILLRRSLEAIELGLGEAQEEKGDVPKDTLDDLFPNEDEQSPAPSPGGGDVSGQHGGYEIPARLRTLHNLVIQYASQGRYEVAVPLCKQALEDLEKTSGHDHPDVATMLNILALVYRDQNKYKEAAHLLNDA

SEQ ID NO: 44427 - protein, 105 aa, Homo sapiens
  Payload ID: 9053
  Gene Symbol: KLC2
  Gene Name: kinesin light chain 2
  ENSP ID: ENSP00000436577
MAMMVFPREEKLSQDEIVLGTKAVIQGLETLRGEHRALLAPLVAPEAGEAEPGSQERCILLRRSLEAIELGLGEAQVILALSSHLGAVESEKQKLRAQVRRLVQE

SEQ ID NO: 44428 - protein, 145 aa, Homo sapiens
  Payload ID: 9053
  Gene Symbol: KLC2
  Gene Name: kinesin light chain 2
  ENSP ID: ENSP00000437026
MAMMVFPREEKLSQDEIVLGTKAVIQGLETLRGEHRALLAPLVAPEAGEAEPGSQERCILLRRSLEAIELGLGEAQVILALSSHLGAVESEKQKLRAQVRRLVQENQWLREELAGTQQKLQRSEQAVAQLEEEKQHLLFMSQIRK

SEQ ID NO: 44429 - protein, 504 aa, Homo sapiens
  Payload ID: 9054
  Gene Symbol: KLC3
  Gene Name: kinesin light chain 3
  Uniprot ID: Q6P597
  ENSP ID: ENSP00000375810
MSVQVAAPGSAGLGPERLSPEELVRQTRQVVQGLEALRAEHHGLAGHLAEALAGQGPAAGLEMLEEKQQVVSHSLEAIELGLGEAQVLLALSAHVGALEAEKQRLRSQARRLAQENVWLREELEETQRRLRASEESVAQLEEEKRHLEFLGQLRQYDPPAESQQSESPPRRDSLASLFPSEEEERKGPEAAGAAAAQQGGYEIPARLRTLHNLVIQYAGQGRYEVAVPLCRQALEDLERSSGHCHPDVATMLNILALVYRDQNKYKEATDLLHDALQIREQTLGPEHPAVAATLNNLAVLYGKRGRYREAEPLCQRALEIREKVLGADHPDVAKQLNNLALLCQNQGKFEDVERHYARALSIYEALGGPHDPNVAKTKNNLASAYLKQNKYQQAEELYKEILHKEDLPAPLGAPNTGTAGDAEQALRRSSSLSKIRESIRRGSEKLVSRLRGEAAAGAAGMKRAMSLNTLNVDAPRAPGTQFPSWHLDKAPRTLSASTQDLSPH

SEQ ID NO: 44430 - protein, 518 aa, Homo sapiens
  Payload ID: 9054
  Gene Symbol: KLC3
  Gene Name: kinesin light chain 3
  Uniprot ID: Q6P597
  ENSP ID: ENSP00000436019
MIPQTPHHCSPGAAMSVQVAAPGSAGLGPERLSPEELVRQTRQVVQGLEALRAEHHGLAGHLAEALAGQGPAAGLEMLEEKQQVVSHSLEAIELGLGEAQVLLALSAHVGALEAEKQRLRSQARRLAQENVWLREELEETQRRLRASEESVAQLEEEKRHLEFLGQLRQYDPPAESQQSESPPRRDSLASLFPSEEEERKGPEAAGAAAAQQGGYEIPARLRTLHNLVIQYAGQGRYEVAVPLCRQALEDLERSSGHCHPDVATMLNILALVYRDQNKYKEATDLLHDALQIREQTLGPEHPAVAATLNNLAVLYGKRGRYREAEPLCQRALEIREKVLGADHPDVAKQLNNLALLCQNQGKFEDVERHYARALSIYEALGGPHDPNVAKTKNNLASAYLKQNKYQQAEELYKEILHKEDLPAPLGAPNTGTAGDAEQALRRSSSLSKIRESIRRGSEKLVSRLRGEAAAGAAGMKRAMSLNTLNVDAPRAPGTQFPSWHLDKAPRTLSASTQDLSPH

SEQ ID NO: 44431 - protein, 396 aa, Homo sapiens
  Payload ID: 9054
  Gene Symbol: KLC3
  Gene Name: kinesin light chain 3
  ENSP ID: ENSP00000465950
MSVQVAAPGSAGLGPERLSPEELVRQTRQVVQGLEALRAEHHGLAGHLAEALAGQGPAAGLEMLEEKQQVVSHSLEAIELGLGEAQVLLALSAHVGALEAEKQRLRSQARRLAQENVWLREELEETQRRLRASEESVAQLEEEKRHLEFLGQLRQYDPPAESQQSESPPRRDSLASLFPSEEEERKGPEAAGAAAAQQGGYEIPARLRTLHNLVIQYAGQGRYEVAVPLCRQALEDLERSSGHCHPDVATMLNILALVYRDQNKYKEATDLLHDALQIREQTLGPEHPAVAATLNNLAVLYGKRGRYREAEPLCQRALEIREKVLGADHPDVAKQLNNLALLCQNQGKFEDVERHYARALSIYEALGGPHDPNVAKTKNNLASAYLKQNKYQQAEE

SEQ ID NO: 44432 - protein, 503 aa, Homo sapiens
  Payload ID: 9054
  Gene Symbol: KLC3
  Gene Name: kinesin light chain 3
  Uniprot ID: Q6P597
  ENSP ID: ENSP00000466067
MSVQVAAPGSAGLGPERLSPEELVRQTRQVVQGLEALRAEHHGLAGHLAEALAGQGPAAGLEMLEEKQQVVSHSLEAIELGLGEAQVLLALSAHVGALEAEKQRLRSQARRLAQENVWLREELEETQRRLRASEESVAQLEEEKRHLEFLGQLRQYDPPAESQSESPPRRDSLASLFPSEEEERKGPEAAGAAAAQQGGYEIPARLRTLHNLVIQYAGQGRYEVAVPLCRQALEDLERSSGHCHPDVATMLNILALVYRDQNKYKEATDLLHDALQIREQTLGPEHPAVAATLNNLAVLYGKRGRYREAEPLCQRALEIREKVLGADHPDVAKQLNNLALLCQNQGKFEDVERHYARALSIYEALGGPHDPNVAKTKNNLASAYLKQNKYQQAEELYKEILHKEDLPAPLGAPNTGTAGDAEQALRRSSSLSKIRESIRRGSEKLVSRLRGEAAAGAAGMKRAMSLNTLNVDAPRAPGTQFPSWHLDKAPRTLSASTQDLSPH

SEQ ID NO: 44433 - protein, 157 aa, Homo sapiens
  Payload ID: 9054
  Gene Symbol: KLC3
  Gene Name: kinesin light chain 3
  ENSP ID: ENSP00000466168
MSVQVAAPGSAGLGPERLSPEELVRQTRQVVQGLEALRAEHHGLAGHLAEALAGQGPAAGLEMLEEKQQVVSHSLEAIELGLGEAQVLLALSAHVGALEAEKQRLRSQARRLAQENVWLREELEETQRRLRASEESVAQLEEEKRHLEFLGQLRQYD

SEQ ID NO: 44434 - protein, 297 aa, Homo sapiens
  Payload ID: 9054
  Gene Symbol: KLC3
  Gene Name: kinesin light chain 3
  ENSP ID: ENSP00000466974
MSVQVAAPGSAGLGPERLSPEELVRQTRQVVQGLEALRAEHHGLAGHLAEALAGQGPAAGLEMLEEKQQVVLLALSAHVGALEAEKQRLRSQARRLAQENVWLREELEETQRRLRASEESVAQLEEEKRHLEFLGQLRQYDPPAESQQSESPPRRDSLASLFPSEEEERKGPEAAGAAAAQQGGYEIPARLRTLHNLVIQYAGQGRYEVAVPLCRQALEDLERSSGHCHPDVATMLNILALVYRDQNKYKEATDLLHDALQIREQTLGPEHPAVAATLNNLAVLYGKRGRYREAEPL

SEQ ID NO: 44435 - protein, 637 aa, Homo sapiens
  Payload ID: 9055
  Gene Symbol: KLC4
  Gene Name: kinesin light chain 4
  Uniprot ID: Q9NSK0
  ENSP ID: ENSP00000259708
MEVTGFGVTRPGKVPQARMSGLVLGQRDEPAGHRLSQEEILGSTRLVSQGLEALRSEHQAVLQSLSQTIECLQQGGHEEGLVHEKARQLRRSMENIELGLSEAQVMLALASHLSTVESEKQKLRAQVRRLCQENQWLRDELAGTQQRLQRSEQAVAQLEEEKKHLEFLGQLRQYDEDGHTSEEKEGDATKDSLDDLFPNEEEEDPSNGLSRGQGATAAQQGGYEIPARLRTLHNLVIQYAAQGRYEVAVPLCKQALEDLERTSGRGHPDVATMLNILALVYRDQNKYKEAAHLLNDALSIRESTLGPDHPAVAATLNNLAVLYGKRGKYKEAEPLCQRALEIREKVLGTNHPDVAKQLNNLALLCQNQGKYEAVERYYQRALAIYEGQLGPDNPNVARTKNNLASCYLKQGKYAEAETLYKEILTRAHVQEFGSVDDDHKPIWMHAEEREEMSKSRHHEGGTPYAEYGGWYKACKVSSPTVNTTLRNLGALYRRQGKLEAAETLEECALRSRRQGTDPISQTKVAELLGESDGRRTSQEGPGDSVKFEGGEDASVAVEWSGDGSGTLQRSGSLGKIRDVLRRSSELLVRKLQGTEPRPSSSNMKRAASLNYLNQPSAAPLQVSRGLSASTMDLSSSS

SEQ ID NO: 44436 - protein, 619 aa, Homo sapiens
  Payload ID: 9055
  Gene Symbol: KLC4
  Gene Name: kinesin light chain 4
  Uniprot ID: Q9NSK0
  ENSP ID: ENSP00000340221
MSGLVLGQRDEPAGHRLSQEEILGSTRLVSQGLEALRSEHQAVLQSLSQTIECLQQGGHEEGLVHEKARQLRRSMENIELGLSEAQVMLALASHLSTVESEKQKLRAQVRRLCQENQWLRDELAGTQQRLQRSEQAVAQLEEEKKHLEFLGQLRQYDEDGHTSEEKEGDATKDSLDDLFPNEEEEDPSNGLSRGQGATAAQQGGYEIPARLRTLHNLVIQYAAQGRYEVAVPLCKQALEDLERTSGRGHPDVATMLNILALVYRDQNKYKEAAHLLNDALSIRESTLGPDHPAVAATLNNLAVLYGKRGKYKEAEPLCQRALEIREKVLGTNHPDVAKQLNNLALLCQNQGKYEAVERYYQRALAIYEGQLGPDNPNVARTKNNLASCYLKQGKYAEAETLYKEILTRAHVQEFGSVDDDHKPIWMHAEEREEMSKSRHHEGGTPYAEYGGWYKACKVSSPTVNTTLRNLGALYRRQGKLEAAETLEECALRSRRQGTDPISQTKVAELLGESDGRRTSQEGPGDSVKFEGGEDASVAVEWSGDGSGTLQRSGSLGKIRDVLRRSSELLVRKLQGTEPRPSSSNMKRAASLNYLNQPSAAPLQVSRGLSASTMDLSSSS

SEQ ID NO: 44437 - protein, 619 aa, Homo sapiens; identical to SEQ ID NO: 44436
  Payload ID: 9055
  Gene Symbol: KLC4
  Gene Name: kinesin light chain 4
  Uniprot ID: Q9NSK0
  ENSP ID: ENSP00000377620

SEQ ID NO: 44438 - protein, 542 aa, Homo sapiens
  Payload ID: 9055
  Gene Symbol: KLC4
  Gene Name: kinesin light chain 4
  Uniprot ID: Q9NSK0
  ENSP ID: ENSP00000395806
MSGLVLGQRDEPAGHRLSQEEILGSTRLVSQGLEALRSEHQAVLQSLSQTIECLQQGGHEEGLVHEKARQLRRSMENIELGLSEAQEEKEGDATKDSLDDLFPNEEEEDPSNGLSRGQGATAAQQGGYEIPARLRTLHNLVIQYAAQGRYEVAVPLCKQALEDLERTSGRGHPDVATMLNILALVYRDQNKYKEAAHLLNDALSIRESTLGPDHPAVAATLNNLAVLYGKRGKYKEAEPLCQRALEIREKVLGTNHPDVAKQLNNLALLCQNQGKYEAVERYYQRALAIYEGQLGPDNPNVARTKNNLASCYLKQGKYAEAETLYKEILTRAHVQEFGSVDDDHKPIWMHAEEREEMSKSRHHEGGTPYAEYGGWYKACKVSSPTVNTTLRNLGALYRRQGKLEAAETLEECALRSRRQGTDPISQTKVAELLGESDGRRTSQEGPGDSVKFEGGEDASVAVEWSGDGSGTLQRSGSLGKIRDVLRRSSELLVRKLQGTEPRPSSSNMKRAASLNYLNQPSAAPLQVSRGLSASTMDLSSSS

SEQ ID NO: 44439 - protein, 315 aa, Homo sapiens
  Payload ID: 9055
  Gene Symbol: KLC4
  Gene Name: kinesin light chain 4
  Uniprot ID: Q9NSK0
  ENSP ID: ENSP00000410358
MSGLVLGQRDEPAGHRLSQEEILGSTRLVSQGLEALRSEHQAVLQSLSQTIECLQQGGHEEGLVHEKARQLRRSMENIELGLSEAQVMLALASHLSTVESEKQKLRAQVRRLCQENQWLRDELAGTQQRLQRSEQAVAQLEEEKKHLEFLGQLRQYDEDGHTSEEKEGDATKDSLDDLFPNEEEEDPSNGLSRGQGATAAQQGGYEIPARLRTLHNLVIQYAAQGRYEVAVPLCKQALEDLERTSGRGHPDVATMLNILALVYRDQNKYKEAAHLLNDALSIRESTLGPDHPAVSIPCPPHPTPRTPHHCCFGLS

SEQ ID NO: 44440 - protein, 159 aa, Homo sapiens
  Payload ID: 9055
  Gene Symbol: KLC4
  Gene Name: kinesin light chain 4
  ENSP ID: ENSP00000417620
  MOD_RES (1)..(1): Any amino acid
XAVAATLNNLAVLYGKRGKYKEAEPLCQRALEIREKVLGTNHPDVAKQLNNLALLCQNQGKYEAVERYYQRALAIYEGQLGPDNPNVARTKNNLASCYLKQGKYAEAETLYKEILTRAHVQEFGSVDDDHKPIWMHAEEREEMSKPHSEHYSEKPGSSV

SEQ ID NO: 44441 - protein, 271 aa, Homo sapiens
  Payload ID: 9055
  Gene Symbol: KLC4
  Gene Name: kinesin light chain 4
  ENSP ID: ENSP00000417652
MSGLVLGQRDEPAGHRLSQEEILGSTRLVSQGLEALRSEHQAVLQSLSQTIECLQQGGHEEGLVHEKARQLRRSMENIELGLSEAQVRRLCQENQWLRDELAGTQQRLQRSEQAVAQLEEEKKHLEFLGQLRQYDEDGHTSEEKEGDATKDSLDDLFPNEEEEDPSNGLSRGQGATAAQQGGYEIPARLRTLHNLVIQYAAQGRYEVAVPLCKQALEDLERTSGRGHPDVATMLNILALVYRDQNKYKEAAHLLNDALSIRESTLGPDHPA

SEQ ID NO: 44442 - protein, 619 aa, Homo sapiens; identical to SEQ ID NO: 44436
  Payload ID: 9055
  Gene Symbol: KLC4
  Gene Name: kinesin light chain 4
  Uniprot ID: Q9NSK0
  ENSP ID: ENSP00000418031

SEQ ID NO: 44443 - protein, 45 aa, Homo sapiens
  Payload ID: 9055
  Gene Symbol: KLC4
  Gene Name: kinesin light chain 4
  ENSP ID: ENSP00000418546
MEVTGFGVTRCSSLPFPRHASCCRSLVKSLSLIPFLGDSSSLGLQ

SEQ ID NO: 44444 - protein, 131 aa, Homo sapiens
  Payload ID: 9055
  Gene Symbol: KLC4
  Gene Name: kinesin light chain 4
  Uniprot ID: Q9NSK0
  ENSP ID: ENSP00000418759
MSGLVLGQRDEPAGHRLSQEEILGSTRLVSQGLEALRSEHQAVLQSLSQTIECLQQGGHEEGLVHEKARQLRRSMENIELGLSEAQNLELRGCAHLGDAGSSQPPEHSGVGETEAAGSGAAAMPGEPVAAG

SEQ ID NO: 44445 - protein, 82 aa, Homo sapiens
  Payload ID: 9055
  Gene Symbol: KLC4
  Gene Name: kinesin light chain 4
  ENSP ID: ENSP00000419102
MSGLVLGQRDEPAGHRLSQEEILGSTRLVSQGLEALRSEHQAVLQSLSQTIECLQQGGHEEGLVHEKARQLRRSMENIELGL

SEQ ID NO: 44446 - protein, 91 aa, Homo sapiens
  Payload ID: 9055
  Gene Symbol: KLC4
  Gene Name: kinesin light chain 4
  ENSP ID: ENSP00000419634
MSGLVLGQRDEPAGHRLSQEEILGSTRLVSQGLEALRSEHQAVLQSLSQTIECLQQGGHEEGLVHEKARQLRRSMENIELGLSEAQVMLAL

SEQ ID NO: 44447 - protein, 162 aa, Homo sapiens
  Payload ID: 9055
  Gene Symbol: KLC4
  Gene Name: kinesin light chain 4
  ENSP ID: ENSP00000419784
MLALASHLSTVESEKQKLRAQVRRLCQENQWLRDELAGTQQRLQRSEQAVAQLEEEKKHLEFLGQLRQYDEDGHTSEEKEGDATKDSLDDLFPNEEEEDPSNGLSRGQGATAAQQGGYEIPARLRTLHNLVIQYAAQGRYEVAVPLCKQALEDLERTSGRGH

SEQ ID NO: 44448 - protein, 84 aa, Homo sapiens
  Payload ID: 9055
  Gene Symbol: KLC4
  Gene Name: kinesin light chain 4
  ENSP ID: ENSP00000420144
MSGLVLGQRDEPAGHRLSQEEILGSTRLVSQGLEALRSEHQAVLQSLSQTIECLQQGGHEEGLVHEKARQLRRSMENIELGLSE

SEQ ID NO: 44449 - protein, 792 aa, Homo sapiens
  Payload ID: 9056
  Gene Symbol: KIFAP3
  Gene Name: kinesin-associated protein 3
  Uniprot ID: Q92845
  ENSP ID: ENSP00000354560
MQGEDARYLKRKVKGGNIDVHPSEKALIVHYEVEATILGEMGDPMLGERKECQKIIRLKSLNANTDITSLARKVVEECKLIHPSKLNEVEQLLYYLQNRRDSLSGKEKKEKSSKPKDPPPFEGMEIDEVANINDMDEYIELLYEDIPDKVRGSALILQLARNPDNLEELLLNETALGALARVLREDWKQSVELATNIIYIFFCFSSFSQFHGLITHYKIGALCMNIIDHELKRHELWQEELSKKKKAVDEDPENQTLRKDYEKTFKKYQGLVVKQEQLLRVALYLLLNLAEDTRTELKMRNKNIVHMLVKALDRDNFELLILVVSFLKKLSIFMENKNDMVEMDIVEKLVKMIPCEHEDLLNITLRLLLNLSFDTGLRNKMVQVGLLPKLTALLGNDNYKQIAMCVLYHISMDDRFKSMFAYTDCIPQLMKMLFECSDERIDLELISFCINLAANKRNVQLICEGNGLKMLMKRALKFKDPLLMKMIRNISQHDGPTKNLFIDYVGDLAAQISNDEEEEFVIECLGTLANLTIPDLDWELVLKEYKLVPYLKDKLKPGAAEDDLVLEVVIMIGTVSMDDSCAALLAKSGIIPALIELLNAQQEDDEFVCQIIYVFYQMVFHQATRDVIIKETQAPAYLIDLMHDKNNEIRKVCDNTLDIIAEYDEEWAKKIQSEKFRWHNSQWLEMVESRQMDESEQYLYGDDRIEPYIHEGDILERPDLFYNSDGLIASEGAISPDFFNDYHLQNGDVVGQHSFPGSLGMDGFGQPVGILGRPATAYGFRPDEPYYYGYGS

SEQ ID NO: 44450 - protein, 752 aa, Homo sapiens
  Payload ID: 9056
  Gene Symbol: KIFAP3
  Gene Name: kinesin-associated protein 3
  Uniprot ID: Q92845
  ENSP ID: ENSP00000356739
MGDPMLGERKECQKIIRLKSLNANTDITSLARKVVEECKLIHPSKLNEVEQLLYYLQNRRDSLSGKEKKEKSSKPKDPPPFEGMEIDEVANINDMDEYIELLYEDIPDKVRGSALILQLARNPDNLEELLLNETALGALARVLREDWKQSVELATNIIYIFFCFSSFSQFHGLITHYKIGALCMNIIDHELKRHELWQEELSKKKKAVDEDPENQTLRKDYEKTFKKYQGLVVKQEQLLRVALYLLLNLAEDTRTELKMRNKNIVHMLVKALDRDNFELLILVVSFLKKLSIFMENKNDMVEMDIVEKLVKMIPCEHEDLLNITLRLLLNLSFDTGLRNKMVQVGLLPKLTALLGNDNYKQIAMCVLYHISMDDRFKSMFAYTDCIPQLMKMLFECSDERIDLELISFCINLAANKRNVQLICEGNGLKMLMKRALKFKDPLLMKMIRNISQHDGPTKNLFIDYVGDLAAQISNDEEEEFVIECLGTLANLTIPDLDWELVLKEYKLVPYLKDKLKPGAAEDDLVLEVVIMIGTVSMDDSCAALLAKSGIIPALIELLNAQQEDDEFVCQIIYVFYQMVFHQATRDVIIKETQAPAYLIDLMHDKNNEIRKVCDNTLDIIAEYDEEWAKKIQSEKFRWHNSQWLEMVESRQMDESEQYLYGDDRIEPYIHEGDILERPDLFYNSDGLIASEGAISPDFFNDYHLQNGDVVGQHSFPGSLGMDGFGQPVGILGRPATAYGFRPDEPYYYGYGS

SEQ ID NO: 44451 - protein, 748 aa, Homo sapiens
  Payload ID: 9056
  Gene Symbol: KIFAP3
  Gene Name: kinesin-associated protein 3
  Uniprot ID: Q92845
  ENSP ID: ENSP00000356741
MQGEDARYLKSIRLKSLNANTDITSLARKVVEECKLIHPSKLNEVEQLLYYLQNRRDSLSGKEKKEKSSKPKDPPPFEGMEIDEVANINDMDEYIELLYEDIPDKVRGSALILQLARNPDNLEELLLNETALGALARVLREDWKQSVELATNIIYIFFCFSSFSQFHGLITHYKIGALCMNIIDHELKRHELWQEELSKKKKAVDEDPENQTLRKDYEKTFKKYQGLVVKQEQLLRVALYLLLNLAEDTRTELKMRNKNIVHMLVKALDRDNFELLILVVSFLKKLSIFMENKNDMVEMDIVEKLVKMIPCEHEDLLNITLRLLLNLSFDTGLRNKMVQVGLLPKLTALLGNDNYKQIAMCVLYHISMDDRFKSMFAYTDCIPQLMKMLFECSDERIDLELISFCINLAANKRNVQLICEGNGLKMLMKRALKFKDPLLMKMIRNISQHDGPTKNLFIDYVGDLAAQISNDEEEEFVIECLGTLANLTIPDLDWELVLKEYKLVPYLKDKLKPGAAEDDLVLEVVIMIGTVSMDDSCAALLAKSGIIPALIELLNAQQEDDEFVCQIIYVFYQMVFHQATRDVIIKETQAPAYLIDLMHDKNNEIRKVCDNTLDIIAEYDEEWAKKIQSEKFRWHNSQWLEMVESRQMDESEQYLYGDDRIEPYIHEGDILERPDLFYNSDGLIASEGAISPDFFNDYHLQNGDVVGQHSFPGSLGMDGFGQPVGILGRPATAYGFRPDEPYYYGYGS

SEQ ID NO: 44452 - protein, 714 aa, Homo sapiens
  Payload ID: 9056
  Gene Symbol: KIFAP3
  Gene Name: kinesin-associated protein 3
  Uniprot ID: Q92845
  ENSP ID: ENSP00000444622
MSIALGNTYRRSLSDSETVSVLQASLCEEKKEKSSKPKDPPPFEGMEIDEVANINDMDEYIELLYEDIPDKVRGSALILQLARNPDNLEELLLNETALGALARVLREDWKQSVELATNIIYIFFCFSSFSQFHGLITHYKIGALCMNIIDHELKRHELWQEELSKKKKAVDEDPENQTLRKDYEKTFKKYQGLVVKQEQLLRVALYLLLNLAEDTRTELKMRNKNIVHMLVKALDRDNFELLILVVSFLKKLSIFMENKNDMVEMDIVEKLVKMIPCEHEDLLNITLRLLLNLSFDTGLRNKMVQVGLLPKLTALLGNDNYKQIAMCVLYHISMDDRFKSMFAYTDCIPQLMKMLFECSDERIDLELISFCINLAANKRNVQLICEGNGLKMLMKRALKFKDPLLMKMIRNISQHDGPTKNLFIDYVGDLAAQISNDEEEEFVIECLGTLANLTIPDLDWELVLKEYKLVPYLKDKLKPGAAEDDLVLEVVIMIGTVSMDDSCAALLAKSGIIPALIELLNAQQEDDEFVCQIIYVFYQMVFHQATRDVIIKETQAPAYLIDLMHDKNNEIRKVCDNTLDIIAEYDEEWAKKIQSEKFRWHNSQWLEMVESRQMDESEQYLYGDDRIEPYIHEGDILERPDLFYNSDGLIASEGAISPDFFNDYHLQNGDVVGQHSFPGSLGMDGFGQPVGILGRPATAYGFRPDEPYYYGYGS

SEQ ID NO: 44453 - protein, 2209 aa, Homo sapiens
  Payload ID: 9057
  Gene Symbol: KNTC1
  Gene Name: kinetochore associated 1
  Uniprot ID: P50748
  ENSP ID: ENSP00000328236
MWNDIELLTNDDTGSGYLSVGSRKEHGTALYQVDLLVKISSEKASLNPKIQACSLSDGFIIVADQSVILLDSICRSLQLHLVFDTEVDVVGLCQEGKFLLVGERSGNLHLIHVTSKQTLLTNAFVQKANDENRRTYQNLVIEKDGSNEGTYYMLLLTYSGFFCITNLQLLKIQQAIENVDFSTAKKLQGQIKSSFISTENYHTLGCLSLVAGDLASEVPVIIGGTGNCAFSKWEPDSSKKGMTVKNLIDAEIIKGAKKFQLIDNLLFVLDTDNVLSLWDIYTLTPVWNWPSLHVEEFLLTTEADSPSSVTWQGITNLKLIALTASANKKMKNLMVYSLPTMEILYSLEVSSVSSLVQTGISTDTIYLLEGVCKNDPKLSEDSVSVLVLRCLTEALPENRLSRLLHKHRFAEAESFAIQFGLDVELVYKVKSNHILEKLALSSVDASEQTEWQQLVDDAKENLHKIQDDEFVVNYCLKAQWITYETTQEMLNYAKTRLLKKEDKTALIYSDGLKEVLRAHAKLTTFYGAFGPEKFSGSSWIEFLNNEDDLKDIFLQLKEGNLVCAQYLWLRHRANFESRFDVKMLESLLNSMSASVSLQKLCPWFKNDVIPFVRRTVPEGQIILAKWLEQAARNLELTDKANWPENGLQLAEIFFTAEKTDELGLASSWHWISLKDYQNTEEVCQLRTLVNNLRELITLHRKYNCKLALSDFEKENTTTIVFRMFDKVLAPELIPSILEKFIRVYMREHDLQEEELLLLYIEDLLNRCSSKSTSLFETAWEAKAMAVIACLSDTDLIFDAVLKIMYAAVVPWSAAVEQLVKQHLEMDHPKVKLLQESYKLMEMKKLLRGYGIREVNLLNKEIMRVVRYILKQDVPSSLEDALKVAQAFMLSDDEIYSLRIIDLIDREQGEDCLLLLKSLPPAEAEKTAERVIIWARLALQEEPDHSKEGKAWRMSVAKTSVDILKILCDIQKDNLQKKDECEEMLKLFKEVASLQENFEVFLSFEDYSNSSLVADLREQHIKAHEVAQAKHKPGSTPEPIAAEVRSPSMESKLHRQALALQMSKQELEAELTLRALKDGNIKTALKKCSDLFKYHCNADTGKLLFLTCQKLCQMLADNVPVTVPVGLNLPSMIHDLASQAATICSPDFLLDALELCKHTLMAVELSRQCQMDDCGILMKASFGTHKDPYEEWSYSDFFSEDGIVLESQMVLPVIYELISSLVPLAESKRYPLESTSLPYCSLNEGDGLVLPVINSISALLQNLQESSQWELALRFVVGSFGTCLQHSVSNFMNATLSEKLFGETTLVKSRHVVMELKEKAVIFIRENATTLLHKVFNCRLVDLDLALGYCTLLPQKDVFENLWKLIDKAWQNYDKILAISLVGSELASLYQEIEMGLKFRELSTDAQWGIRLGKLGISFQPVFRQHFLTKKDLIKALVENIDMDTSLILEYCSTFQLDCDAVLQLFIETLLHNTNAGQGQGDASMDSAKRRHPKLLAKALEMVPLLTSTKDLVISLSGILHKLDPYDYEMIEVVLKVIERADEKITNININQALSILKHLKSYRRISPPVDLEYQYMLEHVITLPSAAQTRLPFHLIFFGTAQNFWKILSTELSEESFPTLLLISKLMKFSLDTLYVSTAKHVFEKKLKPKLLKLTQAKSSTLINKEITKITQTIESCLLSIVNPEWAVAIAISLAQDIPEGSFKISALKFCLYLAERWLQNIPSQDEKREKAEALLKKLHIQYRRSGTEAVLIAHKLNTEEYLRVIGKPAHLIVSLYEHPSINQRIQNSSGTDYPDIHAAAKEIAEVNEINLEKVWDMLLEKWLCPSTKPGEKPSELFELQEDEALRRVQYLLLSRPIDYSSRMLFVFATSTTTTLGMHQLTFAHRTRALQCLFYLADKETIESLFKKPIEEVKSYLRCITFLASFETLNIPITYELFCSSPKEGMIKGLWKNHSHESMAVRLVTELCLEYKIYDLQLWNGLLQKLLGFNMIPYLRKVLKAISSIHSLWQVPYFSKAWQRVIQIPLLSASCPLSPDQLSDCSESLIAVLECPVSGDLDLIGVARQYIQLELPAFALACLMLMPHSEKRHQQIKNFLGSCDPQVILKQLEEHMNTGQLAGFSHQIRSLILNNIINKKEFGILAKTKYFQMLKMHAMNTNNITELVNYLANDLSLDEASVLITEYSKHCGKPVPPDTAPCEILKMFLSGLS

SEQ ID NO: 44454 - protein, 104 aa, Homo sapiens
  Payload ID: 9057
  Gene Symbol: KNTC1
  Gene Name: kinetochore associated 1
  ENSP ID: ENSP00000397140
MDTSLILEYCSTFQLDCDAVLQLFIETLLHNTNAGQGQGDASMDSAKRRHPKLLAKALEMVPLLTSTKDLVISLSGILHKLDPYDYEMIEVVLKVIERADEKIT

SEQ ID NO: 44455 - protein, 1134 aa, Homo sapiens
  Payload ID: 9057
  Gene Symbol: KNTC1
  Gene Name: kinetochore associated 1
  ENSP ID: ENSP00000397992
MWNDIELLTNDDTGSGYLSVGSRKEHGTALYQVDLLVKISSEKASLNPKIQACSLSDGFIIVADQSVILLDSICRSLQLHLVFDTEVDVVGLCQEGKFLLVGERSGNLHLIHVTSKQTLLTNAFVQKANDENRRTYQNLVIEKDGSNEGTYYMLLLTYSGFFCITNLQLLKIQQAIENVDFSTAKKGTGNCAFSKWEPDSSKKGMTVKNLIDAEIIKGAKKFQLIDNLLFVLDTDNVLSLWDIYTLTPVWNWPSLHVEEFLLTTEADSPSSVTWQGITNLKLIALTASANKKMKNLMVYSLPTMEILYSLEVSSVSSLVQTGISTDTIYLLEGVCKNDPKLSEDSVSVLVLRCLTEALPENRLSRLLHKHRFAEAESFAIQFGLDVELVYKVKSNHILEKLALSSVDASEQTEWQQLVDDAKENLHKIQDDEFVVNYCLKAQWITYETTQEMLNYAKTRLLKKEDKTALIYSDGLKEVLRAHAKLTTFYGAFGPEKFSGSSWIEFLNNEDDLKDIFLQLKEGNLVCAQYLWLRHRANFESRFDVKMLESLLNSMSASVSLQKLCPWFKNDVIPFVRRTVPEGQIILAKWLEQAARNLELTDKANWPENGLQLAEIFFTAEKTDELGLASSWHWISLKDYQNTEEVCQLRTLVNNLRELITLHRKYNCKLALSDFEKENTTTIVFRMFDKVLAPELIPSILEKFIRVYMREHDLQEEELLLLYIEDLLNRCSSKSTSLFETAWEAKAMAVIACLSDTDKPSELFELQEDEALRRVQYLLLSRPIDYSSRMLFVFATSTTTTLGMHQLTFAHRTRALQCLFYLADKETIESLFKKPIEEVKSYLRCITFLASFETLNIPITYELFCSSPKEGMIKGLWKNHSHESMAVRLVTELCLEYKIYDLQLWNGLLQKLLGFNMIPYLRKVLKAISSIHSLWQVPYFSKAWQRVIQIPLLSASCPLSPDQLSDCSESLIAVLECPVSGDLDLIGVARQYIQLELPAFALACLMLMPHSEKRHQQIKNFLGSCDPQVILKQLEEHMNTGQLAGFSHQIRSLILNNIINKKEFGILAKTKYFQMLKMHAMNTNNITELVNYLANDLSLDEASVLITEYSKHCGKPVPPDTAPCEILKMFLSGLS

SEQ ID NO: 44456 - protein, 130 aa, Homo sapiens
  Payload ID: 9057
  Gene Symbol: KNTC1
  Gene Name: kinetochore associated 1
  ENSP ID: ENSP00000408760
MLMPHSEKRHQQIKNFLGSCDPQVILKQLEEHMNTGQLAGFSHQIRSLILNNIINKKEFGILAKTKYFQMLKMHAMNTNNITELVNYLANDLSLDEASVLITEYSKHCGKPVPPDTAPCEILKMFLSGLS

SEQ ID NO: 44457 - protein, 130 aa, Homo sapiens; identical to SEQ ID NO: 44456
  Payload ID: 9057
  Gene Symbol: KNTC1
  Gene Name: kinetochore associated 1
  ENSP ID: ENSP00000437344

SEQ ID NO: 44458 - protein, 208 aa, Homo sapiens
  Payload ID: 9057
  Gene Symbol: KNTC1
  Gene Name: kinetochore associated 1
  ENSP ID: ENSP00000439119
KVWDMLLEKWLCPSTKPGEKPSELFELQEDEALRRVQYLLLSRPIDYSSRMLFVFATSTTTTLGMHQLTFAHRTRALQCLFYLADKETIESLFKKPIEEVNSPKEGMIKGLWKNHSHESMAVRLVTELCLEYKIYDLQLWNGLLQKLLGFNMIPYLRKVLKAISSIHSLWQVPYFSKAWQRVIQIPLLSASCPLSPDQLSDCSESLIA

SEQ ID NO: 44459 - protein, 316 aa, Homo sapiens
  Payload ID: 9058
  Gene Symbol: KNSTRN
  Gene Name: kinetochore-localized astrin/SPAG5 binding protein
  Uniprot ID: Q9Y448
  ENSP ID: ENSP00000249776
MAAPEAPPLDRVFRTTWLSTECDSHPLPPSYRKFLFETQAADLAGGTTVAAGNLLNESEKDCGQDRRAPGVQPCRLVTMTSVVKTVYSLQPPSALSGGQPADTQTRATSKSLLPVRSKEVDVSKQLHSGGPENDVTKITKLRRENGQMKATDTATRRNVRKGYKPLSKQKSEEELKDKNQLLEAVNKQLHQKLTETQGELKDLTQKVELLEKFRDNCLAILESKGLDPALGSETLASRQESTTDHMDSMLLLETLQEELKLFNETAKKQMEELQALKVKLEMKEERVRFLEQQTLCNNQVNDLTTALKEMEQLLEM

SEQ ID NO: 44460 - protein, 286 aa, Homo sapiens
  Payload ID: 9058
  Gene Symbol: KNSTRN
  Gene Name: kinetochore-localized astrin/SPAG5 binding protein
  Uniprot ID: Q9Y448
  ENSP ID: ENSP00000391233
MAAPEAPPLDRVFRTTWLSTECDSHPLPPSYRKFLFETQAADLAGGTTVAAGNLLNESEKDCGQDRRAPGVQPCRLVTMTSVVKTVYSLQPPSALSGGQPADTQTRATSKSLLPVRSKEVDVSKQLHSGGPENDVTKITKLRRENGQMKATDTATRRNVRKGYKPLSKQKSEEELKDKNQLLEAVNKQLHQKLTETQGELKDLTQKVELLEKFRDNCLAILESKGLDPALGSETLASRQESTTDHMDSMLLLETLQEELKLFNETAKKQMEELQIAWMNHGILHQM

SEQ ID NO: 44461 - protein, 241 aa, Homo sapiens
  Payload ID: 9058
  Gene Symbol: KNSTRN
  Gene Name: kinetochore-localized astrin/SPAG5 binding protein
  Uniprot ID: Q9Y448
  ENSP ID: ENSP00000393001
MAAPEAPPLDRVFRTTWLSTECDSHPLPPSYRKFLFETQAADLAGGTTVAAGNLLNESEKDCGQDRRAPGVQPCRLVTMTSVVKTVYSLQPPSALSGGQPADTQTRATSKSLLPVRSKEVDVSKQLHSGGPENDVTKITKLRRENGQMKATDTATRRNVRKGYKPLSKQKSEEELKDKNQLLEAVNKQLHQKLTETQGELKDLTQKVELLEKFRDNCLAILESKGLDPVAVRNFARGAEAF

SEQ ID NO: 44462 - protein, 64 aa, Homo sapiens
  Payload ID: 9058
  Gene Symbol: KNSTRN
  Gene Name: kinetochore-localized astrin/SPAG5 binding protein
  ENSP ID: ENSP00000452758
VAAGNLLNESEKDCGQDRRAPGVQPCRLVTMTSVVKTVYSLQPPSALSGGQPAVQLLLQLQTTE

SEQ ID NO: 44463 - protein, 124 aa, Homo sapiens
  Payload ID: 9058
  Gene Symbol: KNSTRN
  Gene Name: kinetochore-localized astrin/SPAG5 binding protein
  ENSP ID: ENSP00000452788
  MOD_RES (1)..(1): Any amino acid
XVAAGNLLNESEKDCGQDRRAPGVQPCRLVTMTSVVKTVYSLQPPSALSGGQPADTQTRATSKSLLPVRSKEVDVSKQLHSGGPENDVTKITKLRRENGQMKATDTATRRNVRKGTTIITATNH

SEQ ID NO: 44464 - protein, 128 aa, Homo sapiens
  Payload ID: 9058
  Gene Symbol: KNSTRN
  Gene Name: kinetochore-localized astrin/SPAG5 binding protein
  ENSP ID: ENSP00000453126
  MOD_RES (1)..(1): Any amino acid
XFETQAADLAGGTTVAAGNLLNESEKDCGQDRRAPGVQPCRLVTMTSVVKTVYSLQPPSALSGGQPADTQTRATSKSLLPVRSKEVDVSKQLHSGGPENDVTKITKLRRENGQMKATDTATRRNVRKG

SEQ ID NO: 44465 - protein, 126 aa, Homo sapiens
  Payload ID: 9058
  Gene Symbol: KNSTRN
  Gene Name: kinetochore-localized astrin/SPAG5 binding protein
  ENSP ID: ENSP00000453213
MAAPEAPPLDRVFRTTWLSTECDSHPLPPSYRKFLFETQAADLAGGTTVAAGNLLNESEKDCGQDRRAPGVQPCRLVTMTSVVKTVYSLQPPSALSGGQPAGPKKSMFPNSFIQEVQRMMLQKSPN

SEQ ID NO: 44466 - protein, 217 aa, Homo sapiens
  Payload ID: 9058
  Gene Symbol: KNSTRN
  Gene Name: kinetochore-localized astrin/SPAG5 binding protein
  ENSP ID: ENSP00000453421
  MOD_RES (1)..(1): Any amino acid
XLNESEKDCGQDRRAPGVQPCRLVTMTSVVKTVYSLQPPSALSGGQPADTQTRATSKSLLPVRSKEVDVSKQLHSGGPENDVTKITKLRRENGQMKATDTATRRNVRKGRSFALVATQAGVQWRNLSSPQPPPPGFKRLSCLSLPNTWDYSYKPLSKQKSEEELKDKNQLLEAVNKQLHQKLTETQGELKDLTQKVELLEKFRDNCLAILESKGLDP

SEQ ID NO: 44467 - protein, 27 aa, Homo sapiens
  Payload ID: 9058
  Gene Symbol: KNSTRN
  Gene Name: kinetochore-localized astrin/SPAG5 binding protein
  ENSP ID: ENSP00000453867
  MOD_RES (1)..(1): Any amino acid
XTSVVKTVYSLQPPSALSGGQPAATNH

SEQ ID NO: 44468 - protein, 67 aa, Homo sapiens
  Payload ID: 9058
  Gene Symbol: KNSTRN
  Gene Name: kinetochore-localized astrin/SPAG5 binding protein
  ENSP ID: ENSP00000454086
  MOD_RES (1)..(1): Any amino acid
XTVAAGNLLNESEKDCGQDRRAPGVQPCRLVTMTSVVKTVYSLQPPSALSGGQPAEHLNGNPGTSGD

SEQ ID NO: 44469 - protein, 238 aa, Homo sapiens
  Payload ID: 9058
  Gene Symbol: KNSTRN
  Gene Name: kinetochore-localized astrin/SPAG5 binding protein
  ENSP ID: ENSP00000476263
MTSVVKTVYSLQPPSALSGGQPADTQTRATSKSLLPVRSKEVDVSKQLHSGGPENDVTKITKLRRENGQMKATDTATRRNVRKGYKPLSKQKSEEELKDKNQLLEAVNKQLHQKLTETQGELKDLTQKVELLEKFRDNCLAILESKGLDPALGSETLASRQESTTDHMDSMLLLETLQEELKLFNETAKKQMEELQALKVKLEMKEERVRFLEQQTLCNNQVNDLTTALKEMEQLLEM

SEQ ID NO: 44470 - protein, 644 aa, Homo sapiens
  Payload ID: 9059
  Gene Symbol: KNG1
  Gene Name: kininogen 1
  Uniprot ID: P01042
  ENSP ID: ENSP00000265023
MKLITILFLCSRLLLSLTQESQSEEIDCNDKDLFKAVDAALKKYNSQNQSNNQFVLYRITEATKTVGSDTFYSFKYEIKEGDCPVQSGKTWQDCEYKDAAKAATGECTATVGKRSSTKFSVATQTCQITPAEGPVVTAQYDCLGCVHPISTQSPDLEPILRHGIQYFNNNTQHSSLFMLNEVKRAQRQVVAGLNFRITYSIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTVSPPHTSMAPAQDEERDSGKEQGHTRRHDWGHEKQRKHNLGHGHKHERDQGHGHQRGHGLGHGHEQQHGLGHGHKFKLDDDLEHQGGHVLDHGHKHKHGHGHGKHKNKGKKNGKHNGWKTEHLASSSEDSTTPSAQTQEKTEGPTPIPSLAKPGVTVTFSDFQDSDLIATMMPPISPAPIQSDDDWIPDIQIDPNGLSFNPISDFPDTTSPKCPGRPWKSVSEINPTTQMKESYYFDLTDGLS

SEQ ID NO: 44471 - protein, 427 aa, Homo sapiens
  Payload ID: 9059
  Gene Symbol: KNG1
  Gene Name: kininogen 1
  Uniprot ID: P01042
  ENSP ID: ENSP00000287611
MKLITILFLCSRLLLSLTQESQSEEIDCNDKDLFKAVDAALKKYNSQNQSNNQFVLYRITEATKTVGSDTFYSFKYEIKEGDCPVQSGKTWQDCEYKDAAKAATGECTATVGKRSSTKFSVATQTCQITPAEGPVVTAQYDCLGCVHPISTQSPDLEPILRHGIQYFNNNTQHSSLFMLNEVKRAQRQVVAGLNFRITYSIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTSHLRSCEYKGRPPKAGAEPASEREVS

SEQ ID NO: 44472 - protein, 391 aa, Homo sapiens
  Payload ID: 9059
  Gene Symbol: KNG1
  Gene Name: kininogen 1
  Uniprot ID: P01042
  ENSP ID: ENSP00000396025
MKLITILFLCSRLLLSLTQESQSEEIDCNDKDLFKAVDAALKKYNSQNQSNNQFVLYRITEATKTVGSDTFYSFKYEIKEGDCPVQSGKTWQDCEYKDAAKAATGECTATVGKRSSTKFSVATQTCQITPAEGPVVTAQYDCLGCVHPISTQSPDLEPILRHGIQYFNNNTQHSSLFMLNEVKRAQRQDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTSHLRSCEYKGRPPKAGAEPASEREVS

SEQ ID NO: 44473 - protein, 101 aa, Homo sapiens
  Payload ID: 9060
  Gene Symbol: KNCN
  Gene Name: kinocilin
  Uniprot ID: A6PVL3
  ENSP ID: ENSP00000379607
MDIPISSRDFRGLQLACVALGLVAGSIIIGISVSKAAAAMGGVFIGAAVLGSLRIHPHPGADHGEGRSSTNGNKEGARSSLSTVSRTLEKLKPGTRGAEEC

SEQ ID NO: 44474 - protein, 124 aa, Homo sapiens
  Payload ID: 9060
  Gene Symbol: KNCN
  Gene Name: kinocilin
  Uniprot ID: A6PVL3
  ENSP ID: ENSP00000419705
MDIPISSRDFRGLQLACVALGLVAGSIIIGISVSKAAAAMGGVFIGAAVLGLLILAYPFLKARFNLDHILPTIGSLRIHPHPGADHGEGRSSTNGNKEGARSSLSTVSRTLEKLKPGTRGAEEC

SEQ ID NO: 44475 - protein, 189 aa, Homo sapiens [sequence omitted]

SEQ ID NO: 44476 - protein, 188 aa, Homo sapiens [sequence omitted]

SEQ ID NO: 44477 - protein, 43 aa, Homo sapiens
  Payload ID: 9061
  Gene Symbol: KRAS
  Gene Name: Kirsten rat sarcoma viral oncogene homolog
  ENSP ID: ENSP00000451856
MTEYKLVVVGAGGVGKSALTIQLIQNHFVDEYDPTIEVLLSSM

SEQ ID NO: 44478 - protein, 75 aa, Homo sapiens
  Payload ID: 9061
  Gene Symbol: KRAS
  Gene Name: Kirsten rat sarcoma viral oncogene homolog
  ENSP ID: ENSP00000452512
MTEYKLVVVGAGGVGKSALTIQLIQNHFVDEYDPTIEGVDDAFYTLVREIRKHKEKMSKDGKKKKKKSKTKCVIM

SEQ ID NO: 44479 - protein, 138 aa, Homo sapiens
  Payload ID: 9062
  Gene Symbol: KISS1
  Gene Name: KiSS-1 metastasis-suppressor
  Uniprot ID: Q15726
  ENSP ID: ENSP00000356162
MNSLVSWQLLLFLCATHFGEPLEKVASVGNSRPTGQQLESLGLLAPGEQSLPCTERKPAATARLSRRGTSLSPPPESSGSPQQPGLSAPHSRQIPAPQGAVLVQREKDLPNYNWNSFGLRFGKREAAPGNHGRSAGRG

SEQ ID NO: 44480 - protein, 144 aa, Homo sapiens [sequence omitted]

SEQ ID NO: 44481 - protein, 398 aa, Homo sapiens
  Payload ID: 9063
  Gene Symbol: KISS1R
  Gene Name: KISS1 receptor
  Uniprot ID: Q969F8
  ENSP ID: ENSP00000234371
MHTVATSGPNASWGAPANASGCPGCGANASDGPVPSPRAVDAWLVPLFFAALMLLGLVGNSLVIYVICRHKPMRTVTNFYIANLAATDVTFLLCCVPFTALLYPLPGWVLGDFMCKFVNYIQQVSVQATCATLTAMSVDRWYVTVFPLRALHRRTPRLALAVSLSIWVGSAAVSAPVLALHRLSPGPRAYCSEAFPSRALERAFALYNLLALYLLPLLATCACYAAMLRHLGRVAVRPAPADSALQGQVLAERAGAVRAKVSRLVAAVVLLFAACWGPIQLFLVLQALGPAGSWHPRSYAAYALKTWAHCMSYSNSALNPLLYAFLGSHFRQAFRRVCPCAPRRPRRPRRPGPSDPAAPHAELLRLGSHPAPARAQKPGSSGLAARGLCVLGEDNAPL

SEQ ID NO: 44482 - protein, 97 aa, Homo sapiens
  Payload ID: 9063
  Gene Symbol: KISS1R
  Gene Name: KISS1 receptor
  ENSP ID: ENSP00000467666
MHTVATSGPNASWGAPANASGCPGCGANASDGPVPSPRAVDAWLVPLFFAALMLLGLVGNSLVIYVICRHKPMRTVTNFYIGLGAGHVCHSDRHECG

SEQ ID NO: 44483 - protein, 226 aa, Homo sapiens
  Payload ID: 9063
  Gene Symbol: KISS1R
  Gene Name: KISS1 receptor
  ENSP ID: ENSP00000475639
MHTVATSGPNASWGAPANASGCPGCGANASDGPVPSPRAVDAWLVPLFFAALMLLGLVGNSLVIYVICRHKPMRTVTNFYIANLAATDVTFLLCCVPFTALLYPLPGWVLGDFMCKFVNYIQQVSVQATCATLTAMSVDRWYVTVFPLRALHRRTPRLALAVSLSIWVGAGAGRARRRRAGQGLAAGGGRGPALRRLLGPHPAVPGAAGAGPRGLLAPTQLRRLRA

SEQ ID NO: 44484 - protein, 245 aa, Homo sapiens
  Payload ID: 9064
  Gene Symbol: KITLG
  Gene Name: KIT ligand
  Uniprot ID: P21583
  ENSP ID: ENSP00000054216
MKKTQTWILTCIYLQLLLFNPLVKTEGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKGKAKNPPGDSSLHWAAMALPALFSLIIGFAFGALYWKKRQPSLTRAVENIQINEEDNEISMLQEKEREFQEV

SEQ ID NO: 44485 - protein, 273 aa, Homo sapiens
  Payload ID: 9064
  Gene Symbol: KITLG
  Gene Name: KIT ligand
  Uniprot ID: P21583
  ENSP ID: ENSP00000228280
MKKTQTWILTCIYLQLLLFNPLVKTEGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 44486 - protein, 56 aa, Homo sapiens
  Payload ID: 9064
  Gene Symbol: KITLG
  Gene Name: KIT ligand
  ENSP ID: ENSP00000474021
MALPALFSLIIGFAFGALYWKKRQPSLTRAVENIQINEEDNEISMLQEKEREFQEV

SEQ ID NO: 44487 - protein, 24 aa, Homo sapiens
  Payload ID: 9064
  Gene Symbol: KITLG
  Gene Name: KIT ligand
  ENSP ID: ENSP00000475042
MITLKYVPGMDVLPSHCWISEMVV

SEQ ID NO: 44488 - protein, 44 aa, Homo sapiens
  Payload ID: 9064
  Gene Symbol: KITLG
  Gene Name: KIT ligand
  ENSP ID: ENSP00000479271
ENSSKCFSVCCKRKRESFKKCNCGLYQHCYFRTLAGNSSCLLHK

SEQ ID NO: 44489 - protein, 538 aa, Homo sapiens
  Payload ID: 9065
  Gene Symbol: KIZ
  Gene Name: kizuna centrosomal protein
  ENSP ID: ENSP00000477873
KMLCSKDSLGLKEELTDEDREKVAVHEGINSGTAMSRGLYQPATIFMGRQMSAILSMRDFSTEHKSPQPTKNFSIPDPHSHRQTAQSSNVTDSCVVQTSNDTQCLNKSDNIDGKASLQIGEKMPVTASVLSEEEQTHCLEIGSNTRHGKSNLSEGKKSAELNSPLRERLSPENRTTDLKCDSSSGSEGEILTREHIEVEEKRASPPVSPIPVSEYCESENKWSQEKHSPWEGVSDHLAHREPKSQKPFRKMQEEEEESWSTSSDLTISISEDDLILESPEPQPNPGGKMEGEDGIEALKLIHAEQERVALSTEKNCILQTLSSPDSEKESSTNAPTREPGQTPDSDVPRAQVGQHVATLKEHDNSVKEEATALLRKALTEECGRRSAIHSSESSCSLPSILNDNSGIKEAKPAVWLNSVPTREQETEAYQLLKKATLQDNTNQTENRFQKTDASVSHLSGLNIGSGAFETKTANKIASEASFSSSEGSPLSRHENKKKPVINLKSNALWDESDDSNSEIEAALRPRNHNTDDSDDFYD

SEQ ID NO: 44490 - protein, 570 aa, Homo sapiens
  Payload ID: 9065
  Gene Symbol: KIZ
  Gene Name: kizuna centrosomal protein
  Uniprot ID: Q2M2Z5
  ENSP ID: ENSP00000478019
MQLEYETQIKKMLCSKDSLGLKEELTDEDREKVAVHEGINSGTAMSRGLYQPATIFMGRQMSAILSMRDFSTEHKSPQPTKNFSIPDPHSHRQTAQSSNVTDSCVVQTSNDTQCLNKSDNIDGKASLQIGEKMPVTASVLSEEEQTHCLEIGSNTRHGKSNLSEGKKSAELNSPLRERLSPENRTTDLKCDSSSGSEGEILTREHIEVEEKRASPPVSPIPVSEYCESENKWSQEKHSPWEGVSDHLAHREPKSQKPFRKMQEEEEESWSTSSDLTISISEDDLILESPEPQPNPGGKMEGEDGIEALKLIHAEQERVALSTEKNCILQTLSSPDSEKESSTNAPTREPGQTPDSDVPRAQVGQHVATLKEHDNSVKEEATALLRKALTEECGRRSAIHSSESSCSLPSILNDNSGIKEAKPAVWLNSVPTREQEVSSGCGDKSKKENVAADIPITETEAYQLLKKATLQDNTNQTENRFQKTDASVSHLSGLNIGSGAFETKTANKIASEASFSSSEGSPLSRHENKKKPVINLKSNALWDESDDSNSEIEAALRPRNHNTDDSDDFYD

SEQ ID NO: 44491 - protein, 673 aa, Homo sapiens
  Payload ID: 9065
  Gene Symbol: KIZ
  Gene Name: kizuna centrosomal protein
  Uniprot ID: Q2M2Z5
  ENSP ID: ENSP00000479542
MSRTLASAVPLSSPDYYERLGQLQHGLRDSEKKRLDLEKKLYEYNQSDTCRVKLKYVKLKNYLKEICESEKKAHTRNQEYLKRFERVQAHVVHFTTNTEKLQKLKLEYETQIKKMLCSKDSLGLKEELTDEDREKVAVHEGINSGTAMSRGLYQPATIFMGRQMSAILSMRDFSTEHKSPQPTKNFSIPDPHSHRQTAQSSNVTDSCVVQTSNDTQCLNKSDNIDGKASLQIGEKMPVTASVLSEEEQTHCLEIGSNTRHGKSNLSEGKKSAELNSPLRERLSPENRTTDLKCDSSSGSEGEILTREHIEVEEKRASPPVSPIPVSEYCESENKWSQEKHSPWEGVSDHLAHREPKSQKPFRKMQEEEEESWSTSSDLTISISEDDLILESPEPQPNPGGKMEGEDGIEALKLIHAEQERVALSTEKNCILQTLSSPDSEKESSTNAPTREPGQTPDSDVPRAQVGQHVATLKEHDNSVKEEATALLRKALTEECGRRSAIHSSESSCSLPSILNDNSGIKEAKPAVWLNSVPTREQEVSSGCGDKSKKENVAADIPITETEAYQLLKKATLQDNTNQTENRFQKTDASVSHLSGLNIGSGAFETKTANKIASEASFSSSEGSPLSRHENKKKPVINLKSNALWDESDDSNSEIEAALRPRNHNTDDSDDFYD

SEQ ID NO: 44492 - protein, 540 aa, Homo sapiens
  Payload ID: 9065
  Gene Symbol: KIZ
  Gene Name: kizuna centrosomal protein
  Uniprot ID: Q2M2Z5
  ENSP ID: ENSP00000480612
MQVAVHEGINSGTAMSRGLYQPATIFMGRQMSAILSMRDFSTEHKSPQPTKNFSIPDPHSHRQTAQSSNVTDSCVVQTSNDTQCLNKSDNIDGKASLQIGEKMPVTASVLSEEEQTHCLEIGSNTRHGKSNLSEGKKSAELNSPLRERLSPENRTTDLKCDSSSGSEGEILTREHIEVEEKRASPPVSPIPVSEYCESENKWSQEKHSPWEGVSDHLAHREPKSQKPFRKMQEEEEESWSTSSDLTISISEDDLILESPEPQPNPGGKMEGEDGIEALKLIHAEQERVALSTEKNCILQTLSSPDSEKESSTNAPTREPGQTPDSDVPRAQVGQHVATLKEHDNSVKEEATALLRKALTEECGRRSAIHSSESSCSLPSILNDNSGIKEAKPAVWLNSVPTREQEVSSGCGDKSKKENVAADIPITETEAYQLLKKATLQDNTNQTENRFQKTDASVSHLSGLNIGSGAFETKTANKIASEASFSSSEGSPLSRHENKKKPVINLKSNALWDESDDSNSEIEAALRPRNHNTDDSDDFYD

SEQ ID NO: 44493 - protein, 450 aa, Homo sapiens
  Payload ID: 9065
  Gene Symbol: KIZ
  Gene Name: kizuna centrosomal protein
  ENSP ID: ENSP00000480652
  MOD_RES (1)..(1): Any amino acid
XCVVQTSNDTQCLNKSDNIDGKASLQIGEKMPVTASVLSEEEQTHCLEIGSNTRHGKSNLSEGKKSAELNSPLRERLSPENRTTDLKCDSSSGSEGEILTREHIEVEEKRASPPVSPIPVSEYCESENKWSQEKHSPWEGVSDHLAHREPKSQKPFRKMQEEEEESWSTSSDLTISISEDDLILESPEPQPNPGGKMEGEDGIEALKLIHAEQERVALSTEKNCILQTLSSPDSEKESSTNAPTREPGQTPDSDVPRAQATALLRKALTEECGRRSAIHSSESSCSLPSILNDNSGIKEAKPAVWLNSVPTREQEVSSGCGDKSKKENVAADIPITETEAYQLLKKATLQDNTNQTENRFQKTDASVSHLSGLNIGSGAFETKTANKIASEASFSSSEGSPLSRHENKKKPVINLKSNALWDESDDSNSEIEAALRPRNHNTDDSDDFYD

SEQ ID NO: 44494 - protein, 61 aa, Homo sapiens
  Payload ID: 9065
  Gene Symbol: KIZ
  Gene Name: kizuna centrosomal protein
  ENSP ID: ENSP00000480859
MSRTLASAVPLSSPDYYERLGQLQHGLRDRFPWRLLHTFVPFVLDASGIFCFLDQRSIFTK

SEQ ID NO: 44495 - protein, 521 aa, Homo sapiens
  Payload ID: 9065
  Gene Symbol: KIZ
  Gene Name: kizuna centrosomal protein
  ENSP ID: ENSP00000483065
KKMLCSKDSLGLKEELTDEDREKVAVHEGINSGTAMSRGLYQPATIFMGRQMSAILSMRDFSTEHKSPQPTKNFSIPDPHSHRQTAQSSNVTDSCVVQTSNDTQCLNKSDNIDGKASLQIGEKMPVTASVLSEEEQTHCLEIGSNTRHGKSNLSEGKKSAELNSPLRERLSPENRTTDLKCDSSSGSEGEILTREHIEVEEKRASPPVSPIPVSEYCESENKWSQEKHSPWEGVSDHLAHREPKSQKPFRKMQEEEEESWSTSSDLTISISEDDLILESPEPQPNPGGKMEGEDGIEALKLIHAEQERVALSTEKNCILQTLSSPDSEKESSTNAPTREPGQTPDSDVPRAQVGQHVATLKEHDNSVKEEATALLRKALTEECGRRSAIHSSESSCSLPSILNDNSGIKEAKPAVWLNSVPTREQETEAYQLLKKATLQDNTNQTENRFQKTDASVSHLSGLNIGSGAFETKTANKIASEASFSSSEGSPLSRHENKKKPVINLKSNGERDNRTLDFLFLF

SEQ ID NO: 44496 - protein, 624 aa, Homo sapiens
  Payload ID: 9065
  Gene Symbol: KIZ
  Gene Name: kizuna centrosomal protein
  ENSP ID: ENSP00000483644
  MOD_RES (1)..(1): Any amino acid
XVGRSPSATPAERPPRGCAELAQRQQHEPDPRIGRAPVESRLLREAGPTPARAAGQLEYETQIKKMLCSKDSLGLKEELTDEDREKVAVHEGINSGTAMSRGLYQPATIFMGRQMSAILSMRDFSTEHKSPQPTKNFSIPDPHSHRQTAQSSNVTDSCVVQTSNDTQCLNKSDNIDGKASLQIGEKMPVTASVLSEEEQTHCLEIGSNTRHGKSNLSEGKKSAELNSPLRERLSPENRTTDLKCDSSSGSEGEILTREHIEVEEKRASPPVSPIPVSEYCESENKWSQEKHSPWEGVSDHLAHREPKSQKPFRKMQEEEEESWSTSSDLTISISEDDLILESPEPQPNPGGKMEGEDGIEALKLIHAEQERVALSTEKNCILQTLSSPDSEKESSTNAPTREPGQTPDSDVPRAQVGQHVATLKEHDNSVKEEATALLRKALTEECGRRSAIHSSESSCSLPSILNDNSGIKEAKPAVWLNSVPTREQEVSSGCGDKSKKENVAADIPITETEAYQLLKKATLQDNTNQTENRFQKTDASVSHLSGLNIGSGAFETKTANKIASEASFSSSEGSPLSRHENKKKPVINLKSNALWDESDDSNSEIEAALRPRNHNTDDSDDFYD

SEQ ID NO: 44497 - protein, 624 aa, Homo sapiens
  Payload ID: 9065
  Gene Symbol: KIZ
  Gene Name: kizuna centrosomal protein
  ENSP ID: ENSP00000484706
MVGRSPSATPAERPPRGCAELAQRQQHEPDPRIGRAPVESRLLREAGPTPARAAGQLEYETQIKKMLCSKDSLGLKEELTDEDREKVAVHEGINSGTAMSRGLYQPATIFMGRQMSAILSMRDFSTEHKSPQPTKNFSIPDPHSHRQTAQSSNVTDSCVVQTSNDTQCLNKSDNIDGKASLQIGEKMPVTASVLSEEEQTHCLEIGSNTRHGKSNLSEGKKSAELNSPLRERLSPENRTTDLKCDSSSGSEGEILTREHIEVEEKRASPPVSPIPVSEYCESENKWSQEKHSPWEGVSDHLAHREPKSQKPFRKMQEEEEESWSTSSDLTISISEDDLILESPEPQPNPGGKMEGEDGIEALKLIHAEQERVALSTEKNCILQTLSSPDSEKESSTNAPTREPGQTPDSDVPRAQVGQHVATLKEHDNSVKEEATALLRKALTEECGRRSAIHSSESSCSLPSILNDNSGIKEAKPAVWLNSVPTREQEVSSGCGDKSKKENVAADIPITETEAYQLLKKATLQDNTNQTENRFQKTDASVSHLSGLNIGSGAFETKTANKIASEASFSSSEGSPLSRHENKKKPVINLKSNALWDESDDSNSEIEAALRPRNHNTDDSDDFYD

SEQ ID NO: 44498 - protein, 1012 aa, Homo sapiens
  Payload ID: 9066
  Gene Symbol: KL
  Gene Name: klotho
  Uniprot ID: Q9UEF7
  ENSP ID: ENSP00000369442
MPASAPPRRPRPPPPSLSLLLVLLGLGGRRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSLLAFIAFLFFASIISLSLIFYYSKKGRRSYK

SEQ ID NO: 44499 - protein, 1044 aa, Homo sapiens
  Payload ID: 9067
  Gene Symbol: KLB
  Gene Name: klotho beta
  Uniprot ID: Q86Z14
  ENSP ID: ENSP00000257408
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPIVTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDRQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 44500 - protein, 150 aa, Homo sapiens
  Payload ID: 9068
  Gene Symbol: KLRC4-KLRK1
  Gene Name: KLRC4-KLRK1 readthrough
  ENSP ID: ENSP00000455951
  MOD_RES (1)..(1): Any amino acid
XEVSLAQDPKRQQRKLKGNKISISGTKQEIFQVELNLQNASSDHQGNDKTYHCKGLLPPPEKLTAEVLGIICIVLMATVLKTIVLIPCIGVLEQNNFSLNRRMQKARHCGHCPEEWITYSNSCYYIGKERRTWEERVCWPVLRRTLICFL

SEQ ID NO: 44501 - protein, 37 aa, Homo sapiens
  Payload ID: 9068
  Gene Symbol: KLRC4-KLRK1
  Gene Name: KLRC4-KLRK1 readthrough
  ENSP ID: ENSP00000456286
EEWITYSNSCYYIGKERRTWEERVCWPVLRRTLICFL

SEQ ID NO: 44502 - protein, 75 aa, Homo sapiens
  Payload ID: 9068
  Gene Symbol: KLRC4-KLRK1
  Gene Name: KLRC4-KLRK1 readthrough
  ENSP ID: ENSP00000457500
MATVLKTIVLIPCIGVLEQNNFSLNRRMQKARHCGHCPEEWITYSNSCYYIGKERRTWEERVCWPVLRRTLICFL

SEQ ID NO: 44503 - protein, 75 aa, Homo sapiens; identical to SEQ ID NO: 44502
  Payload ID: 9068
  Gene Symbol: KLRC4-KLRK1
  Gene Name: KLRC4-KLRK1 readthrough
  ENSP ID: ENSP00000465254

SEQ ID NO: 44504 - protein, 75 aa, Homo sapiens; identical to SEQ ID NO: 44502
  Payload ID: 9068
  Gene Symbol: KLRC4-KLRK1
  Gene Name: KLRC4-KLRK1 readthrough
  ENSP ID: ENSP00000465434

SEQ ID NO: 44505 - protein, 75 aa, Homo sapiens; identical to SEQ ID NO: 44502
  Payload ID: 9068
  Gene Symbol: KLRC4-KLRK1
  Gene Name: KLRC4-KLRK1 readthrough
  ENSP ID: ENSP00000466326

SEQ ID NO: 44506 - protein, 75 aa, Homo sapiens; identical to SEQ ID NO: 44502
  Payload ID: 9068
  Gene Symbol: KLRC4-KLRK1
  Gene Name: KLRC4-KLRK1 readthrough
  ENSP ID: ENSP00000467152

SEQ ID NO: 44507 - protein, 150 aa, Homo sapiens; identical to SEQ ID NO: 44500
  Payload ID: 9068
  Gene Symbol: KLRC4-KLRK1
  Gene Name: KLRC4-KLRK1 readthrough
  ENSP ID: ENSP00000467228
  MOD_RES (1)..(1): Any amino acid

SEQ ID NO: 44508 - protein, 35 aa, Homo sapiens
  Payload ID: 9068
  Gene Symbol: KLRC4-KLRK1
  Gene Name: KLRC4-KLRK1 readthrough
  ENSP ID: ENSP00000467316
  MOD_RES (1)..(1): Any amino acid
XITYSNSCYYIGKERRTWEERVCWPVLRRTLICFL

SEQ ID NO: 44509 - protein, 75 aa, Homo sapiens; identical to SEQ ID NO: 44502
  Payload ID: 9068
  Gene Symbol: KLRC4-KLRK1
  Gene Name: KLRC4-KLRK1 readthrough
  ENSP ID: ENSP00000467880

SEQ ID NO: 44510 - protein, 75 aa, Homo sapiens; identical to SEQ ID NO: 44502
  Payload ID: 9068
  Gene Symbol: KLRC4-KLRK1
  Gene Name: KLRC4-KLRK1 readthrough
  ENSP ID: ENSP00000468074

SEQ ID NO: 44511 - protein, 75 aa, Homo sapiens; identical to SEQ ID NO: 44502
  Payload ID: 9068
  Gene Symbol: KLRC4-KLRK1
  Gene Name: KLRC4-KLRK1 readthrough
  ENSP ID: ENSP00000468432

SEQ ID NO: 44512 - protein, 283 aa, Homo sapiens
  Payload ID: 9069
  Gene Symbol: KANK1
  Gene Name: KN motif and ankyrin repeat domains 1
  ENSP ID: ENSP00000371723
  MOD_RES (1)..(1): Any amino acid
XYELSEKMLSACNLLKNTINDPKALTSKDMRFCLNTLQHEWFRVSSQKSAIPAMVGDYIAAFEAISPDVLRYVINLADGNGNTALHYSVSHSNFEIVKLLLDADVCNVDHQNKAGYTPIMLAALAAVEAEKDMRIVEELFGCGDVNAKASQAGQTALMLAVSHGRIDMVKGLLACGADVNIQDDEGSTALMCASEHGHVEIVKLLLAQPGCNGHLEDNDGSTALSIALEAGHKDIAVLLYAHVNFAKAQSPVSVVHLAFVNRLKSTRLVDPLPPGIDGRQILC

SEQ ID NO: 44513 - protein, 352 aa, Homo sapiens
  Payload ID: 9069
  Gene Symbol: KANK1
  Gene Name: KN motif and ankyrin repeat domains 1
  ENSP ID: ENSP00000371726
ECDVIEYPLEEEEEEEDEDTRGMAEGHHAVNIEGLKSARVEDEMQVQECEPEKVEIRERYELSEKMLSACNLLKNTINDPKALTSKDMGQVQWLTPMIPTLREADAGGSHERFCLNTLQHEWFRVSSQKSAIPAMVGDYIAAFEAISPDVLRYVINLADGNGNTALHYSVSHSNFEIVKLLLDADVCNVDHQNKAGYTPIMLAALAAVEAEKDMRIVEELFGCGDVNAKASQAGQTALMLAVSHGRIDMVKGLLACGADVNIQDDEGSTALMCASEHGHVEIVKLLLAQPGCNGHLEDNDGSTALSIALEAGHKDIAVLLYAHVNFAKAQSPGTPRLGRKTSPGPTHRGSFD

SEQ ID NO: 44514 - protein, 1194 aa, Homo sapiens
  Payload ID: 9069
  Gene Symbol: KANK1
  Gene Name: KN motif and ankyrin repeat domains 1
  Uniprot ID: Q14678
  ENSP ID: ENSP00000371730
METRRRLEQERATMQMTPGEFRRPRLASFGGMGTTSSLPSFVGSGNHNPAKHQLQNGYQGNGDYGSYAPAAPTTSSMGSSIRHSPLSSGISTPVTNVSPMHLQHIREQMAIALKRLKELEEQVRTIPVLQVKISVLQEEKRQLVSQLKNQRAASQINVCGVRKRSYSAGNASQLEQLSRARRSGGELYIDYEEEEMETVEQSTQRIKEFRQLTADMQALEQKIQDSSCEASSELRENGECRSVAVGAEENMNDIVVYHRGSRSCKDAAVGTLVEMRNCGVSVTEAMLGVMTEADKEIELQQQTIESLKEKIYRLEVQLRETTHDREMTKLKQELQAAGSRKKVDKATMAQPLVFSKVVEAVVQTRDQMVGSHMDLVDTCVGTSVETNSVGISCQPECKNKVVGPELPMNWWIVKERVEMHDRCAGRSVEMCDKSVSVEVSVCETGSNTEESVNDLTLLKTNLNLKEVRSIGCGDCSVDVTVCSPKECASRGVNTEAVSQVEAAVMAVPRTADQDTSTDLEQVHQFTNTETATLIESCTNTCLSTLDKQTSTQTVETRTVAVGEGRVKDINSSTKTRSIGVGTLLSGHSGFDRPSAVKTKESGVGQININDNYLVGLKMRTIACGPPQLTVGLTASRRSVGVGDDPVGESLENPQPQAPLGMMTGLDHYIERIQKLLAEQQTLLAENYSELAEAFGEPHSQMGSLNSQLISTLSSINSVMKSASTEELRNPDFQKTSLGKITGNYLGYTCKCGGLQSGSPLSSQTSQPEQEVGTSEGKPISSLDAFPTQEGTLSPVNLTDDQIAAGLYACTNNESTLKSIMKKKDGNKDSNGAKKNLQFVGINGGYETTSSDDSSSDESSSSESDDECDVIEYPLEEEEEEEDEDTRGMAEGHHAVNIEGLKSARVEDEMQVQECEPEKVEIRERYELSEKMLSACNLLKNTINDPKALTSKDMRFCLNTLQHEWFRVSSQKSAIPAMVGDYIAAFEAISPDVLRYVINLADGNGNTALHYSVSHSNFEIVKLLLDADVCNVDHQNKAGYTPIMLAALAAVEAEKDMRIVEELFGCGDVNAKASQAGQTALMLAVSHGRIDMVKGLLACGADVNIQDDEGSTALMCASEHGHVEIVKLLLAQPGCNGHLEDNDGSTALSIALEAGHKDIAVLLYAHVNFAKAQSPGTPRLGRKTSPGPTHRGSFD

SEQ ID NO: 44515 - protein, 1352 aa, Homo sapiens
  Payload ID: 9069
  Gene Symbol: KANK1
  Gene Name: KN motif and ankyrin repeat domains 1
  Uniprot ID: Q14678
  ENSP ID: ENSP00000371734
MAHTTKVNGSASGKAGDILSGDQDKEQKDPYFVETPYGYQLDLDFLKYVDDIQKGNTIKRLNIQKRRKPSVPCPEPRTTSGQQGIWTSTESLSSSNSDDNKQCPNFLIARSQVTSTPISKPPPPLETSLPFLTIPENRQLPPPSPQLPKHNLHVTKTLMETRRRLEQERATMQMTPGEFRRPRLASFGGMGTTSSLPSFVGSGNHNPAKHQLQNGYQGNGDYGSYAPAAPTTSSMGSSIRHSPLSSGISTPVTNVSPMHLQHIREQMAIALKRLKELEEQVRTIPVLQVKISVLQEEKRQLVSQLKNQRAASQINVCGVRKRSYSAGNASQLEQLSRARRSGGELYIDYEEEEMETVEQSTQRIKEFRQLTADMQALEQKIQDSSCEASSELRENGECRSVAVGAEENMNDIVVYHRGSRSCKDAAVGTLVEMRNCGVSVTEAMLGVMTEADKEIELQQQTIESLKEKIYRLEVQLRETTHDREMTKLKQELQAAGSRKKVDKATMAQPLVFSKVVEAVVQTRDQMVGSHMDLVDTCVGTSVETNSVGISCQPECKNKVVGPELPMNWWIVKERVEMHDRCAGRSVEMCDKSVSVEVSVCETGSNTEESVNDLTLLKTNLNLKEVRSIGCGDCSVDVTVCSPKECASRGVNTEAVSQVEAAVMAVPRTADQDTSTDLEQVHQFTNTETATLIESCTNTCLSTLDKQTSTQTVETRTVAVGEGRVKDINSSTKTRSIGVGTLLSGHSGFDRPSAVKTKESGVGQININDNYLVGLKMRTIACGPPQLTVGLTASRRSVGVGDDPVGESLENPQPQAPLGMMTGLDHYIERIQKLLAEQQTLLAENYSELAEAFGEPHSQMGSLNSQLISTLSSINSVMKSASTEELRNPDFQKTSLGKITGNYLGYTCKCGGLQSGSPLSSQTSQPEQEVGTSEGKPISSLDAFPTQEGTLSPVNLTDDQIAAGLYACTNNESTLKSIMKKKDGNKDSNGAKKNLQFVGINGGYETTSSDDSSSDESSSSESDDECDVIEYPLEEEEEEEDEDTRGMAEGHHAVNIEGLKSARVEDEMQVQECEPEKVEIRERYELSEKMLSACNLLKNTINDPKALTSKDMRFCLNTLQHEWFRVSSQKSAIPAMVGDYIAAFEAISPDVLRYVINLADGNGNTALHYSVSHSNFEIVKLLLDADVCNVDHQNKAGYTPIMLAALAAVEAEKDMRIVEELFGCGDVNAKASQAGQTALMLAVSHGRIDMVKGLLACGADVNIQDDEGSTALMCASEHGHVEIVKLLLAQPGCNGHLEDNDGSTALSIALEAGHKDIAVLLYAHVNFAKAQSPGTPRLGRKTSPGPTHRGSFD

SEQ ID NO: 44516 - protein, 1352 aa, Homo sapiens; identical to SEQ ID NO: 44515
  Payload ID: 9069
  Gene Symbol: KANK1
  Gene Name: KN motif and ankyrin repeat domains 1
  Uniprot ID: Q14678
  ENSP ID: ENSP00000371740

SEQ ID NO: 44517 - protein, 1352 aa, Homo sapiens; identical to SEQ ID NO: 44515
  Payload ID: 9069
  Gene Symbol: KANK1
  Gene Name: KN motif and ankyrin repeat domains 1
  Uniprot ID: Q14678
  ENSP ID: ENSP00000477725

SEQ ID NO: 44518 - protein, 2 aa, Homo sapiens
  Payload ID: 9070
  Gene Symbol: KANK2
  Gene Name: KN motif and ankyrin repeat domains 2
  ENSP ID: ENSP00000464861
MA

SEQ ID NO: 44519 - protein, 221 aa, Homo sapiens
  Payload ID: 9070
  Gene Symbol: KANK2
  Gene Name: KN motif and ankyrin repeat domains 2
  ENSP ID: ENSP00000464896
  MOD_RES (1)..(1): Any amino acid
XEKYLDNPNALTERELKVAYTTVLQEWLRLACRSDAHPELVRRHLVTFRAMSARLLDYVVNIADSNGNTALHYSVSHANFPVVQQLLDSGVCKVDKQNRAGYSPIMLTALATLKTQDDIETVLQLFRLGNINAKASQAGQTALMLAVSHGRVDVVKALLACEADVNVQDDDGSTALMCACEHGHKEIAGLLLAVPSCDISLTDRFAPMSDDESPTSSSAEE

SEQ ID NO: 44520 - protein, 851 aa, Homo sapiens
  Payload ID: 9070
  Gene Symbol: KANK2
  Gene Name: KN motif and ankyrin repeat domains 2
  Uniprot ID: Q63ZY3
  ENSP ID: ENSP00000465650
MAQVLHVPAPFPGTPGPASPPAFPAKDPDPPYSVETPYGYRLDLDFLKYVDDIEKGHTLRRVAVQRRPRLSSLPRGPGSWWTSTESLCSNASGDSRHSAYSYCGRGFYPQYGALETRGGFNPRVERTLLDARRRLEDQAATPTGLGSLTPSAAGSTASLVGVGLPPPTPRSSGLSTPVPPSAGHLAHVREQMAGALRKLRQLEEQVKLIPVLQVKLSVLQEEKRQLTVQLKSQKFLGHPTAGRGRSELCLDLPDPPEDPVALETRSVGTWVRERDLGMPDGEAALAAKVAVLETQLKKALQELQAAQARQADPQPQAWPPPDSPVRVDTVRVVEGPREVEVVASTAAGAPAQRAQSLEPYGTGLRALAMPGRPESPPVFRSQEVVETMCPVPAAATSNVHMVKKISITERSCDGAAGLPEVPAESSSSPPGSEVASLTQPEKSTGRVPTQEPTHREPTRQAASQESEEAGGTGGPPAGVRSIMKRKEEVADPTAHRRSLQFVGVNGGYESSSEDSSTAENISDNDSTENEAPEPRERVPSVAEAPQLRPAGTAAAKTSRQECQLSRESQHIPTAEGASGSNTEEEIRMELSPDLISACLALEKYLDNPNALTERELKVAYTTVLQEWLRLACRSDAHPELVRRHLVTFRAMSARLLDYVVNIADSNGNTALHYSVSHANFPVVQQLLDSGVCKVDKQNRAGYSPIMLTALATLKTQDDIETVLQLFRLGNINAKASQAGQTALMLAVSHGRVDVVKALLACEADVNVQDDDGSTALMCACEHGHKEIAGLLLAVPSCDISLTDRDGSTALMVALDAGQSEIASMLYSRMNIKCSFAPMSDDESPTSSSAEE

SEQ ID NO: 44521 - protein, 44 aa, Homo sapiens
  Payload ID: 9070
  Gene Symbol: KANK2
  Gene Name: KN motif and ankyrin repeat domains 2
  ENSP ID: ENSP00000465914
MAQVLHVPAPFPGTPGPASPPAFPAKDPDPPYSVETPYGYRLDL

SEQ ID NO: 44522 - protein, 841 aa, Homo sapiens
  Payload ID: 9070
  Gene Symbol: KANK2
  Gene Name: KN motif and ankyrin repeat domains 2
  Uniprot ID: Q63ZY3
  ENSP ID: ENSP00000467029
MAQVLHVPAPFPGTPGPASPPAFPAKDPDPPYSVETPYGYRLDLDFLKYVDDIEKGHTLRRVAVQRRPRLSSLPRGPGSWWTSTESLCSNASGDSRHSAYSYCGRGFYPQYGALETRGGFNPRVERTLLDARRRLEDQAATPTGLGSLTPSAAGSTASLVGVGLPPPTPRSSGLSTPVPPSAGHLAHVREQMAGALRKLRQLEEQVKLIPVLQVKLSVLQEEKRQLTVQLKSQKFLGHPTAGRGRSELCLDLPDPPEDPVALETRSVGTWVRERDLGMPDGEAALAAKVAVLETQLKKALQELQAAQARQADPQPQAWPPPDSPVRVDTVRVVEGPREVEVVASTAAGAPAQRAQSLEPYGTGLRALAMPGRPESPPVFRSQEVVETMCPVPAAATSNVHMVKKISITERSCDGAAGLPEVPAESSSSPPGSEVASLTQPEKSTGRVPTQEPTHREPTRQAASQESEEAGGTGGPPAGVRSIMKRKEEVADPTAHRRSLQFVGVNGGYESSSEDSSTAENISDNDSTENEAPEPRERVPSVAEAPQLRPAGTAAAKTSRQECQLSRESQHIPTAEGASGSNTEEEIRMELSPDLISACLALEKYLDNPNALTERELKVAYTTVLQEWLRLACRSDAHPELVRRHLVTFRAMSARLLDYVVNIADSNGNTALHYSVSHANFPVVQQLLDSGVCKVDKQNRAGYSPIMLTALATLKTQDDIETVLQLFRLGNINAKASQAGQTALMLAVSHGRVDVVKALLACEADVNVQDDDGSTALMCACEHGHKEIAGLLLAVPSCDISLTDRDGSTALMVALDAGQSEIASMLYSRMNIKCSVSLNPAG

SEQ ID NO: 44523 - protein, 859 aa, Homo sapiens
  Payload ID: 9070
  Gene Symbol: KANK2
  Gene Name: KN motif and ankyrin repeat domains 2
  Uniprot ID: Q63ZY3
  ENSP ID: ENSP00000468002
MAQVLHVPAPFPGTPGPASPPAFPAKDPDPPYSVETPYGYRLDLDFLKYVDDIEKGHTLRRVAVQRRPRLSSLPRGPGSWWTSTESLCSNASGDSRHSAYSYCGRGFYPQYGALETRGGFNPRVERTLLDARRRLEDQAATPTGLGSLTPSAAGSTASLVGVGLPPPTPRSSGLSTPVPPSAGHLAHVREQMAGALRKLRQLEEQVKLIPVLQVKLSVLQEEKRQLTVQLKSQKFLGHPTAGRGRSELCLDLPDPPEDPVALETRSVGTWVRERDLGMPDGEAALAAKVAVLETQLKKALQELQAAQARQADPQPQAWPPPDSPVRVDTVRVVEGPREVEVVASTAAGAPAQRAQSLEPYGTGLRALAMPGRPESPPVFRSQEVVETMCPVPAAATSNVHMVKKISITERSCDGAAGLPEVPAESSSSPPGSEVASLTQPEKSTGRVPTQEPTHREPTRQAASQESEEAGGTAPPLSSPPGGPPAGVRSIMKRKEEVADPTAHRRSLQFVGVNGGYESSSEDSSTAENISDNDSTENEAPEPRERVPSVAEAPQLRPAGTAAAKTSRQECQLSRESQHIPTAEGASGSNTEEEIRMELSPDLISACLALEKYLDNPNALTERELKVAYTTVLQEWLRLACRSDAHPELVRRHLVTFRAMSARLLDYVVNIADSNGNTALHYSVSHANFPVVQQLLDSGVCKVDKQNRAGYSPIMLTALATLKTQDDIETVLQLFRLGNINAKASQAGQTALMLAVSHGRVDVVKALLACEADVNVQDDDGSTALMCACEHGHKEIAGLLLAVPSCDISLTDRDGSTALMVALDAGQSEIASMLYSRMNIKCSFAPMSDDESPTSSSAEE

SEQ ID NO: 44524 - protein, 122 aa, Homo sapiens
  Payload ID: 9070
  Gene Symbol: KANK2
  Gene Name: KN motif and ankyrin repeat domains 2
  ENSP ID: ENSP00000468409
MPDGEAALAAKVAVLETQLKKALQELQAAQARQADPQPQAWPPPDSPVRVDTVRVVEGPREVEVVASTAAGAPAQRAQSLEPYGTGLRALAMPGRPESPPVFRSQEVVETMCPVPAAATSNV

SEQ ID NO: 44525 - protein, 147 aa, Homo sapiens
  Payload ID: 9070
  Gene Symbol: KANK2
  Gene Name: KN motif and ankyrin repeat domains 2
  ENSP ID: ENSP00000468490
MAQVLHVPAPFPGTPGPASPPAFPAKDPDPPYSVETPYGYRLDLDFLKYVDDIEKGHTLRRVAVQRRPRLSSLPRGPGSWWTSTESLCSNASGDSRHSAYSYCGRGFYPQYGALETRGGFNPRVERTLLDARRRLEDQAATPTGLGS

SEQ ID NO: 44526 - protein, 821 aa, Homo sapiens
  Payload ID: 9071
  Gene Symbol: KANK3
  Gene Name: KN motif and ankyrin repeat domains 3
  Uniprot ID: Q6NY19
  ENSP ID: ENSP00000328923
MAKFALNQNLPDLGGPRLCPVPAAGGARSPSSPYSVETPYGFHLDLDFLKYIEELERGPAARRAPGPPTSRRPRAPRPGLAGARSPGAWTSSESLASDDGGAPGILSQGAPSGLLMQPLSPRAPVRNPRVEHTLRETSRRLELAQTHERAPSPGRGVPRSPRGSGRSSPAPNLAPASPGPAQLQLVREQMAAALRRLRELEDQARTLPELQEQVRALRAEKARLLAGRAQPEPDGEAETRPDKLAQLRRLTERLATSERGGRARASPRADSPDGLAAGRSEGALQVLDGEVGSLDGTPQTREVAAEAVPETREAGAQAVPETREAGVEAAPETVEADAWVTEALLGLPAAAERELELLRASLEHQRGVSELLRGRLRELEEAREAAEEAAAGARAQLREATTQTPWSCAEKAAQTESPAEAPSLTQESSPGSMDGDRAVAPAGILKSIMKKRDGTPGAQPSSGPKSLQFVGVLNGEYESSSSEDASDSDGDSENGGAEPPGSSSGSGDDSGGGSDSGTPGPPSGGDIRDPEPEAEAEPQQVAQGRCELSPRLREACVALQRQLSRPRGVASDGGAVRLVAQEWFRVSSQRRSQAEPVARMLEGVRRLGPELLAHVVNLADGNGNTALHYSVSHGNLAIASLLLDTGACEVNRQNRAGYSALMLAALTSVRQEEEDMAVVQRLFCMGDVNAKASQTGQTALMLAISHGRQDMVATLLACGADVNAQDADGATALMCASEYGRLDTVRLLLTQPGCDPAILDNEGTSALAIALEAEQDEVAALLHAHLSSGQPDTQSESPPGSQTATPGEGECGDNGENPQVQ

SEQ ID NO: 44527 - protein, 146 aa, Homo sapiens
  Payload ID: 9071
  Gene Symbol: KANK3
  Gene Name: KN motif and ankyrin repeat domains 3
  ENSP ID: ENSP00000470585
MAKFALNQNLPGILKSIMKKRDGTPGAQPSSGPKSLQFVGVLNGEYESSSSEDASDSDGDSENGGAEPPGSSSGSGDDSGGGSDSGTPGPPSGGDIRDPEPEAEAEPQQVAQGRCELSPRLREACVALQRQLSRPRGVASDGGAVR

SEQ ID NO: 44528 - protein, 840 aa, Homo sapiens
  Payload ID: 9071
  Gene Symbol: KANK3
  Gene Name: KN motif and ankyrin repeat domains 3
  Uniprot ID: Q6NY19
  ENSP ID: ENSP00000470728
MAKFALNQNLPDLGGPRLCPVPAAGGARSPSSPYSVETPYGFHLDLDFLKYIEELERGPAARRAPGPPTSRRPRAPRPGLAGARSPGAWTSSESLASDDGGAPGILSQGAPSGLLMQPLSPRAPVRNPRVEHTLRETSRRLELAQTHERAPSPGRGVPRSPRGSGRSSPAPNLAPASPGPAQLQLVREQMAAALRRLRELEDQARTLPELQEQVRALRAEKARLLAGRAQPEPDGEAETRPDKLAQLRRLTERLATSERGGRARASPRADSPDGLAAGRSEGALQVLDGEVGSLDGTPQTREVAAEAVPETREAGAQAVPETREAGVEAAPETVEADAWVTEALLGLPAAAERELELLRASLEHQRGVSELLRGRLRELEEAREAAEEAAAGARAQLREATTQTPWSCAEKAAQTESPAEAPSLTQESSPGSMDGDRAVAPAGILKSIMKKRDGTPGAQPSSGPKSLQFVGVLNGEYESSSSEDASDSDGDSENGGAEPPGSSSGSGDDSGGGSDSGTPGPPSGGDIRDPEPEAEAEPQQVAQGRCELSPRLREACVALQRQLSRPRGVASDGGAVRLVAQEWFRVSSQRRSQAEPVARMLEGVRRLGPELLAHVVNLADGNGNTALHYSVSHGNLAIASLLLDTGACEVNRQNRAGYSALMLAALTSVRQEEEDMAVVQRLFCMGDVNAKASQTGQTALMLAISHGRQDMVATLLACGADVNAQDADGATALMCASEYGRLDTVRLLLTQPGCDPAILDNEGTSALAIALEAEQDEVAALLHAHLSSGQPDTQAGVQRHNLSSLQPPPPRFKKFSCLSLPSSWDYNSCEPSRLAQLTIF

SEQ ID NO: 44529 - protein, 212 aa, Homo sapiens
  Payload ID: 9071
  Gene Symbol: KANK3
  Gene Name: KN motif and ankyrin repeat domains 3
  ENSP ID: ENSP00000484877
MATARTVAPSPRVAPRAPGMTAAGDPTRAPLALPAAGTSGTLSPRRRQSLSRWHRGGERRSLVVWRGGGCPPPGRRCPRSILSLSWPPLQVRAEPASEGGVRSAAAAAEPAPRSASDGGAVRLVAQEWFRVSSQRRSQAEPVARMLEGVRRLGPELLAHVVNLADGNGNTALHYSVSHGNLAIASLLLDTGQSQGRVGGHQEMGGGRGQGLT

SEQ ID NO: 44530 - protein, 133 aa, Homo sapiens
  Payload ID: 9072
  Gene Symbol: KANK4
  Gene Name: KN motif and ankyrin repeat domains 4
  ENSP ID: ENSP00000321161
MITPLASAETNEDMAVVWKLLREGNVNIQATQGGQTALMLGVSHDREDMVQALLSCQADVNLQDHDGSSALMVACHHGNVDLVRLLLAHPACDSSLTDKAGRTALSIALKSPTHMEIAGLLRAHAEQGRSLGL

SEQ ID NO: 44531 - protein, 367 aa, Homo sapiens
  Payload ID: 9072
  Gene Symbol: KANK4
  Gene Name: KN motif and ankyrin repeat domains 4
  Uniprot ID: Q5T7N3
  ENSP ID: ENSP00000346352
MEKTDEISPSTSLKSIMKKKDYGFRAGGNGTKKNLQFVGVNGGYETTSSEETSGEDSTPEDLSDSEAEKKCDGPDHKHVKDAHLTCEAGQGIPEGTCHAAQESGPGEEVPHSKAERYKPSEEFLNACRALSQHLPETGTTTDQLLRQSLNTISQEWFRVSSRKSSSPAVVASYLHEVQPHSPHFLKLLVNLADHNGNTALHYSVSHSNFSIVKLLLETGVCNVDHQNKAGYTAVMITPLASAETNEDMAVVWKLLREGNVNIQATQGGQTALMLGVSHDREDMVQALLSCQADVNLQDHDGSSALMVACHHGNVDLVRLLLAHPACDSSLTDKAGRTALSIALKSPTHMEIAGLLRAHAEQGRSLGL

SEQ ID NO: 44532 - protein, 351 aa, Homo sapiens
  Payload ID: 9072
  Gene Symbol: KANK4
  Gene Name: KN motif and ankyrin repeat domains 4
  ENSP ID: ENSP00000360192
MKKKDYGFRAGGNGTKKNLQFVGVNGGYETTSSEETSGEDSTPEDLSDSEAEKKCDGPDHKHVKDAHLTCEAGQGIPEGTCHAAQESGPGEEVPHSKAERYKPSEEFLNACRALSQHLPETGTTTDQLLRQSLNTISQEWFRVSSRKSSSPAVVASYLHEVQPHSPHFLKLLVNLADHNGNTALHYSVSHSNFSIVKLLLETGVCNVDHQNKAGYTAVMITPLASAETNEDMAVVWKLLREGNVNIQATQGGQTALMLGVSHDREDMVQALLSCQADVNLQDHDGSSALMVACHHGNVDLVRLLLAHPACDSSLTDKAGRTALSIALKSPTHMEIAGLLRAHAEQGRSLGL

SEQ ID NO: 44533 - protein, 995 aa, Homo sapiens
  Payload ID: 9072
  Gene Symbol: KANK4
  Gene Name: KN motif and ankyrin repeat domains 4
  Uniprot ID: Q5T7N3
  ENSP ID: ENSP00000360195
MEKTDAKDQSSQGDEEKDPPKSHPYSVETPYGFHLDLDFLKYVDDIEKGNTIKRIPIHRRAKQAKFSTLPRNFSLPDSGARPPAAPPLQNWSPVVPREASLGTQEQNQSPPLGNAPQASTSRSEVSYHRKALLAEATRQLEAAEPEDAELTFGSGRPQLLRASSMPATLLHSRASEEPGLSLGPPAPPALPPLQGEGSVCDGTFEPAEGLAGFHSSSPRASTRIPELVQEGAEPPEGVVKVPNHLPLPGPPFSFQNVLVVLEDKEDEHNAREAEVLFTPGSPTPSPPPLPSPIPENELLLEEIELNISEIPPPPPVEVDMRSIGIRVTEESLGLARVDPGSISSLKQQVSALEGELSGRTEELAQVRTALQQQEEEIKAREQRIRELEFTVAQLEGQFHQENAKDTQGQTDVMVNTDPVHGLLTRESCDKGIEVNLLGSMESESWGHRGEENGLLWGPDGHKQGNQSPAERVLLPQLSLPQGPEQVLTSSVHSFLSTELRIEEAGTEQEGGPQGGTRGAGGFLWGSDRKTPPAGREETSSNLPGKEHPGRPPSSPTDATIGQYVKKIQELLQEQWNCLEHGYPELASAIKQPASKLSSIQSQLLSSLNLLLSAYSAQAHPPKEPPASSSSPPVEISPSTSLKSIMKKKDYGFRAGGNGTKKNLQFVGVNGGYETTSSEETSGEDSTPEDLSDSEAEKKCDGPDHKHVKDAHLTCEAGQGIPEGTCHAAQESGPGEEVPHSKAERYKPSEEFLNACRALSQHLPETGTTTDQLLRQSLNTISQEWFRVSSRKSSSPAVVASYLHEVQPHSPHFLKLLVNLADHNGNTALHYSVSHSNFSIVKLLLETGVCNVDHQNKAGYTAVMITPLASAETNEDMAVVWKLLREGNVNIQATQGGQTALMLGVSHDREDMVQALLSCQADVNLQDHDGSSALMVACHHGNVDLVRLLLAHPACDSSLTDKAGRTALSIALKSPTHMEIAGLLRAHAEQGRSLGL

SEQ ID NO: 44534 - protein, 128 aa, Homo sapiens
  Payload ID: 9073
  Gene Symbol: KRBOX1
  Gene Name: KRAB box domain containing 1
  Uniprot ID: C9JBD0
  ENSP ID: ENSP00000373254
MMTAVSLTTRPQESVAFEDVAVYFTTKEWAIMVPAERALYRDVMLENYEAVAFVVPPTSKPALVSHLEQGKESCFTQPQGVLSRNDWRAGWIGYLELRRYTYLAKAVLRRIVSKIFRNRQCWEDRRKA

SEQ ID NO: 44535 - protein, 128 aa, Homo sapiens; identical to SEQ ID NO: 44534
  Payload ID: 9073
  Gene Symbol: KRBOX1
  Gene Name: KRAB box domain containing 1
  Uniprot ID: C9JBD0
  ENSP ID: ENSP00000388094

SEQ ID NO: 44536 - protein, 128 aa, Homo sapiens; identical to SEQ ID NO: 44534
  Payload ID: 9073
  Gene Symbol: KRBOX1
  Gene Name: KRAB box domain containing 1
  Uniprot ID: C9JBD0
  ENSP ID: ENSP00000413859

SEQ ID NO: 44537 - protein, 166 aa, Homo sapiens
  Payload ID: 9074
  Gene Symbol: KRBOX4
  Gene Name: KRAB box domain containing 4
  Uniprot ID: Q5JUW0
  ENSP ID: ENSP00000298190
MAMSQESLTFKDVFVDFTLEEWQQLDSAQKNLYRDVMLENYSHLVSVGYLVAKPDVIFRLGPGEESWMADGGTPVRTCAEVWQVDEQIDHYKESQDKLPWQAAFIGKETLKDESGQESRTCRKSIYLSTEFDSVRQRLPKYYSWEKAFKTSFKLSWSKWKLCKKER

SEQ ID NO: 44538 - protein, 171 aa, Homo sapiens
  Payload ID: 9074
  Gene Symbol: KRBOX4
  Gene Name: KRAB box domain containing 4
  Uniprot ID: Q5JUW0
  ENSP ID: ENSP00000345797
MAMSQESLTFKDVFVDFTLEEWQQLDSAQKNLYRDVMLENYSHLVSVGYLVAKPDVIFRLGPGEESWMADGGTPVRTCAGEDRPEVWQVDEQIDHYKESQDKLPWQAAFIGKETLKDESGQESRTCRKSIYLSTEFDSVRQRLPKYYSWEKAFKTSFKLSWSKWKLCKKER

SEQ ID NO: 44539 - protein, 98 aa, Homo sapiens
  Payload ID: 9074
  Gene Symbol: KRBOX4
  Gene Name: KRAB box domain containing 4
  Uniprot ID: Q5JUW0
  ENSP ID: ENSP00000367152
MAMSQESLTFKDVFVDFTLEEWQQLDSAQKNLYRDVMLENYSHLVSVGYLVAKPDVIFRLGPGEESWMADGGTPVRTCAGEDRPDVSIFASCILKCCY

SEQ ID NO: 44540 - protein, 98 aa, Homo sapiens; identical to SEQ ID NO: 44539
  Payload ID: 9074
  Gene Symbol: KRBOX4
  Gene Name: KRAB box domain containing 4
  Uniprot ID: Q5JUW0
  ENSP ID: ENSP00000418076

SEQ ID NO: 44541 - protein, 93 aa, Homo sapiens
  Payload ID: 9074
  Gene Symbol: KRBOX4
  Gene Name: KRAB box domain containing 4
  ENSP ID: ENSP00000418146
MAMSQESLTFKDVFVDFTLEEWQQLDSAQKNLYRDVMLENYSHLVSVGYLVAKPDVIFRLGPGEESWMADGGTPVRTCAGTVLQRFQLKACGI

SEQ ID NO: 44542 - protein, 131 aa, Homo sapiens
  Payload ID: 9074
  Gene Symbol: KRBOX4
  Gene Name: KRAB box domain containing 4
  ENSP ID: ENSP00000418205
MAMSQESLTFKDVFVDFTLEEWQQLDSAQKNLYRDVMLENYSHLVSVGYLVAKPDVIFRLGPGEESWMADGGTPVRTCAGEDRPGESGRGKETRLVGESLASGMCSGALLRASDLWTCLGSDEQNCCHVQM

SEQ ID NO: 44543 - protein, 1030 aa, Homo sapiens
  Payload ID: 9075
  Gene Symbol: KRBA1
  Gene Name: KRAB-A domain containing 1
  Uniprot ID: A5PL33
  ENSP ID: ENSP00000317165
MRENYETLVSVGTAELLPLSAFLSPSEPGRAVGGGSHADEGQEPAGCGDPQGGQPRHSLHLTALVQLVKEIPEFLFGEVKGAMDSPESESRGASLDGERASPEAAAAREPCPLRGLLSCLPDGPTSQPHLATTPTDSSCSSGPTGDGVQGSPLPIKTADKPWPTRKEGPGALGGEPSPPTHSPSRRKSHRGQERGTSEAGISPGNSPLQGLINCLKEILVPGPRHPETSPSFLPPLPSLGTSRLTRADLGPGSPPWAVKTEAVSGDCPLQGLLHCLKELPEAQDRHPSPSGVGNRRLQENPGAWKRGSGGPGYLLTPPPHPDLGAGGLLSVKMENSWVQSPPGPASCQPGRQPLSPSATGDTRGVPQPSWGPEAQAASASSSPLEALEACLKGIPPNGSSPSQLPPTSCSQNPQPGDSRSQKPELQPHRSHSEEATREPVLPLGLQSCVRDGPSRPLAPRGTPTSFSSSSSTDWDLDFGSPVGNQGQHPGKGSPPGSSPLQGLENCLKEIPVPVLRPAWPCSSAADRGPRRAEPRNWTADKEGLRAEACESARLGQGRGEAPTRSLHLVSPQVFTSSCVPACHQRGFKDPGATRPGVWRWLPEGSAPKPSPLHCLESALRGILPVRPLRFACVGGPSPSPSPGSSSSFSGSEGEDPRPEPDLWKPLPQERDRLPSCKPPVPLSPCPGGTPAGSSGGSPGEDPRRTEPRYCSGLGAGTAQDPCPVSQLEKRPRVSEASRGLELGHGRPRVAAKTHERLLPQGPPELPSESPPPELPPPEAAPPVLPASSLQPPCHCGKPLQQELHSLGAALAEKLDRLATALAGLAQEVATMRTQVNRLGRRPQGPGPMGQASWMWTLPRGPRWAHGPGHRHLPYWRQKGPTRPKPKILRGQGESCRAGDLQGLSRGTARRARPLPPDAPPAEPPGLHCSSSQQLLSSTPSCHAAPPAHPLLAHTGGHQSPLPPLVPAALPLQGASPPAASADADVPTSGVAPDGIPERPKEPSSLLGGVQRALQEELWGGEHRDPRWGAH

SEQ ID NO: 44544 - protein, 103 aa, Homo sapiens
  Payload ID: 9075
  Gene Symbol: KRBA1
  Gene Name: KRAB-A domain containing 1
  ENSP ID: ENSP00000417921
MRENYETLVSVGTAELLPLSAFLSPSEPGRAVGGGSHADEGQEPAGCGDPQGGQPRHSLHLTALVQLVKEIPEFLFGEVKGAMDSPESESRGASLDGERASPE

SEQ ID NO: 44545 - protein, 1064 aa, Homo sapiens
  Payload ID: 9075
  Gene Symbol: KRBA1
  Gene Name: KRAB-A domain containing 1
  ENSP ID: ENSP00000418647
MARQVSITFKDLAVRFSEEEWRLLEEGQREFYRDVMRENYETLVSVGTAELLPLSAFLSPSEPGRAVGGGSHADEGQEPAGCGDPQGGQPRHSLHLTALVQLVKEIPEFLFGEVKGAMDSPESESRGASLDGERASPEAAAREPCPLRGLLSCLPDGPTSQPHLATTPTDSSCSSGPTGDGVQGSPLPIKTADKPWPTRKEGPGALGGEPSPPTHSPSRRKSHRGQERGTSEAGISPGNSPLQGLINCLKEILVPGPRHPETSPSFLPPLPSLGTSRLTRADLGPGSPPWAVKTEAVSGDCPLQGLLHCLKELPEAQDRHPSPSGVGNRRLQENPGAWKRGSGGPGYLLTPPPHPDLGAGGLLSVKMENSWVQSPPGPASCQPGRQPLSPSATGDTRGVPQPSWGPEAQAASASSSPLEALEACLKGIPPNGSSPSQLPPTSCSQNPQPGDSRSQKPELQPHRSHSEEATREPVLPLGLQSCVRDGPSRPLAPRGTPTSFSSSSSTDWDLDFGSPVGNQGQHPGKGSPPGSSPLQGLENCLKEIPVPVLRPAWPCSSAADRGPRRAEPRNWTADKEGLRAEACESARLGQGRGEAPTRSLHLVSPQVFTSSCVPACHQRGFKDPGATRPGVWRWLPEGSAPKPSPLHCLESALRGILPVRPLRFACVGGPSPSPSPGSSSSFSGSEGEDPRPEPDLWKPLPQERDRLPSCKPPVPLSPCPGGTPAGSSGGSPGEDPRRTEPRYCSGLGAGTAQDPCPVSQLEKRPRVSEASRGLELGHGRPRVAAKTHERLLPQGPPELPSESPPPELPPPEAAPPVLPASSLQPPCHCGKPLQQELHSLGAALAEKLDRLATALAGLAQEVATMRTQVNRLGRRPQGPGPMGQASWMWTLPRGPRWAHGPGHRHLPYWRQKGPTRPKPKILRGQGESCRAGDLQGLSRGTARRARPLPPDAPPAEPPGLHCSSSQQLLSSTPSCHAAPPAHPLLAHTGGHQSPLPPLVPAALPLQGASPPAASADADVPTSGVAPDGIPERPKEPSSLLGGVQRALQEELWGGEHRDPRWGAH

SEQ ID NO: 44546 - protein, 167 aa, Homo sapiens
  Payload ID: 9075
  Gene Symbol: KRBA1
  Gene Name: KRAB-A domain containing 1
  ENSP ID: ENSP00000418841
  MOD_RES (1)..(1): Any amino acid
XRGASLDGERASPEAAAREPCPLRGLLSCLPDGPTSQPHLATTPTDSSCSSGPTGDGVQGSPLPISESDTAGTGRTSISKALIVASEDLDPVPSSFFSRTQFPCCAVLLLTKYAREQDNIFSLWCNHQRGGMMLSPWGACHPAPITEHFVHRKSPAVSNMQAHGQQH

SEQ ID NO: 44547 - protein, 35 aa, Homo sapiens
  Payload ID: 9075
  Gene Symbol: KRBA1
  Gene Name: KRAB-A domain containing 1
  ENSP ID: ENSP00000419900
MRENYETLVSVEPGRAVGGGSHADEGQEPAGCGDP

SEQ ID NO: 44548 - protein, 969 aa, Homo sapiens
  Payload ID: 9075
  Gene Symbol: KRBA1
  Gene Name: KRAB-A domain containing 1
  Uniprot ID: A5PL33
  ENSP ID: ENSP00000420112
MRENYETLVSVGTAELLPLSAFLSPSEPGRAVGGGSHADEGQEPAGCGDPQGGQPRHSLHLTALVQLVKEIPEFLFGEVKGAMDSPESESRGASLDGERASPEAAAAREPCPLRGLLSCLPDGPTSQPHLATTPTDSSCSSGPTGDGVQGSPLPIKTADKPWPTRKEGPGALGGEPSPPTHSPSRRKSHRGQERGTSEAGISPGNSPLQGLINCLKEILVPGPRHPETSPSFLPPLPSLGTSRLTRADLGPGSPPWAVKTEAVSGDCPLQGLLHCLKELPEAQDRHPSPSGVGNRRLQENPGAWKRGSGGPGYLLTPPPHPDLGAGGLLSVKMENSWVQSPPGPASCQPGRQPLSPSATGDTRGVPQPSWGPEAQAASASSSPLEALEACLKGIPPNGSSPSQLPPTSCSQNPQPGDSRSQKPELQPHRSHSEEATREPVLPLGLQSCVRDGPSRPLAPRGTPTSFSSSSSTDWDLDFGSPVGNQGQHPGKGSPPGSSPLQGLENCLKEIPVPVLRPAWPCSSAADRGPRRAEPRNWTADKEGSAPKPSPLHCLESALRGILPVRPLRFACVGGPSPSPSPGSSSSFSGSEGEDPRPEPDLWKPLPQERDRLPSCKPPVPLSPCPGGTPAGSSGGSPGEDPRRTEPRYCSGLGAGTAQDPCPVSQLEKRPRVSEASRGLELGHGRPRVAAKTHERLLPQGPPELPSESPPPELPPPEAAPPVLPASSLQPPCHCGKPLQQELHSLGAALAEKLDRLATALAGLAQEVATMRTQVNRLGRRPQGPGPMGQASWMWTLPRGPRWAHGPGHRHLPYWRQKGPTRPKPKILRGQGESCRAGDLQGLSRGTARRARPLPPDAPPAEPPGLHCSSSQQLLSSTPSCHAAPPAHPLLAHTGGHQSPLPPLVPAALPLQGASPPAASADADVPTSGVAPDGIPERPKEPSSLLGGVQRALQEELWGGEHRDPRWGAH

SEQ ID NO: 44549 - protein, 617 aa, Homo sapiens
  Payload ID: 9075
  Gene Symbol: KRBA1
  Gene Name: KRAB-A domain containing 1
  ENSP ID: ENSP00000479341
  MOD_RES (1)..(1): Any amino acid
XPAGCGDPQGGQPRHSLHLTALVQLVKEIPEFLFGEVKGAMDSPESESRGASLDGERASPEAAAREPCPLRGLLSCLPDGPTSQPHLATTPTDSSCSSGPTGDGVQGSPLPIKTADKPWPTRKEGPGALGGEPSPPTHSPSRRKSHRGQERGTSEAGISPGNSPLQGLINCLKEILVPGPRHPETSPSFLPPLPSLGTSRLTRADLGPGSPPWAVKTEAVSGDCPLQGLLHCLKELPEAQDRHPSPSGVGNRRLQENPGAWKRGSGGPGYLLTPPPHPDLGAGGLLSVKMENSWVQSPPGPASCQPGRQPLSPSATGDTRGVPQPSWGPEAQAASASSSPLEALEACLKGIPPNGSSPSQLPPTSCSQNPQPGDSRSQKPELQPHRSHSEEATREPVLPLGLQSCVRDGPSRPLAPRGTPTSFSSSSSTDWDLDFGSPVGNQGQHPGKGSPPGSSPLQGLENCLKEIPVPVLRPAWPCSSAADRGPRRAEPRNWTADKEGSAPKPSPLHCLESALRGILPVRPLRFACVGGPSPSPSPGSSSSFSGSEGEDPRPEPDLWKPLPQERDRLPSCKPPVPLSPCPGGTPAGSSGGSPGEDPRRTEPRYCSGLGAGEPGVS

SEQ ID NO: 44550 - protein, 492 aa, Homo sapiens
  Payload ID: 9076
  Gene Symbol: KRBA2
  Gene Name: KRAB-A domain containing 2
  Uniprot ID: Q6ZNG9
  ENSP ID: ENSP00000328017
MPSFLVPSLVSSPVLLKLLFSPGPKTIWSLWQQPMLFQEATAFENMTKDWNYLEGSQKDCYRDTMLDSYENTVPQGSFLQLSMMPQRAGNDPPGVSNASEMEMEISNMREKFLMSVTKLVESKSYNSKVFSKEKYFQTIKEVKEAKEKGKKSSRDYRRAAKYDVISVQGTEKLIEATHGERDRIRYYVHKEELFDILHDTHLSIGHGGRTRMLKELQGKYGNVTKEVIVLYLTLCKQCHQKNPVPKRGLAPKPMTFKDIDSTCQVEILDMQSSADGEFKFILYYQDHSTKFIILRPLRTKQAHEVVSVLLDIFTILGTPSVLDSDSGVEFTNQVVHELNELWPDLKIVSGKYHPGQSQGSLEGASRDVKNMISTWMQSNHSCHWAKGLRFMQMVRNQAFDVSLQQSPFEAMFGYKAKFGLYSSNLPRETVATLQTEEELEIAEEQLENSLWIRQEERAEIGADRSDMDDDMDPTPEASEPSTSQGTSGLLCW

SEQ ID NO: 44551 - protein, 410 aa, Homo sapiens
  Payload ID: 9076
  Gene Symbol: KRBA2
  Gene Name: KRAB-A domain containing 2
  ENSP ID: ENSP00000379565
MMPQRAGNDPPGVSNASEMEMEISNMREKFLMSVTKLVESKSYNSKVFSKEKYFQTIKEVKEAKEKGKKSSRDYRRAAKYDVISVQGTEKLIEATHGERDRIRYYVHKEELFDILHDTHLSIGHGGRTRMLKELQGKYGNVTKEVIVLYLTLCKQCHQKNPVPKRGLAPKPMTFKDIDSTCQVEILDMQSSADGEFKFILYYQDHSTKFIILRPLRTKQAHEVVSVLLDIFTILGTPSVLDSDSGVEFTNQVVHELNELWPDLKIVSGKYHPGQSQGSLEGASRDVKNMISTWMQSNHSCHWAKGLRFMQMVRNQAFDVSLQQSPFEAMFGYKAKFGLYSSNLPRETVATLQTEEELEIAEEQLENSLWIRQEERAEIGADRSDMDDDMDPTPEASEPSTSQGTSGLLCW

SEQ ID NO: 44552 - protein, 709 aa, Homo sapiens
  Payload ID: 9077
  Gene Symbol: KRI1
  Gene Name: KRI1 homolog
  Uniprot ID: Q8N9T8
  ENSP ID: ENSP00000320917
MGHRTAMPEPRGSSQLRVNAAFAARYNRYREREELQRLKDRYGDRDSSSDSSSESDSSDERVEFDPQQERDFYKTLSLLKKKDPRIYQKDATFYNRTASSSDSEEDPEALEKQKKVRPMYLKDYERKVILEKAGKYVDEENSDGETSNHRLQETSSQSYVEEQKQLKESFRAFVEDSEDEDGAGEGGSSLLQKRAKTRQEKAQEEADYIEWLKGQKEIRNPDSLKELTHLKEYWNDPELDEGERFLRDYILNKRYEEEEEEEEDEEEMEEEEGVHGPPVQLAVDDSSDEGELFLKKQEDFEQKYNFRFEEPDSASVKTYPRSIASSVRRKDERRKEKREETRERKKREKAKKQEELKQLKNLKRKEILAKLEKLRKVTGNEMLGLEEGDLEDDFDPAQHDQLMQKCFGDEYYGAVEEEKPQFEEEEGLEDDWNWDTWDGPEQEGDWSQQELHCEDPNFNMDADYDPSQPRKKKREAPLTGKKKRKSPFAAAVGQEKPVFEPGDKTFEEYLDEYYRLDYEDIIDDLPCRFKYRTVVPCDFGLSTEEILAADDKELNRWCSLKKTCMYRSEQEELRDKRAYSQKAQNSWKKRQVFKSLCREEAETPAEATGKPQRDEAGPQRQLPALDGSLMGPESPPAQEEEAPVSPHKKPAPQKRRRAKKARLLGPTVMLGGCEFSRQRLQAFGLNPKRLHFRQLGRQRRKQQGPKNSS

SEQ ID NO: 44553 - protein, 197 aa, Homo sapiens
  Payload ID: 9077
  Gene Symbol: KRI1
  Gene Name: KRI1 homolog
  ENSP ID: ENSP00000412919
MYLKDYERKVILEKAGKYVDEENSDGETSNHRLQETSSQSYVEEQKQLKESFRAFVEDSEDEDGAGEGGSSLLQKRAKTRQEKAQEEADYIEWLKGQKEIRNPDSLKELTHLKEYWNDPELDEGERFLRDYILNKRYEEEEEEEEDEEEMEEEEGVHGPPVQLAVDDSSDEGELFLKKQEDFEQKYNFRFEEPDSAS

SEQ ID NO: 44554 - protein, 190 aa, Homo sapiens
  Payload ID: 9077
  Gene Symbol: KRI1
  Gene Name: KRI1 homolog
  ENSP ID: ENSP00000438000
  MOD_RES (1)..(1): Any amino acid
XRTAMPEPRGSSQLRVNAAFAARYNRYREREELQRPSSSDSEEDPEALEKQKKVRPMYLKDYERKVILEKAGKYVDEENSDGETSNHRLQETSSQSYVEEQKQLKESFRAFVEDSEDEDGAGEGGSSLLQKRAKTRQEKAQEEADYIEWLKGQKEIRNPDSLKELTHLKEYWNDPELDEGERFLRDYILN

SEQ ID NO: 44555 - protein, 112 aa, Homo sapiens
  Payload ID: 9077
  Gene Symbol: KRI1
  Gene Name: KRI1 homolog
  ENSP ID: ENSP00000442213
RTAMPEPRGSSQLRVNAAFAARYNRYREREELQRLKDRYGDRDSSSDSSSESDSSDERVEFDPQQERDFYKTLSLLKKKDPRIYQKDATFYNRTVRRTQKPWRSRRKCGPCT

SEQ ID NO: 44556 - protein, 194 aa, Homo sapiens
  Payload ID: 9077
  Gene Symbol: KRI1
  Gene Name: KRI1 homolog
  ENSP ID: ENSP00000445789
PRGSSQLRVNAAFAARYNRYREREELQRLKDRYGDRDSSSDSSSESDSSDERVEFDPQQERDFYKTLSLLKKKDPRIYQKDATFYNRTASSSDSEEDPEALEKQKKVRPMYLKDYERKVILEKAGKYVDEENSDGETSNHRLQEKPVFEPGDKTFEEYLDEYYRLDYEDIIDDLPCRFKYRTVVPCDFGLSTEE

SEQ ID NO: 44557 - protein, 492 aa, Homo sapiens
  Payload ID: 9078
  Gene Symbol: KREMEN1
  Gene Name: kringle containing transmembrane protein 1
  Uniprot ID: Q96MU8
  ENSP ID: ENSP00000331242
MAPPAARLALLSAAALTLAARPAPSPGLGPGPECFTANGADYRGTQNWTALQGGKPCLFWNETFQHPYNTLKYPNGEGGLGEHNYCRNPDGDVSPWCYVAEHEDGVYWKYCEIPACQMPGNLGCYKDHGNPPPLTGTSKTSNKLTIQTCISFCRSQRFKFAGMESGYACFCGNNPDYWKYGEAASTECNSVCFGDHTQPCGGDGRIILFDTLVGACGGNYSAMSSVVYSPDFPDTYATGRVCYWTIRVPGASHIHFSFPLFDIRDSADMVELLDGYTHRVLARFHGRSRPPLSFNVSLDFVILYFFSDRINQAQGFAVLYQAVKEELPQERPAVNQTVAEVITEQANLSVSAARSSKVLYVITTSPSHPPQTVPGSNSWAPPMGAGSHRVEGWTVYGLATLLILTVTAIVAKILLHVTFKSHRVPASGDLRDCHQPGTSGEIWSIFYKPSTSISIFKKKLKGQSQQDDRNPLAIQDSEVTSLIWSQGQPRSI

SEQ ID NO: 44558 - protein, 458 aa, Homo sapiens
  Payload ID: 9078
  Gene Symbol: KREMEN1
  Gene Name: kringle containing transmembrane protein 1
  Uniprot ID: Q96MU8
  ENSP ID: ENSP00000383189
MAPPAARLALLSAAALTLAARPAPSPGLGPGPECFTANGADYRGTQNWTALQGGKPCLFWNETFQHPYNTLKYPNGEGGLGEHNYCRNPDGDVSPWCYVAEHEDGVYWKYCEIPACQMPGNLGCYKDHGNPPPLTGTSKTSNKLTIQTCISFCRSQRFKFAGMESGYACFCGNNPDYWKYGEAASTECNSVCFGDHTQPCGGDGRIILFDTLVGACGGNYSAMSSVVYSPDFPDTYATGRVCYWTIRVPGASHIHFSFPLFDIRDSADMVELLDGYTHRVLARFHGRSRPPLSFNVSLDFVILYFFSDRINQAQGFAVLYQAVKEELPQERPAVNQTVAEVITEQANLSVSAARSSKVLYVITTSPSHPPQTVPGWTVYGLATLLILTVTAIVAKILLHVTFKSHRVPASGDLRDCHQPGTSGEIWSIFYKPSTSISIFKKKLKGQSQQDDRNPLVSD

SEQ ID NO: 44559 - protein, 473 aa, Homo sapiens
  Payload ID: 9078
  Gene Symbol: KREMEN1
  Gene Name: kringle containing transmembrane protein 1
  Uniprot ID: Q96MU8
  ENSP ID: ENSP00000385431
MAPPAARLALLSAAALTLAARPAPSPGLGPECFTANGADYRGTQNWTALQGGKPCLFWNETFQHPYNTLKYPNGEGGLGEHNYCRNPDGDVSPWCYVAEHEDGVYWKYCEIPACQMPGNLGCYKDHGNPPPLTGTSKTSNKLTIQTCISFCRSQRFKFAGMESGYACFCGNNPDYWKYGEAASTECNSVCFGDHTQPCGGDGRIILFDTLVGACGGNYSAMSSVVYSPDFPDTYATGRVCYWTIRVPGASHIHFSFPLFDIRDSADMVELLDGYTHRVLARFHGRSRPPLSFNVSLDFVILYFFSDRINQAQGFAVLYQAVKEELPQERPAVNQTVAEVITEQANLSVSAARSSKVLYVITTSPSHPPQTVPGSNSWAPPMGAGSHRVEGWTVYGLATLLILTVTAIVAKILLHVTFKSHRVPASGDLRDCHQPGTSGEIWSIFYKPSTSISIFKKKLKGQSQQDDRNPLVSD

SEQ ID NO: 44560 - protein, 82 aa, Homo sapiens
  Payload ID: 9078
  Gene Symbol: KREMEN1
  Gene Name: kringle containing transmembrane protein 1
  ENSP ID: ENSP00000388228
  MOD_RES (1)..(1): Any amino acid
XQTCISFCRSQRFKFAGMESGYACFCGNNPDYWKYGEAASTECNSVCFGDHTQPCGGDGRIILFDRTRRTWWSFWMATPTVS

SEQ ID NO: 44561 - protein, 462 aa, Homo sapiens
  Payload ID: 9079
  Gene Symbol: KREMEN2
  Gene Name: kringle containing transmembrane protein 2
  Uniprot ID: Q8NCW0
  ENSP ID: ENSP00000304422
MGTQALQGFLFLLFLPLLQPRGASAGSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLAGVEAGYACFCGSESDLARGRLAPATDCDQICFGHPGQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAAIGARVFSTVTAVSVLLLLLLGLLRPLRRRSCLLAPGKGPPALGASRGPRRSWAVWYQQPRGVALPCSPGDPQAEGSAAGYRPLSASSQSSLRSLISAL

SEQ ID NO: 44562 - protein, 420 aa, Homo sapiens
  Payload ID: 9079
  Gene Symbol: KREMEN2
  Gene Name: kringle containing transmembrane protein 2
  Uniprot ID: Q8NCW0
  ENSP ID: ENSP00000322079
MGTQALQGFLFLLFLPLLQPRGASAGSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLAGVEAGYACFCGSESDLARGRLAPATDCDQICFGHPGQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAAIGGAVCWLREKGPRRWGLPGAPGEAGLCGTNSPEGWPCPAPPGTPRLRVLPRATGL

SEQ ID NO: 44563 - protein, 381 aa, Homo sapiens
  Payload ID: 9079
  Gene Symbol: KREMEN2
  Gene Name: kringle containing transmembrane protein 2
  Uniprot ID: Q8NCW0
  ENSP ID: ENSP00000459878
MGTQALQGFLFLLFLPLLQPRGASAGSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAAIGGAVCWLREKGPRRWGLPGAPGEAGLCGTNSPEGWPCPAPPGTPRLRVLPRATGL

SEQ ID NO: 44564 - protein, 399 aa, Homo sapiens
  Payload ID: 9079
  Gene Symbol: KREMEN2
  Gene Name: kringle containing transmembrane protein 2
  Uniprot ID: Q8NCW0
  ENSP ID: ENSP00000460578
MGTQALQGFLFLLFLPLLQPRGASAGSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLAGVEAGYACFCGSESDLARGRLAPATDCDQICFGHPGQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAAIGGEAGARDGSESGSRPLAPILTAAVCPQPGSSRR

SEQ ID NO: 44565 - protein, 424 aa, Homo sapiens
  Payload ID: 9079
  Gene Symbol: KREMEN2
  Gene Name: kringle containing transmembrane protein 2
  Uniprot ID: Q8NCW0
  ENSP ID: ENSP00000460917
MGTQALQGFLFLLFLPLLQPRGASAGSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLAGVEAGYACFCGSESDLARGRLAPATDCDQICFGHPGQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAAIGARVFSTVTAVSVLLLLLLGLLRPLRRRCGALGQGLRADRWWGAGAPEGNRARKELLGS

SEQ ID NO: 44566 - protein, 423 aa, Homo sapiens
  Payload ID: 9079
  Gene Symbol: KREMEN2
  Gene Name: kringle containing transmembrane protein 2
  Uniprot ID: Q8NCW0
  ENSP ID: ENSP00000461860
MGTQALQGFLFLLFLPLLQPRGASAGSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAAIGARVFSTVTAVSVLLLLLLGLLRPLRRRSCLLAPGKGPPALGASRGPRRSWAVWYQQPRGVALPCSPGDPQAEGSAAGYRPLSASSQSSLRSLISAL

SEQ ID NO: 44567 - protein, 736 aa, Homo sapiens
  Payload ID: 9080
  Gene Symbol: KRIT1
  Gene Name: KRIT1, ankyrin repeat containing
  Uniprot ID: O00522
  ENSP ID: ENSP00000344668
MGNPENIEDAYVAVIRPKNTASLNSREYRAKSYEILLHEVPIEGQKKKRKKVLLETKLQGNSEITQGILDYVVETTKPISPANQGIRGKRVVLMKKFPLDGEKMGREASLFIVPSVVKDNTKYTYTPGCPIFYCLQDIMRVCSESSTHFATLTARMLIALDKWLDERHAQSHFIPALFRPSPLERIKTNVINPAYATESGQTENSLHMGYSALEIKSKMLALEKADTCIYNPLFGSDLQYTNRVDKVVINPYFGLGAPDYSKIQIPKQEKWQRSMSSVTEDKERQWVDDFPLHRSACEGDSELLSRLLSERFSVNQLDSDHWAPIHYACWYGKVEATRILLEKGKCNPNLLNGQLSSPLHFAAGGGHAEIVQILLNHPETDRHITDQQGRSPLNICEENKQNNWEEAAKLLKEAINKPYEKVRIYRMDGSYRSVELKHGNNTTVQQIMEGMRLSQETQQYFTIWICSENLSLQLKPYHKPLQHVRDWPEILAELTNLDPQRETPQLFLRRDVRLPLEVEKQIEDPLAILILFDEARYNLLKGFYTAPDAKLITLASLLLQIVYGNYESKKHKQGFLNEENLKSIVPVTKLKSKAPHWTNRILHEYKNLSTSEGVSKEMHHLQRMFLQNCWEIPTYGAAFFTGQIFTKASPSNHKVIPVYVGVNIKGLHLLNMETKALLISLKYGCFMWQLGDTDTCFQIHSMENKMSFIVHTKQAGLVVKLLMKLNGQLMPTERNS

SEQ ID NO: 44568 - protein, 688 aa, Homo sapiens
  Payload ID: 9080
  Gene Symbol: KRIT1
  Gene Name: KRIT1, ankyrin repeat containing
  Uniprot ID: O00522
  ENSP ID: ENSP00000378011
MGNPENIEDAYVAVIRPKNTASLNSREYRAKSYEILLHEVPIEGQKKKRKKVLLETKLQGNSEITQGILDYVVETTKPISPANQGIRGKRVVLMKKFPLDGEKMGREASLFIVPSVVKDNTKYTYTPGCPIFYCLQDIMRVCSESSTHFATLTARMLIALDKWLDERHAQSHFIPALFRPSPLERIKTNVINPAYATESGQTENSLHMGYSALEIKSKMLALEKADTCIYNPLFGSDLQYTNRVDKVVINPYFGLGAPDYSKIQIPKQEKWQRSMSSVTEDKYGKVEATRILLEKGKCNPNLLNGQLSSPLHFAAGGGHAEIVQILLNHPETDRHITDQQGRSPLNICEENKQNNWEEAAKLLKEAINKPYEKVRIYRMDGSYRSVELKHGNNTTVQQIMEGMRLSQETQQYFTIWICSENLSLQLKPYHKPLQHVRDWPEILAELTNLDPQRETPQLFLRRDVRLPLEVEKQIEDPLAILILFDEARYNLLKGFYTAPDAKLITLASLLLQIVYGNYESKKHKQGFLNEENLKSIVPVTKLKSKAPHWTNRILHEYKNLSTSEGVSKEMHHLQRMFLQNCWEIPTYGAAFFTGQIFTKASPSNHKVIPVYVGVNIKGLHLLNMETKALLISLKYGCFMWQLGDTDTCFQIHSMENKMSFIVHTKQAGLVVKLLMKLNGQLMPTERNS

SEQ ID NO: 44569 - protein, 736 aa, Homo sapiens; identical to SEQ ID NO: 44567
  Payload ID: 9080
  Gene Symbol: KRIT1
  Gene Name: KRIT1, ankyrin repeat containing
  Uniprot ID: O00522
  ENSP ID: ENSP00000378013

SEQ ID NO: 44570 - protein, 736 aa, Homo sapiens; identical to SEQ ID NO: 44567
  Payload ID: 9080
  Gene Symbol: KRIT1
  Gene Name: KRIT1, ankyrin repeat containing
  Uniprot ID: O00522
  ENSP ID: ENSP00000378015

SEQ ID NO: 44571 - protein, 34 aa, Homo sapiens
  Payload ID: 9080
  Gene Symbol: KRIT1
  Gene Name: KRIT1, ankyrin repeat containing
  ENSP ID: ENSP00000388076
MGNPENIEDAYVAVIRPKNTASLNSREYRAKSYE

SEQ ID NO: 44572 - protein, 97 aa, Homo sapiens
  Payload ID: 9080
  Gene Symbol: KRIT1
  Gene Name: KRIT1, ankyrin repeat containing
  ENSP ID: ENSP00000391540
MGNPENIEDAYVAVIRPKNTASLNSREYRAKSYEILLHEVPIEGQKKKRKKVLLETKLQGNSEITQGILDYVVETTKPISPANQGIRGKRVVLMKKF

SEQ ID NO: 44573 - protein, 243 aa, Homo sapiens
  Payload ID: 9080
  Gene Symbol: KRIT1
  Gene Name: KRIT1, ankyrin repeat containing
  ENSP ID: ENSP00000391675
MGNPENIEDAYVAVIRPKNTASLNSREYRAKSYEILLHEVPIEGQKKKRKKVLLETKLQGNSEITQGILDYVVETTKPISPANQGIRGKRVVLMKKFPLDGEKMGREASLFIVPSVVKDNTKYTYTPGCPIFYCLQDIMRVCSESSTHFATLTARMLIALDKWLDERHAQSHFIPALFRPSPLERIKTNVINPAYATESGQTENSLHMGYSALEIKSKMLALEKADTCIYNPLFGSDLQYTNR

SEQ ID NO: 44574 - protein, 58 aa, Homo sapiens
  Payload ID: 9080
  Gene Symbol: KRIT1
  Gene Name: KRIT1, ankyrin repeat containing
  ENSP ID: ENSP00000395346
MGNPENIEDAYVAVIRPKNTASLNSREYRAKSYEILLHEVPIEGQKKKRKKVLLETKL

SEQ ID NO: 44575 - protein, 25 aa, Homo sapiens
  Payload ID: 9080
  Gene Symbol: KRIT1
  Gene Name: KRIT1, ankyrin repeat containing
  ENSP ID: ENSP00000395604
MGNPENIEDAYVAVIRPKNTASLNS

SEQ ID NO: 44576 - protein, 112 aa, Homo sapiens
  Payload ID: 9080
  Gene Symbol: KRIT1
  Gene Name: KRIT1, ankyrin repeat containing
  ENSP ID: ENSP00000396042
MGNPENIEDAYVAVIRPKNTASLNSREYRAKSYEILLHEVPIEGQKKKRKKVLLETKLQGNSEITQGILDYVVETTKPISPANQGIRGKRVVLMKKFPLDGEKMGREASLFI

SEQ ID NO: 44577 - protein, 65 aa, Homo sapiens
  Payload ID: 9080
  Gene Symbol: KRIT1
  Gene Name: KRIT1, ankyrin repeat containing
  ENSP ID: ENSP00000396352
MGNPENIEDAYVAVIRPKNTASLNSREYRAKSYEILLHEVPIEGQKKKRKKVLLETKLQGNSEIT

SEQ ID NO: 44578 - protein, 164 aa, Homo sapiens
  Payload ID: 9080
  Gene Symbol: KRIT1
  Gene Name: KRIT1, ankyrin repeat containing
  ENSP ID: ENSP00000404084
MLLNQVDKVVINPYFGLGAPDYSKIQIPKQEKWQRSMSSVTEDKERQWVDDFPLHRSACEGDSELLSRLLSERFSVNQLDSDHWAPIHYACWYGKVEATRILLEKGKCNPNLLNGQLSSPLHFAAGGGHAEIVQILLNHPETDRHITDQQGRSPLNICEENKQN

SEQ ID NO: 44579 - protein, 11 aa, Homo sapiens
  Payload ID: 9080
  Gene Symbol: KRIT1
  Gene Name: KRIT1, ankyrin repeat containing
  ENSP ID: ENSP00000404790
MGNPENIEDAY

SEQ ID NO: 44580 - protein, 162 aa, Homo sapiens
  Payload ID: 9080
  Gene Symbol: KRIT1
  Gene Name: KRIT1, ankyrin repeat containing
  ENSP ID: ENSP00000405835
MGNPENIEDAYVAVIRPKNTASLNSREYRAKSYEILLHEVPIEGQKKKRKKVLLETKLQGNSEITQGILDYVVETTKPISPANQGIRGKRVVLMKKFPLDGEKMGREASLFIVPSVVKDNTKYTYTPGCPIFYCLQDIMRVCSESSTHFATLTARMLIALDK

SEQ ID NO: 44581 - protein, 184 aa, Homo sapiens
  Payload ID: 9080
  Gene Symbol: KRIT1
  Gene Name: KRIT1, ankyrin repeat containing
  ENSP ID: ENSP00000410104
MGNPENIEDAYVAVIRPKNTASLNSREYRAKSYEILLHEVPIEGQKKKRKKVLLETKLQGNSEITQGILDYVVETTKPISPANQGIRGKRVVLMKKFPLDGEKMGREASLFIVPSVVKDNTKYTYTPGCPIFYCLQDIMRVCSESSTHFATLTARMLIALDKWLDERHAQSHFIPALFRPSPLE

SEQ ID NO: 44582 - protein, 69 aa, Homo sapiens
  Payload ID: 9080
  Gene Symbol: KRIT1
  Gene Name: KRIT1, ankyrin repeat containing
  ENSP ID: ENSP00000410467
MGNPENIEDAYVAVIRPKNTASLNSREYRAKSYEILLHEVPIEGQKKKRKKVLLETKLQGNSEITQGIL

SEQ ID NO: 44583 - protein, 736 aa, Homo sapiens; identical to SEQ ID NO: 44567
  Payload ID: 9080
  Gene Symbol: KRIT1
  Gene Name: KRIT1, ankyrin repeat containing
  Uniprot ID: O00522
  ENSP ID: ENSP00000410909

SEQ ID NO: 44584 - protein, 38 aa, Homo sapiens
  Payload ID: 9080
  Gene Symbol: KRIT1
  Gene Name: KRIT1, ankyrin repeat containing
  ENSP ID: ENSP00000414694
MGNPENIEDAYVAVIRPKNTASLNSREYRAKSYEILLH

SEQ ID NO: 44585 - protein, 565 aa, Homo sapiens
  Payload ID: 9080
  Gene Symbol: KRIT1
  Gene Name: KRIT1, ankyrin repeat containing
  ENSP ID: ENSP00000478777
MGNPENIEDAYVAVIRPKNTASLNSREYRAKSYEILLHEVPIEGQKKKRKKVLLETKLQGNSEITQGILDYVVETTKPISPANQGIRGKRVVLMKKFPLDGEKMGREASLFIVPSVVKDNTKYTYTPGCPIFYCLQDIMRVCSESSTHFATLTARMLIALDKWLDERHAQSHFIPALFRPSPLERIKTNVINPAYATESGQTENSLHMGYSALEIKSKMLALEKADTCIYNPLFGSDLQYTNRVDKVVINPYFGLGAPDYSKIQIPKQEKWQRSMSSVTEDKERQWVDDFPLHRSACEGDSELLSRLLSERFSVNQLDSDHWAPIHYACWYGKVEATRILLEKGKCNPNLLNGQLSSPLHFAAGGGHAEIVQILLNHPETDRHITDQQGRSPLNICEENKQNNWEEAAKLLKEAINKPYEKVRIYRMDGSYRSVELKHGNNTTVQQIMEGMRLSQETQQYFTIWICSENLSLQLKPYHKPLQHVRDWPEILAELTNLDPQRETPQLFLRRDVRLPLEVEKQIEDPLAILILFDEARYNLLKGFYTAPDAKLITLASLLLQSLWKL

SEQ ID NO: 44586 - protein, 381 aa, Homo sapiens
  Payload ID: 9081
  Gene Symbol: KRR1
  Gene Name: KRR1, small subunit (SSU) processome component, homolog (yeast)
  Uniprot ID: Q13601
  ENSP ID: ENSP00000229214
MASPSLERPEKGAGKSEFRNQKPKPENQDESELLTVPDGWKEPAFSKEDNPRGLLEESSFATLFPKYREAYLKECWPLVQKALNEHHVNATLDLIEGSMTVCTTKKTFDPYIIIRARDLIKLLARSVSFEQAVRILQDDVACDIIKIGSLVRNKERFVKRRQRLIGPKGSTLKALELLTNCYIMVQGNTVSAIGPFSGLKEVRKVVLDTMKNIHPIYNIKSLMIKRELAKDSELRSQSWERFLPQFKHKNVNKRKEPKKKTVKKEYTPFPPPQPESQIDKELASGEYFLKANQKKRQKMEAIKAKQAEAISKRQEERNKAFIPPKEKPIVKPKEASTETKIDVASIKEKVKKAKNKKLGALTAEEIALKMEADEKKKKKKK

SEQ ID NO: 44587 - protein, 324 aa, Homo sapiens
  Payload ID: 9081
  Gene Symbol: KRR1
  Gene Name: KRR1, small subunit (SSU) processome component, homolog (yeast)
  Uniprot ID: Q13601
  ENSP ID: ENSP00000411740
MASPSLERPEKGAGKSEFRNQKPKPENQDESELLTVPDGWKEPAFSKEDNPRGLLEESSFATLFPKYREAYLKECWPLVQKALNEHHVNATLDLIEGSMTVCTTKKTFDPYIIIRARDLIKLLARSVSFEQAVRILQDDVACDIIKIGSLVRNKERFVKRRQRLIGPKGSTLKALELLTNCYIMVQGNTVSAIGPFSGLKEVRKVVLDTMKNIHPIYNIKIDKELASGEYFLKANQKKRQKMEAIKAKQAEAISKRQEERNKAFIPPKEKPIVKPKEASTETKIDVASIKEKVKKAKNKKLGALTAEEIALKMEADEKKKKKKK

SEQ ID NO: 44588 - protein, 288 aa, Homo sapiens
  Payload ID: 9081
  Gene Symbol: KRR1
  Gene Name: KRR1, small subunit (SSU) processome component, homolog (yeast)
  ENSP ID: ENSP00000482557
MASPSLERPEKGAGKSEFRNQKPKPENQDESELLTVPDGWKEPAFSKEDNPRGLLEESSFATLFPKYREAYLKECWPLVQKALNEHHVNATLDLIEGSMTVCTTKKTFDPYIIIRARDLIKLLARSVSFEQAVRILQDDVACDIIKIGSLVRNKERFVKRRQRLIGPKGSTLKALELLTNCYIMVQGNTVSAIGPFSGLKEVRKVVLDTMKNIHPIYNIKSLMIKRELAKDSELRSQSWERFLPQFKHKNVNKRKEPKKKTVKKNIRHSHHHNQKVRSIKNWLVVNTF

SEQ ID NO: 44589 - protein, 362 aa, Homo sapiens
  Payload ID: 9082
  Gene Symbol: KLF1
  Gene Name: Kruppel-like factor 1 (erythroid)
  Uniprot ID: Q13351
  ENSP ID: ENSP00000264834
MATAETALPSISTLTALGPFPDTQDDFLKWWRSEEAQDMGPGPPDPTEPPLHVKSEDQPGEEEDDERGADATWDLDLLLTNFSGPEPGGAPQTCALAPSEASGAQYPPPPETLGAYAGGPGLVAGLLGSEDHSGWVRPALRARAPDAFVGPALAPAPAPEPKALALQPVYPGPGAGSSGGYFPRTGLSVPAASGAPYGLLSGYPAMYPAPQYQGHFQLFRGLQGPAPGPATSPSFLSCLGPGTVGTGLGGTAEDPGVIAETAPSKRGRRSWARKRQAAHTCAHPGCGKSYTKSSHLKAHLRTHTGEKPYACTWEGCGWRFARSDELTRHYRKHTGQRPFRCQLCPRAFSRSDHLALHMKRHL

SEQ ID NO: 44590 - protein, 480 aa, Homo sapiens
  Payload ID: 9083
  Gene Symbol: KLF10
  Gene Name: Kruppel-like factor 10
  Uniprot ID: Q13118
  ENSP ID: ENSP00000285407
MLNFGASLQQTAEERMEMISERPKESMYSWNKTAEKSDFEAVEALMSMSCSWKSDFKKYVENRPVTPVSDLSEEENLLPGTPDFHTIPAFCLTPPYSPSDFEPSQVSNLMAPAPSTVHFKSLSDTAKPHIAAPFKEEEKSPVSAPKLPKAQATSVIRHTADAQLCNHQTCPMKAASILNYQNNSFRRRTHLNVEAARKNIPCAAVSPNRSKCERNTVADVDEKASAALYDFSVPSSETVICRSQPAPVSPQQKSVLVSPPAVSAGGVPPMPVICQMVPLPANNPVVTTVVPSTPPSQPPAVCPPVVFMGTQVPKGAVMFVVPQPVVQSSKPPVVSPNGTRLSPIAPAPGFSPSAAKVTPQIDSSRIRSHICSHPGCGKTYFKSSHLKAHTRTHTGEKPFSCSWKGCERRFARSDELSRHRRTHTGEKKFACPMCDRRFMRSDHLTKHARRHLSAKKLPNWQMEVSKLNDIALPPTPAPTQ

SEQ ID NO: 44591 - protein, 469 aa, Homo sapiens
  Payload ID: 9083
  Gene Symbol: KLF10
  Gene Name: Kruppel-like factor 10
  Uniprot ID: Q13118
  ENSP ID: ENSP00000379222
MEERMEMISERPKESMYSWNKTAEKSDFEAVEALMSMSCSWKSDFKKYVENRPVTPVSDLSEEENLLPGTPDFHTIPAFCLTPPYSPSDFEPSQVSNLMAPAPSTVHFKSLSDTAKPHIAAPFKEEEKSPVSAPKLPKAQATSVIRHTADAQLCNHQTCPMKAASILNYQNNSFRRRTHLNVEAARKNIPCAAVSPNRSKCERNTVADVDEKASAALYDFSVPSSETVICRSQPAPVSPQQKSVLVSPPAVSAGGVPPMPVICQMVPLPANNPVVTTVVPSTPPSQPPAVCPPVVFMGTQVPKGAVMFVVPQPVVQSSKPPVVSPNGTRLSPIAPAPGFSPSAAKVTPQIDSSRIRSHICSHPGCGKTYFKSSHLKAHTRTHTGEKPFSCSWKGCERRFARSDELSRHRRTHTGEKKFACPMCDRRFMRSDHLTKHARRHLSAKKLPNWQMEVSKLNDIALPPTPAPTQ

SEQ ID NO: 44592 - protein, 512 aa, Homo sapiens
  Payload ID: 9084
  Gene Symbol: KLF11
  Gene Name: Kruppel-like factor 11
  Uniprot ID: O14901
  ENSP ID: ENSP00000307023
MHTPDFAGPDDARAVDIMDICESILERKRHDSERSTCSILEQTDMEAVEALVCMSSWGQRSQKGDLLRIRPLTPVSDSGDVTTTVHMDAATPELPKDFHSLSTLCITPPQSPDLVEPSTRTPVSPQVTDSKACTATDVLQSSAVVARALSGGAERGLLGLEPVPSSPCRAKGTSVIRHTGESPAACFPTIQTPDCRLSDSREGEEQLLGHFETLQDTHLTDSLLSTNLVSCQPCLHKSGGLLLTDKGQQAGWPGAVQTCSPKNYENDLPRKTTPLISVSVPAPPVLCQMIPVTGQSSMLPAFLKPPPQLSVGTVRPILAQAAPAPQPVFVGPAVPQGAVMLVLPQGALPPPAPCAANVMAAGNTKLLPLAPAPVFITSSQNCVPQVDFSRRRNYVCSFPGCRKTYFKSSHLKAHLRTHTGEKPFNCSWDGCDKKFARSDELSRHRRTHTGEKKFVCPVCDRRFMRSDHLTKHARRHMTTKKIPGWQAEVGKLNRIASAESPGSPLVSMPASA

SEQ ID NO: 44593 - protein, 127 aa, Homo sapiens
  Payload ID: 9084
  Gene Symbol: KLF11
  Gene Name: Kruppel-like factor 11
  ENSP ID: ENSP00000386058
MDICESILERKRHDSERSTCSILEQTDMEAVEALVCMSSWGQRSQKGDLLRIRPLTPVSDSGDVTTTVHMDAATPELPKDFHSLSTLCITPPQSPDLVEPSTRTPVSPQVTDSKACTATDVLQSSAV

SEQ ID NO: 44594 - protein, 163 aa, Homo sapiens
  Payload ID: 9084
  Gene Symbol: KLF11
  Gene Name: Kruppel-like factor 11
  ENSP ID: ENSP00000387866
MDICESILERKRHDSERSTCSILEQTDMEAVEALVCMSSWGQRSQKGDLLRIRPLTPVSDSGDVTTTVHMDAATPELPKDFHSLSTLCITPPQSPDLVEPSTRTPVSPQVTDSKACTATDVLQSSAVVARALSGGAERGLLGLEPVPSSPCRAKGTSVIRHTG

SEQ ID NO: 44595 - protein, 122 aa, Homo sapiens
  Payload ID: 9084
  Gene Symbol: KLF11
  Gene Name: Kruppel-like factor 11
  ENSP ID: ENSP00000388263
MDICESILERKRHDSERSTCSILEQTDMEAVEALVCMSSWGQRSQKGDLLRIRPLTPVSDSGDVTTTVHMDAATPELPKDFHSLSTLCITPPQSPDLVEPSTRTPVSPQVTDSKACTATDVL

SEQ ID NO: 44596 - protein, 495 aa, Homo sapiens
  Payload ID: 9084
  Gene Symbol: KLF11
  Gene Name: Kruppel-like factor 11
  Uniprot ID: O14901
  ENSP ID: ENSP00000442722
MDICESILERKRHDSERSTCSILEQTDMEAVEALVCMSSWGQRSQKGDLLRIRPLTPVSDSGDVTTTVHMDAATPELPKDFHSLSTLCITPPQSPDLVEPSTRTPVSPQVTDSKACTATDVLQSSAVVARALSGGAERGLLGLEPVPSSPCRAKGTSVIRHTGESPAACFPTIQTPDCRLSDSREGEEQLLGHFETLQDTHLTDSLLSTNLVSCQPCLHKSGGLLLTDKGQQAGWPGAVQTCSPKNYENDLPRKTTPLISVSVPAPPVLCQMIPVTGQSSMLPAFLKPPPQLSVGTVRPILAQAAPAPQPVFVGPAVPQGAVMLVLPQGALPPPAPCAANVMAAGNTKLLPLAPAPVFITSSQNCVPQVDFSRRRNYVCSFPGCRKTYFKSSHLKAHLRTHTGEKPFNCSWDGCDKKFARSDELSRHRRTHTGEKKFVCPVCDRRFMRSDHLTKHARRHMTTKKIPGWQAEVGKLNRIASAESPGSPLVSMPASA

SEQ ID NO: 44597 - protein, 495 aa, Homo sapiens; identical to SEQ ID NO: 44596
  Payload ID: 9084
  Gene Symbol: KLF11
  Gene Name: Kruppel-like factor 11
  Uniprot ID: O14901
  ENSP ID: ENSP00000444690

SEQ ID NO: 44598 - protein, 377 aa, Homo sapiens [sequence omitted]

SEQ ID NO: 44599 - protein, 402 aa, Homo sapiens
  Payload ID: 9085
  Gene Symbol: KLF12
  Gene Name: Kruppel-like factor 12
  Uniprot ID: Q9Y4X4
  ENSP ID: ENSP00000366897
MNIHMKRKTIKNINTFENRMLMLDGMPAVRVKTELLESEQGSPNVHNYPDMEAVPLLLNNVKGEPPEDSLSVDHFQTQTEPVDLSINKARTSPTAVSSSPVSMTASASSPSSTSTSSSSSSRLASSPTVITSVSSASSSSTVLTPGPLVASASGVGGQQFLHIIHPVPPSSPMNLQSNKLSHVHRIPVVVQSVPVVYTAVRSPGNVNNTIVVPLLEDGRGHGKAQMDPRGLSPRQSKSDSDDDDLPNVTLDSVNETGSTALSIARAVQEVHPSPVSRVRGNRMNNQKFPCSISPFSIESTRRQRRSESPDSRKRRIHRCDFEGCNKVYTKSSHLKAHRRTHTGEKPYKCTWEGCTWKFARSDELTRHYRKHTGVKPFKCADCDRSFSRSDHLALHRRRHMLV

SEQ ID NO: 44600 - protein, 288 aa, Homo sapiens
  Payload ID: 9086
  Gene Symbol: KLF13
  Gene Name: Kruppel-like factor 13
  Uniprot ID: Q9Y2Y9
  ENSP ID: ENSP00000302456
MAAAAYVDHFAAECLVSMSSRAVVHGPREGPESRPEGAAVAATPTLPRVEERRDGKDSASLFVVARILADLNQQAPAPAPAERREGAAARKARTPCRLPPPAPEPTSPGAEGAAAAPPSPAWSEPEPEAGLEPEREPGPAGSGEPGLRQRVRRGRSRADLESPQRKHKCHYAGCEKVYGKSSHLKAHLRTHTGERPFACSWQDCNKKFARSDELARHYRTHTGEKKFSCPICEKRFMRSDHLTKHARRHANFHPGMLQRRGGGSRTGSLSDYSRSDASSPTISPASSP

SEQ ID NO: 44601 - protein, 100 aa, Homo sapiens
  Payload ID: 9086
  Gene Symbol: KLF13
  Gene Name: Kruppel-like factor 13
  ENSP ID: ENSP00000452609
MEEPGERPFACSWQDCNKKFARSDELARHYRTHTGEKKFSCPICEKRFMRSDHLTKHARRHANFHPGMLQRRGGGSRTGSLSDYSRSDASSPTISPASSP

SEQ ID NO: 44602 - protein, 14 aa, Homo sapiens
  Payload ID: 9086
  Gene Symbol: KLF13
  Gene Name: Kruppel-like factor 13
  ENSP ID: ENSP00000452867
MRSDHLTKHARRHA

SEQ ID NO: 44603 - protein, 286 aa, Homo sapiens
  Payload ID: 9086
  Gene Symbol: KLF13
  Gene Name: Kruppel-like factor 13
  ENSP ID: ENSP00000481494
MAAAAYVDHFAAECLVSMSSRAVVHGPREGPESRPEGAAVAATPTLPRVEERRDGKDSASLFVVARILADLNQQAPAPAPAERREGAAARKARTPCRLPPPPSPPPPAPKARRAPPSPAWSEPEPEAGLEPEREPGPAGSGEPGLRQRVRRGRSRADLESPQRKHKCHYAGCEKVYGKSSHLKAHLRTHTGERPFACSWQDCNKKFARSDELARHYRTHTGEKKFSCPICEKRFMRSDHLTKHARRHANFHPGMLQRRGGGSRTGSLSDYSRSDASSPTISPASSP

SEQ ID NO: 44604 - protein, 286 aa, Homo sapiens; identical to SEQ ID NO: 44603
  Payload ID: 9086
  Gene Symbol: KLF13
  Gene Name: Kruppel-like factor 13
  ENSP ID: ENSP00000484274

SEQ ID NO: 44605 - protein, 288 aa, Homo sapiens; identical to SEQ ID NO: 44600
  Payload ID: 9086
  Gene Symbol: KLF13
  Gene Name: Kruppel-like factor 13
  Uniprot ID: Q9Y2Y9
  ENSP ID: ENSP00000484904

SEQ ID NO: 44606 - protein, 323 aa, Homo sapiens
  Payload ID: 9087
  Gene Symbol: KLF14
  Gene Name: Kruppel-like factor 14
  ENSP ID: ENSP00000463287
MSAAVACLDYFAAECLVSMSAGAVVHRRPPDPEGAGGAAGSEVGAAPPESALPGPGPPGPASVPQLPQVPAPSPGAGGAAPHLLAASVWADLRGSSGEGSWENSGEAPRASSGFSDPIPCSVQTPCSELAPASGAAAVCAPESSSDAPAVPSAPAAPGAPAASGGFSGGALGAGPAPAADQAPRRRSVTPAAKRHQCPFPGCTKAYYKSSHLKSHQRTHTGERPFSCDWLDCDKKFTRSDELARHYRTHTGEKRFSCPLCPKQFSRSDHLTKHARRHPTYHPDMIEYRGRRRTPRIDPPLTSEVESSASGSGPGPAPSFTTCL

SEQ ID NO: 44607 - protein, 416 aa, Homo sapiens
  Payload ID: 9088
  Gene Symbol: KLF15
  Gene Name: Kruppel-like factor 15
  Uniprot ID: Q9UIH9
  ENSP ID: ENSP00000296233
MVDHLLPVDENFSSPKCPVGYLGDRLVGRRAYHMLPSPVSEDDSDASSPCSCSSPDSQALCSCYGGGLGTESQDSILDFLLSQATLGSGGGSGSSIGASSGPVAWGPWRRAAAPVKGEHFCLPEFPLGDPDDVPRPFQPTLEEIEEFLEENMEPGVKEVPEGNSKDLDACSQLSAGPHKSHLHPGSSGRERCSPPPGGASAGGAQGPGGGPTPDGPIPVLLQIQPVPVKQESGTGPASPGQAPENVKVAQLLVNIQGQTFALVPQVVPSSNLNLPSKFVRIAPVPIAAKPVGSGPLGPGPAGLLMGQKFPKNPAAELIKMHKCTFPGCSKMYTKSSHLKAHLRRHTGEKPFACTWPGCGWRFSRSDELSRHRRSHSGVKPYQCPVCEKKFARSDHLSKHIKVHRFPRSSRSVRSVN

SEQ ID NO: 44608 - protein, 252 aa, Homo sapiens
  Payload ID: 9089
  Gene Symbol: KLF16
  Gene Name: Kruppel-like factor 16
  Uniprot ID: Q9BXK1
  ENSP ID: ENSP00000250916
MSAAVACVDYFAADVLMAISSGAVVHRGRPGPEGAGPAAGLDVRAARREAASPGTPGPPPPPPAASGPGPGAAAAPHLLAASILADLRGGPGAAPGGASPASSSSAASSPSSGRAPGAAPSAAAKSHRCPFPDCAKAYYKSSHLKSHLRTHTGERPFACDWQGCDKKFARSDELARHHRTHTGEKRFSCPLCSKRFTRSDHLAKHARRHPGFHPDLLRRPGARSTSPSDSLPCSLAGSPAPSPAPSPAPAGL

SEQ ID NO: 44609 - protein, 252 aa, Homo sapiens; identical to SEQ ID NO: 44608
  Payload ID: 9089
  Gene Symbol: KLF16
  Gene Name: Kruppel-like factor 16
  Uniprot ID: Q9BXK1
  ENSP ID: ENSP00000439973

SEQ ID NO: 44610 - protein, 115 aa, Homo sapiens
  Payload ID: 9089
  Gene Symbol: KLF16
  Gene Name: Kruppel-like factor 16
  ENSP ID: ENSP00000480570
MAAPAAVAGAPGAQRGERPFACDWQGCDKKFARSDELARHHRTHTGEKRFSCPLCSKRFTRSDHLAKHARRHPGFHPDLLRRPGARSTSPSDSLPCSLAGSPAPSPAPSPAPAGL

SEQ ID NO: 44611 - protein, 252 aa, Homo sapiens; identical to SEQ ID NO: 44608
  Payload ID: 9089
  Gene Symbol: KLF16
  Gene Name: Kruppel-like factor 16
  Uniprot ID: Q9BXK1
  ENSP ID: ENSP00000483701

SEQ ID NO: 44612 - protein, 389 aa, Homo sapiens
  Payload ID: 9090
  Gene Symbol: KLF17
  Gene Name: Kruppel-like factor 17
  Uniprot ID: Q5JT82
  ENSP ID: ENSP00000361373
MYGRPQAEMEQEAGELSRWQAAHQAAQDNENSAPILNMSSSSGSSGVHTSWNQGLPSIQHFPHSAEMLGSPLVSVEAPGQNVNEGGPQFSMPLPERGMSYCPQATLTPSRMIYCQRMSPPQQEMTIFSGPQLMPVGEPNIPRVARPFGGNLRMPPNGLPVSASTGIPIMSHTGNPPVPYPGLSTVPSDETLLGPTVPSTEAQAVLPSMAQMLPPQDAHDLGMPPAESQSLLVLGSQDSLVSQPDSQEGPFLPEQPGPAPQTVEKNSRPQEGTGRRGSSEARPYCCNYENCGKAYTKRSHLVSHQRKHTGERPYSCNWESCSWSFFRSDELRRHMRVHTRYRPYKCDQCSREFMRSDHLKQHQKTHRPGPSDPQANNNNGEQDSPPAAGP

SEQ ID NO: 44613 - protein, 115 aa, Homo sapiens
  Payload ID: 9090
  Gene Symbol: KLF17
  Gene Name: Kruppel-like factor 17
  ENSP ID: ENSP00000489364
MYGRPQAEMEQEAGELSRWQAAHQAAQDNENSAPILNMSSSSGSSGVHTSWNQGLPSIQHFPHSAEMLGSPLVSVEAPGQNVNEGGPQFSMPLPERARTCSTDSREELQASGRDW

SEQ ID NO: 44614 - protein, 1052 aa, Homo sapiens
  Payload ID: 9091
  Gene Symbol: KLF18
  Gene Name: Kruppel-like factor 18
  ENSP ID: ENSP00000489024
MDSSLLQAIEEIEKFFQHLSERHTEQAETPDAPEPQNCMPLTAHAEESQHESTQSKTMPPLGSTMMTSACTNIPGTVLTQDLTMHPLKALEDLSETYSMGQKVTSFDQVKHTAGSQMTDVTVTPKSSPTDCQKTTITASNMTISNESSQLNTPSSDQTLNESQIPALLGDQMKTLSDNQTLCGDQVTFSSDQTLTDGHTVTSGSDETLSGGQMTTSLDLYGGQMMTSIDNQTLCGEQMTTSSGNQAFYGRQMTTSTGNQTLCGEQMTTSTGNQALYGGQMTTSASNQTLCGEQMTTSTSNQTLCGEQVMTSTGNQALCGGQMTTSTGNQNLYGGQMMTSTGNQTLYWGQMMTSTGNQNLCGEQVMTSTGNQALCGGQMTTSTGNQNLYGGQMMTSTGNQTLYWGQMMTSTGNQNLCGEQVMTSTGNQALCGGQMTTSTGNQNLCGEQVMTSTSNQTLCGEQTTTSTSNQTLCGEQVTTSTGNQALYGGQMMTSTGNQTLYWGQMMTSTGNQNLCGEQMTTSTGNQALYGGQMTTSTSNQTLCGEQMTTPTSNQTLCGEQVTTSTGNQALYGGQITTSTSNQTLCGEQMTTSTSNQTLCGEQVTTSTGNQALYGGQMMTSTGNQALYGGQMTTSASNQTLCGEQMTTSTSNQTLCEEQVMTSTGNQALCGEQMTTSTGNQALYGGQMTTSTSNQTLCGEQTTTSTSNQTLCGEQVTTSTGNQALYGGQMMTSTGNQTLYWGQMMTSTGNQNLCGEQMTTSTGNQALYGGQMTTSTSNQTLCGEQMTTPTSNQTLCGEQVTTSTGNQALYRGQITTSTSNQTLCGEQMTTSTSNQTLCGEQVTTSTGNQALYGGQMMTSTGNQNLYGGQNMTSTDNQALYGGQMATYSGNQTLYGDQMLTLQVGNMTTLTDDHSLYGGYMMSHQFSSLPYPGFLCFSSSHLIQGQLPKQKTQSCQFWKNPEVSRPYVCTYEDCKMSYSKACHLRTHMRKHTGEKPYVCDVEGCTWKFARSDELNRHKKRHTGERPYLCSICSKNFARSDHLKQHAKVHNIRPGL

SEQ ID NO: 44615 - protein, 355 aa, Homo sapiens
  Payload ID: 9092
  Gene Symbol: KLF2
  Gene Name: Kruppel-like factor 2
  Uniprot ID: Q9Y5W3
  ENSP ID: ENSP00000248071
MALSEPILPSFSTFASPCRERGLQERWPRAEPESGGTDDDLNSVLDFILSMGLDGLGAEAAPEPPPPPPPPAFYYPEPGAPPPYSAPAGGLVSELLRPELDAPLGPALHGRFLLAPPGRLVKAEPPEADGGGGYGCAPGLTRGPRGLKREGAPGPAASCMRGPGGRPPPPPDTPPLSPDGPARLPAPGPRASFPPPFGGPGFGAPGPGLHYAPPAPPAFGLFDDAAAAAAALGLAPPAARGLLTPPASPLELLEAKPKRGRRSWPRKRTATHTCSYAGCGKTYTKSSHLKAHLRTHTGEKPYHCNWDGCGWKFARSDELTRHYRKHTGHRPFQCHLCDRAFSRSDHLALHMKRHM

SEQ ID NO: 44616 - protein, 78 aa, Homo sapiens
  Payload ID: 9092
  Gene Symbol: KLF2
  Gene Name: Kruppel-like factor 2
  ENSP ID: ENSP00000465035
MALSEPILPSFSTFASPCRERGLQEVRSPTTATGTAAAGSLRAQTSSRATTESTRATGHSSAICAIVPSRAPITWRCT

SEQ ID NO: 44617 - protein, 345 aa, Homo sapiens
  Payload ID: 9093
  Gene Symbol: KLF3
  Gene Name: Kruppel-like factor 3 (basic)
  Uniprot ID: P57682
  ENSP ID: ENSP00000261438
MLMFDPVPVKQEAMDPVSVSYPSNYMESMKPNKYGVIYSTPLPEKFFQTPEGLSHGIQMEPVDLTVNKRSSPPSAGNSPSSLKFPSSHRRASPGLSMPSSSPPIKKYSPPSPGVQPFGVPLSMPPVMAAALSRHGIRSPGILPVIQPVVVQPVPFMYTSHLQQPLMVSLSEEMENSSSSMQVPVIESYEKPISQKKIKIEPGIEPQRTDYYPEEMSPPLMNSVSPPQALLQENHPSVIVQPGKRPLPVESPDTQRKRRIHRCDYDGCNKVYTKSSHLKAHRRTHTGEKPYKCTWEGCTWKFARSDELTRHFRKHTGIKPFQCPDCDRSFSRSDHLALHRKRHMLV

SEQ ID NO: 44618 - protein, 232 aa, Homo sapiens
  Payload ID: 9093
  Gene Symbol: KLF3
  Gene Name: Kruppel-like factor 3 (basic)
  Uniprot ID: P57682
  ENSP ID: ENSP00000421252
MLMFDPVPVKQEAMDPVSVSYPSNYMESMKPNKYGVIYSTPLPEKFFQTPEGLSHGIQMEPVDLTVNKRSSPPSAGNSPSSLKFPSSHRRASPGLSMPSSSPPIKKYSPPSPGVQPFGVPLSMPPVMAAALSRHGIRSPGILPVIQPVVVQPVPFMYTSHLQQPLMVSLSEEMENSSSSMQVPVIESYEKPISQKKIKIEPGIEPQRTDYYPEEMSPPLMNSVSPPQALLQE

SEQ ID NO: 44619 - protein, 479 aa, Homo sapiens
  Payload ID: 9094
  Gene Symbol: KLF4
  Gene Name: Kruppel-like factor 4 (gut)
  Uniprot ID: O43474
  ENSP ID: ENSP00000363804
MRQPPGESDMAVSDALLPSFSTFASGPAGREKTLRQAGAPNNRWREELSHMKRLPPVLPGRPYDLAAATVATDLESGGAGAACGGSNLAPLPRRETEEFNDLLDLDFILSNSLTHPPESVAATVSSSASASSSSSPSSSGPASAPSTCSFTYPIRAGNDPGVAPGGTGGGLLYGRESAPPPTAPFNLADINDVSPSGGFVAELLRPELDPVYIPPQQPQPPGGGLMGKFVLKASLSAPGSEYGSPSVISVSKGSPDGSHPVVVAPYNGGPPRTCPKIKQEAVSSCTHLGAGPPLSNGHRPAAHDFPLGRQLPSRTTPTLGLEEVLSSRDCHPALPLPPGFHPHPGPNYPSFLPDQMQPQVPPLHYQELMPPGSCMPEEPKPKRGRRSWPRKRTATHTCDYAGCGKTYTKSSHLKAHLRTHTGEKPYHCDWDGCGWKFARSDELTRHYRKHTGHRPFQCQKCDRAFSRSDHLALHMKRHF

SEQ ID NO: 44620 - protein, 232 aa, Homo sapiens
  Payload ID: 9094
  Gene Symbol: KLF4
  Gene Name: Kruppel-like factor 4 (gut)
  ENSP ID: ENSP00000399921
MAVSDALLPSFSTFASGPAGREKTLRQAGAPNNRWREELSHMKRLPPVLPGRPYDLAAATVATDLESGGAGAACGGSNLAPLPRRETEEFNDLLDLDFILSNSLTHPPESVAATVSSSASASSSSSPSSSGPASAPSTCSFTYPIRAGNDPGVAPGGTGGGLLYGRESAPPPTAPFNLADINDVSPSGGFVAELLRPELDPVYIPPQQPQPPGGGLMGKFVLKASLSAPGSE

SEQ ID NO: 44621 - protein, 22 aa, Homo sapiens
  Payload ID: 9094
  Gene Symbol: KLF4
  Gene Name: Kruppel-like factor 4 (gut)
  ENSP ID: ENSP00000404922
MRQPPGESDMAVSDALLPSFST

SEQ ID NO: 44622 - protein, 145 aa, Homo sapiens
  Payload ID: 9094
  Gene Symbol: KLF4
  Gene Name: Kruppel-like factor 4 (gut)
  ENSP ID: ENSP00000483629
MAVSDALLPSFSTFASGPAGREKTLRQAGAPNNLMPPGSCMPEEPKPKRGRRSWPRKRTATHTCDYAGCGKTYTKSSHLKAHLRTHTGEKPYHCDWDGCGWKFARSDELTRHYRKHTGHRPFQCQKCDRAFSRSDHLALHMKRHF

SEQ ID NO: 44623 - protein, 457 aa, Homo sapiens
  Payload ID: 9095
  Gene Symbol: KLF5
  Gene Name: Kruppel-like factor 5 (intestinal)
  Uniprot ID: Q13887
  ENSP ID: ENSP00000366915
MATRVLSMSARLGPVPQPPAPQDEPVFAQLKPVLGAANPARDAALFPGEELKHAHHRPQAQPAPAQAPQPAQPPATGPRLPPEDLVQTRCEMEKYLTPQLPPVPIIPEHKKYRRDSASVVDQFFTDTEGLPYSINMNVFLPDITHLRTGLYKSQRPCVTHIKTEPVAIFSHQSETTAPPPAPTQALPEFTSIFSSHQTAAPEVNNIFIKQELPTPDLHLSVPTQQGHLYQLLNTPDLDMPSSTNQTAAMDTLNVSMSAAMAGLNTHTSAVPQTAVKQFQGMPPCTYTMPSQFLPQQATYFPPSPPSSEPGSPDRQAEMLQNLTPPPSYAATIASKLAIHNPNLPTTLPVNSQNIQPVRYNRRSNPDLEKRRIHYCDYPGCTKVYTKSSHLKAHLRTHTGEKPYKCTWEGCDWRFARSDELTRHYRKHTGAKPFQCGVCNRSFSRSDHLALHMKRHQN

SEQ ID NO: 44624 - protein, 366 aa, Homo sapiens
  Payload ID: 9095
  Gene Symbol: KLF5
  Gene Name: Kruppel-like factor 5 (intestinal)
  Uniprot ID: Q13887
  ENSP ID: ENSP00000440407
MEKYLTPQLPPVPIIPEHKKYRRDSASVVDQFFTDTEGLPYSINMNVFLPDITHLRTGLYKSQRPCVTHIKTEPVAIFSHQSETTAPPPAPTQALPEFTSIFSSHQTAAPEVNNIFIKQELPTPDLHLSVPTQQGHLYQLLNTPDLDMPSSTNQTAAMDTLNVSMSAAMAGLNTHTSAVPQTAVKQFQGMPPCTYTMPSQFLPQQATYFPPSPPSSEPGSPDRQAEMLQNLTPPPSYAATIASKLAIHNPNLPTTLPVNSQNIQPVRYNRRSNPDLEKRRIHYCDYPGCTKVYTKSSHLKAHLRTHTGEKPYKCTWEGCDWRFARSDELTRHYRKHTGAKPFQCGVCNRSFSRSDHLALHMKRHQN

SEQ ID NO: 44625 - protein, 281 aa, Homo sapiens
  Payload ID: 9096
  Gene Symbol: KLF6
  Gene Name: Kruppel-like factor 6
  Uniprot ID: Q99612
  ENSP ID: ENSP00000419079
MDVLPMCSIFQELQIVHETGYFSALPSLEEYWQQTCLELERYLQSEPCYVSASEIKFDSQEDLWTKIILAREKKEESELKISSSPPEDTLISPSFCYNLETNSLNSDVSSESSDSSEELSPTAKFTSDPIGEVLVSSGKLSSSVTSTPPSSPELSREPSQLWGCVPGELPSPGKVRSGTSGKPGDKGNGDASPDGRRRVHRCHFNGCRKVYTKSSHLKAHQRTHTGQCPRGPRRAAAGGRHCIAPALEGAGPGCTGCGQGRQILTSSDVFHQSIRSFWSSE

SEQ ID NO: 44626 - protein, 283 aa, Homo sapiens
  Payload ID: 9096
  Gene Symbol: KLF6
  Gene Name: Kruppel-like factor 6
  Uniprot ID: Q99612
  ENSP ID: ENSP00000419923
MDVLPMCSIFQELQIVHETGYFSALPSLEEYWQQTCLELERYLQSEPCYVSASEIKFDSQEDLWTKIILAREKKEESELKISSSPPEDTLISPSFCYNLETNSLNSDVSSESSDSSEELSPTAKFTSDPIGEVLVSSGKLSSSVTSTPPSSPELSREPSQLWGCVPGELPSPGKVRSGTSGKPGDKGNGDASPDGRRRVHRCHFNGCRKVYTKSSHLKAHQRTHTGEKPYRCSWEGCEWRFARSDELTRHFRKHTGAKPFKCSHCDRCFSRSDHLALHMKRHL

SEQ ID NO: 44627 - protein, 237 aa, Homo sapiens
  Payload ID: 9096
  Gene Symbol: KLF6
  Gene Name: Kruppel-like factor 6
  Uniprot ID: Q99612
  ENSP ID: ENSP00000445301
MDVLPMCSIFQELQIVHETGYFSALPSLEEYWQQTCLELERYLQSEPCYVSASEIKFDSQEDLWTKIILAREKKEESELKISSSPPEDTLISPSFCYNLETNSLNSDVSSESSDSSEELSPTAKFTSDPIGEVLVSSGKLSSSVTSTPPSSPELSREPSQLWGCVPGELPSPGKVRSGTSGKPGDKGNGDASPDGRRRVHRCHFNGCRKVYTKSSHLKAHQRTHTGVFPGLTTWPCT

SEQ ID NO: 44628 - protein, 302 aa, Homo sapiens
  Payload ID: 9097
  Gene Symbol: KLF7
  Gene Name: Kruppel-like factor 7 (ubiquitous)
  Uniprot ID: O75840
  ENSP ID: ENSP00000309570
MDVLASYSIFQELQLVHDTGYFSALPSLEETWQQTCLELERYLQTEPRRISETFGEDLDCFLHASPPPCIEESFRRLDPLLLPVEAAICEKSSAVDILLSRDKLLSETCLSLQPASSSLDSYTAVNQAQLNAVTSLTPPSSPELSRHLVKTSQTLSAVDGTVTLKLVAKKAALSSVKVGGVATAAAAVTAAGAVKSGQSDSDQGGLGAEACPENKKRVHRCQFNGCRKVYTKSSHLKAHQRTHTGEKPYKCSWEGCEWRFARSDELTRHYRKHTGAKPFKCNHCDRCFSRSDHLALHMKRHI

SEQ ID NO: 44629 - protein, 269 aa, Homo sapiens
  Payload ID: 9097
  Gene Symbol: KLF7
  Gene Name: Kruppel-like factor 7 (ubiquitous)
  Uniprot ID: O75840
  ENSP ID: ENSP00000387510
MTCLELERYLQTEPRRISETFGEDLDCFLHASPPPCIEESFRRLDPLLLPVEAAICEKSSAVDILLSRDKLLSETCLSLQPASSSLDSYTAVNQAQLNAVTSLTPPSSPELSRHLVKTSQTLSAVDGTVTLKLVAKKAALSSVKVGGVATAAAAVTAAGAVKSGQSDSDQGGLGAEACPENKKRVHRCQFNGCRKVYTKSSHLKAHQRTHTGEKPYKCSWEGCEWRFARSDELTRHYRKHTGAKPFKCNHCDRCFSRSDHLALHMKRHI

SEQ ID NO: 44630 - protein, 60 aa, Homo sapiens
  Payload ID: 9097
  Gene Symbol: KLF7
  Gene Name: Kruppel-like factor 7 (ubiquitous)
  ENSP ID: ENSP00000392015
MDVLASYSIFQELQLVHDTGYFSALPSLEETWQQTCLELERYLQTEPRRISETFGEDLDC

SEQ ID NO: 44631 - protein, 112 aa, Homo sapiens
  Payload ID: 9097
  Gene Symbol: KLF7
  Gene Name: Kruppel-like factor 7 (ubiquitous)
  Uniprot ID: O75840
  ENSP ID: ENSP00000393268
MDVLASYSIFQELQLVHDTGYFSALPSLEETWQQTCLELERYLQTEPRRISETFGEKPYKCSWEGCEWRFARSDELTRHYRKHTGAKPFKCNHCDRCFSRSDHLALHMKRHI

SEQ ID NO: 44632 - protein, 112 aa, Homo sapiens
  Payload ID: 9097
  Gene Symbol: KLF7
  Gene Name: Kruppel-like factor 7 (ubiquitous)
  ENSP ID: ENSP00000397245
MDVLASYSIFQELQLVHDTGYFSALPSLEETWQQTCLELERYLQTEPRRISETFGEDLDCFLHASPPPCIEESFRRLDPLLLPVEAAICEKSSAVDILLSRDKLLSETCLSL

SEQ ID NO: 44633 - protein, 230 aa, Homo sapiens
  Payload ID: 9097
  Gene Symbol: KLF7
  Gene Name: Kruppel-like factor 7 (ubiquitous)
  Uniprot ID: O75840
  ENSP ID: ENSP00000398572
MDVLASYSIFQELQLVHDTGYFSALPSLEETWQQTCLELERYLQTEPRRISETFGEDLDCFLHASPPPCIEESFRRLDPLLLPVEAAICEKSSAVDILLSRDKLLSETCLSLQPASSSLDSYTAVNQAQLNAVTSLTPPSSPELSRHLVKTSQTLSAVDGTVTLKLVAKKAALSSVKVRSLISAHGRDVSGVLHEAMSSRGTTGNTQVQSPSNATTATGVFPGLTILPST

SEQ ID NO: 44634 - protein, 274 aa, Homo sapiens
  Payload ID: 9097
  Gene Symbol: KLF7
  Gene Name: Kruppel-like factor 7 (ubiquitous)
  Uniprot ID: O75840
  ENSP ID: ENSP00000403284
MFPSWPTCLELERYLQTEPRRISETFGEDLDCFLHASPPPCIEESFRRLDPLLLPVEAAICEKSSAVDILLSRDKLLSETCLSLQPASSSLDSYTAVNQAQLNAVTSLTPPSSPELSRHLVKTSQTLSAVDGTVTLKLVAKKAALSSVKVGGVATAAAAVTAAGAVKSGQSDSDQGGLGAEACPENKKRVHRCQFNGCRKVYTKSSHLKAHQRTHTGEKPYKCSWEGCEWRFARSDELTRHYRKHTGAKPFKCNHCDRCFSRSDHLALHMKRHI

SEQ ID NO: 44635 - protein, 51 aa, Homo sapiens
  Payload ID: 9097
  Gene Symbol: KLF7
  Gene Name: Kruppel-like factor 7 (ubiquitous)
  ENSP ID: ENSP00000412950
MDVLASYSIFQELQLVHDTGYFSALPSLEETWQQKIIEDHLQKENTPVSYY

SEQ ID NO: 44636 - protein, 175 aa, Homo sapiens
  Payload ID: 9097
  Gene Symbol: KLF7
  Gene Name: Kruppel-like factor 7 (ubiquitous)
  ENSP ID: ENSP00000413590
MFPSWPTCLELERYLQTEPRRISETFGEDLDCFLHASPPPCIEESFRRLDPLLLPVEAAICEKSSAVDILLSRDKLLSETCLSLQPASSSLDSYTAVNQAQLNAVTSLTPPSSPELSRHLVKTSQTLSAVDGTVTLKLVAKKAALSSVKVGGVATAAAAVTAAGAVKSGQSDSDQ

SEQ ID NO: 44637 - protein, 257 aa, Homo sapiens
  Payload ID: 9098
  Gene Symbol: KLF8
  Gene Name: Kruppel-like factor 8
  Uniprot ID: O95600
  ENSP ID: ENSP00000364063
MVDMDKLINNLEVQLNSEGGSMQVFKQVTASVRNRDPPEIEYRSNMTSPTLLDANPMENPALFNDIKIEPPEELLASDFSLPQVEPVDLSFHKPKAPLQPASMLQAPIRPPKPQSSPQTLVVSTSTSDMSTSANIPTVLTPGSVLTSSQSTGSQQILHVIHTIPSVSLPNKMGGLKTIPVVVQSLPMVYTTLPADGGPAAITVPLIGGDGKNAGSVKVDPTSMSPLEIPSDSEESTIESGSSALQSLQGLQQEREAL

SEQ ID NO: 44638 - protein, 359 aa, Homo sapiens
  Payload ID: 9098
  Gene Symbol: KLF8
  Gene Name: Kruppel-like factor 8
  Uniprot ID: O95600
  ENSP ID: ENSP00000417303
MVDMDKLINNLEVQLNSEGGSMQVFKQVTASVRNRDPPEIEYRSNMTSPTLLDANPMENPALFNDIKIEPPEELLASDFSLPQVEPVDLSFHKPKAPLQPASMLQAPIRPPKPQSSPQTLVVSTSTSDMSTSANIPTVLTPGSVLTSSQSTGSQQILHVIHTIPSVSLPNKMGGLKTIPVVVQSLPMVYTTLPADGGPAAITVPLIGGDGKNAGSVKVDPTSMSPLEIPSDSEESTIESGSSALQSLQGLQQEPAAMAQMQGEESLDLKRRRIHQCDFAGCSKVYTKSSHLKAHRRIHTGEKPYKCTWDGCSWKFARSDELTRHFRKHTGIKPFRCTDCNRSFSRSDHLSLHRRRHDTM

SEQ ID NO: 44639 - protein, 228 aa, Homo sapiens
  Payload ID: 9098
  Gene Symbol: KLF8
  Gene Name: Kruppel-like factor 8
  ENSP ID: ENSP00000431911
MVDMDKLINNLEVQLNSEGGSMQVFKQVTASVRNRDPPEIEYRSNMTSPTLLDANPMENPALFNDIKIEPPEELLASDFSLPQVEPVDLSFHKPKAPLQPASMLQAPIRPPKPQSSPQTLVVSTSTSDMSTSANIPTVLTPGSVLTSSQSTGSQQILHVIHTIPSVSLPNKMGGLKTIPVVVQSLPMVYTTLPADGGPAAITVPLIGGDGKNAGSGAQRPRWMFSHLD

SEQ ID NO: 44640 - protein, 252 aa, Homo sapiens
  Payload ID: 9098
  Gene Symbol: KLF8
  Gene Name: Kruppel-like factor 8
  ENSP ID: ENSP00000489260
MSLPEDGMSSGHFRSPQLVTWSVTASVRNRDPPEIEYRSNMTSPTLLDANPMENPALFNDIKIEPPEELLASDFSLPQVEPVDLSFHKPKAPLQPASMLQAPIRPPKPQSSPQTLVVSTSTSDMSTSANIPTVLTPGSVLTSSQSTGSQQILHVIHTIPSVSLPNKMGGLKTIPVVVQSLPMVYTTLPADGGPAAITVPLIGGDGKNAGSVKVDPTSMSPLEIPSDSEESTIESGSSALQSLQGLQQEREAL

SEQ ID NO: 44641 - protein, 244 aa, Homo sapiens
  Payload ID: 9099
  Gene Symbol: KLF9
  Gene Name: Kruppel-like factor 9
  Uniprot ID: Q13886
  ENSP ID: ENSP00000366330
MSAAAYMDFVAAQCLVSISNRAAVPEHGVAPDAERLRLPEREVTKEHGDPGDTWKDYCTLVTIAKSLLDLNKYRPIQTPSVCSDSLESPDEDMGSDSDVTTESGSSPSHSPEERQDPGSAPSPLSLLHPGVAAKGKHASEKRHKCPYSGCGKVYGKSSHLKAHYRVHTGERPFPCTWPDCLKKFSRSDELTRHYRTHTGEKQFRCPLCEKRFMRSDHLTKHARRHTEFHPSMIKRSKKALANAL

SEQ ID NO: 44642 - protein, 354 aa, Homo sapiens
  Payload ID: 9100
  Gene Symbol: KTI12
  Gene Name: KTI12 chromatin associated homolog
  Uniprot ID: Q96EK9
  ENSP ID: ENSP00000360676
MPLVVFCGLPYSGKSRRAEELRVALAAEGRAVYVVDDAAVLGAEDPAVYGDSAREKALRGALRASVERRLSRHDVVILDSLNYIKGFRYELYCLARAARTPLCLVYCVRPGGPIAGPQVAGANENPGRNVSVSWRPRAEEDGRAQAAGSSVLRELHTADSVVNGSAQADVPKELEREESGAAESPALVTPDSEKSAKHGSGAFYSPELLEALTLRFEAPDSRNRWDRPLFTLVGLEEPLPLAGIRSALFENRAPPPHQSTQSQPLASGSFLHQLDQVTSQVLAGLMEAQKSAVPGDLLTLPGTTEHLRFTRPLTMAELSRLRRQFISYTKMHPNNENLPQLANMFLQYLSQSLH

SEQ ID NO: 44643 - protein, 216 aa, Homo sapiens
  Payload ID: 9101
  Gene Symbol: KCNIP1
  Gene Name: Kv channel interacting protein 1
  ENSP ID: ENSP00000329686
MGAVMGTFSSLQTKQRRPSKDKIEDELEMTMVCHRPEGLEQLEAQTNFTKRELQVLYRGFKNECPSGVVNEDTFKQIYAQFFPHGDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 44644 - protein, 225 aa, Homo sapiens
  Payload ID: 9101
  Gene Symbol: KCNIP1
  Gene Name: Kv channel interacting protein 1
  Uniprot ID: Q9NZI2
  ENSP ID: ENSP00000366577
MSGCSKRCKLGFVKFAQTIFKLITGTLSKDKIEDELEMTMVCHRPEGLEQLEAQTNFTKRELQVLYRGFKNECPSGVVNEDTFKQIYAQFFPHGDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 44645 - protein, 220 aa, Homo sapiens
  Payload ID: 9101
  Gene Symbol: KCNIP1
  Gene Name: Kv channel interacting protein 1
  ENSP ID: ENSP00000375071
KIEDELEMTMVCHRPEGLEQLEAQTNFTKRELQVLYRGFKNECPSGVVNEDTFKQIYAQFFPHGALPCLEGSPCVEFLPPSPALLFCLVDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 44646 - protein, 227 aa, Homo sapiens
  Payload ID: 9101
  Gene Symbol: KCNIP1
  Gene Name: Kv channel interacting protein 1
  Uniprot ID: Q9NZI2
  ENSP ID: ENSP00000395323
MGAVMGTFSSLQTKQRRPSKDIAWWYYQYQRDKIEDELEMTMVCHRPEGLEQLEAQTNFTKRELQVLYRGFKNECPSGVVNEDTFKQIYAQFFPHGDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 44647 - protein, 241 aa, Homo sapiens
  Payload ID: 9101
  Gene Symbol: KCNIP1
  Gene Name: Kv channel interacting protein 1
  Uniprot ID: Q9NZI2
  ENSP ID: ENSP00000414886
MGAVMGTFSSLQTKQRRPSKDKIEDELEMTMVCHRPEGLEQLEAQTNFTKRELQVLYRGFKNECPSGVVNEDTFKQIYAQFFPHGALPCLEGSPCVEFLPPSPALLFCLVDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 44648 - protein, 42 aa, Homo sapiens
  Payload ID: 9101
  Gene Symbol: KCNIP1
  Gene Name: Kv channel interacting protein 1
  ENSP ID: ENSP00000431053
MSGCSKRCKLGFVKFAQTIFKLITGTLSKDGVKSGTGARRAG

SEQ ID NO: 44649 - protein, 188 aa, Homo sapiens
  Payload ID: 9101
  Gene Symbol: KCNIP1
  Gene Name: Kv channel interacting protein 1
  Uniprot ID: Q9NZI2
  ENSP ID: ENSP00000431102
MTMVCHRPEGLEQLEAQTNFTKRELQVLYRGFKNECPSGVVNEDTFKQIYAQFFPHGDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 44650 - protein, 207 aa, Homo sapiens
  Payload ID: 9101
  Gene Symbol: KCNIP1
  Gene Name: Kv channel interacting protein 1
  ENSP ID: ENSP00000478151
DIAWWYYQYQRDKIEDELEMTMVCHRPEGLEQLEAQTNFTKRELQVLYRGFKNECPSGVVNEDTFKQIYAQFFPHGDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 44651 - protein, 184 aa, Homo sapiens
  Payload ID: 9102
  Gene Symbol: KCNIP2
  Gene Name: Kv channel interacting protein 2
  Uniprot ID: Q9NS61
  ENSP ID: ENSP00000239117
MRGQGRKESLSDSRDLDGSYDQLTDSVDDEFELSTVCHRPEGLEQLQEQTKFTRKELQVLYRGFKNECPSGIVNEENFKQIYSQFFPQGDSSTYATFLFNAFDTNHDGSVSFEEMLDIMKSIYDMMGKYTYPALREEAPREHVESFFQKMDRNKDGVVTIEEFIESCQKVQLPALYITLTWTQA

SEQ ID NO: 44652 - protein, 225 aa, Homo sapiens
  Payload ID: 9102
  Gene Symbol: KCNIP2
  Gene Name: Kv channel interacting protein 2
  Uniprot ID: Q9NS61
  ENSP ID: ENSP00000239118
MNRCPRRCRSPLGQAARSLYQLVTGSLSPDSVDDEFELSTVCHRPEGLEQLQEQTKFTRKELQVLYRGFKNECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 44653 - protein, 227 aa, Homo sapiens
  Payload ID: 9102
  Gene Symbol: KCNIP2
  Gene Name: Kv channel interacting protein 2
  Uniprot ID: Q9NS61
  ENSP ID: ENSP00000341624
MRGQGRKESLSDSRDLDGSYDQLTDSVDDEFELSTVCHRPEGLEQLQEQTKFTRKELQVLYRGFKNPGALSFQECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 44654 - protein, 220 aa, Homo sapiens
  Payload ID: 9102
  Gene Symbol: KCNIP2
  Gene Name: Kv channel interacting protein 2
  Uniprot ID: Q9NS61
  ENSP ID: ENSP00000344169
MRGQGRKESLSDSRDLDGSYDQLTDSVDDEFELSTVCHRPEGLEQLQEQTKFTRKELQVLYRGFKNECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 44655 - protein, 270 aa, Homo sapiens
  Payload ID: 9102
  Gene Symbol: KCNIP2
  Gene Name: Kv channel interacting protein 2
  Uniprot ID: Q9NS61
  ENSP ID: ENSP00000349055
MRGQGRKESLSDSRDLDGSYDQLTGHPPGPTKKALKQRFLKLLPCCGPQALPSVSETLAAPASLRPHRPRLLDPDSVDDEFELSTVCHRPEGLEQLQEQTKFTRKELQVLYRGFKNECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 44656 - protein, 252 aa, Homo sapiens
  Payload ID: 9102
  Gene Symbol: KCNIP2
  Gene Name: Kv channel interacting protein 2
  Uniprot ID: Q9NS61
  ENSP ID: ENSP00000350733
MRGQGRKESLSDSRDLDGSYDQLTGHPPGPTKKALKQRFLKLLPCCGPQALPSVSENSVDDEFELSTVCHRPEGLEQLQEQTKFTRKELQVLYRGFKNECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 44657 - protein, 184 aa, Homo sapiens
  Payload ID: 9102
  Gene Symbol: KCNIP2
  Gene Name: Kv channel interacting protein 2
  ENSP ID: ENSP00000359063
MRGQGRKESLSDSRDLDGSYDQLTDSVDDEFELSTVCHRPEGLEQLQEQTKFTRKELQVLYRGFKNECPSGIVNEENFKQIYSQFFPQGDSSTYATFLFNAFDTNHDGSVSFEEMLDIMKSIYDMMGKYTYPALREEAPREHVESFFQKMDRNKDGVVTIEEFIESCQKDENIMRSMQLFDNVI

SEQ ID NO: 44658 - protein, 177 aa, Homo sapiens
  Payload ID: 9102
  Gene Symbol: KCNIP2
  Gene Name: Kv channel interacting protein 2
  Uniprot ID: Q9NS61
  ENSP ID: ENSP00000411679
MWLSWTAWTMNLNCPPCVTGLRVWSSCRSKPNSRARSCRSCTGASRTNVPAELSMRRTSSRFTPSSFLKEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 44659 - protein, 285 aa, Homo sapiens
  Payload ID: 9102
  Gene Symbol: KCNIP2
  Gene Name: Kv channel interacting protein 2
  Uniprot ID: Q9NS61
  ENSP ID: ENSP00000420040
MRGQGRKESLSDSRDLDGSYDQLTGHPPGPTKKALKQRFLKLLPCCGPQALPSVSEIGRVFRFLGDSSLPSALAAPASLRPHRPRLLDPDSVDDEFELSTVCHRPEGLEQLQEQTKFTRKELQVLYRGFKNECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 44660 - protein, 256 aa, Homo sapiens
  Payload ID: 9103
  Gene Symbol: KCNIP3
  Gene Name: Kv channel interacting protein 3, calsenilin
  Uniprot ID: Q9Y2W7
  ENSP ID: ENSP00000295225
MQPAKEVTKASDGSLLGDLGHTPLSKKEGIKWQRPRLSRQALMRCCLVKWILSSTAPQGSDSSDSELELSTVRHQPEGLDQLQAQTKFTKKELQSLYRGFKNECPTGLVDEDTFKLIYAQFFPQGDATTYAHFLFNAFDADGNGAIHFEDFVVGLSILLRGTVHEKLKWAFNLYDINKDGYITKEEMLAIMKSIYDMMGRHTYPILREDAPAEHVERFFEKMDRNQDGVVTIEEFLEACQKDENIMSSMQLFENVI

SEQ ID NO: 44661 - protein, 256 aa, Homo sapiens
  Payload ID: 9103
  Gene Symbol: KCNIP3
  Gene Name: Kv channel interacting protein 3, calsenilin
  ENSP ID: ENSP00000354261
MQPRKEVTKASDGSLLGDLGHTPLSKKEGIKWQRPRLSRQALMRCCLVKWILSSTAPQGSDSSDSELELSTVRHQPEGLDQLQAQTKFTKKELQSLYRGFKNECPTGLVDEDTFKLIYAQFFPQGDATTYAHFLFNAFDADGNGAIHFEDFVVGLSILLRGTVHEKLKWAFNLYDINKDGYITKEEMLAIMKSIYDMMGRHTYPILREDAPAEHVERFFEKMDRNQDGVVTIEEFLEACQKDENIMSSMQLFENVI

SEQ ID NO: 44662 - protein, 230 aa, Homo sapiens
  Payload ID: 9103
  Gene Symbol: KCNIP3
  Gene Name: Kv channel interacting protein 3, calsenilin
  Uniprot ID: Q9Y2W7
  ENSP ID: ENSP00000417499
MGIQGMELCAMAVVVLLFIAVLKQFGILEPISMEDSSDSELELSTVRHQPEGLDQLQAQTKFTKKELQSLYRGFKNECPTGLVDEDTFKLIYAQFFPQGDATTYAHFLFNAFDADGNGAIHFEDFVVGLSILLRGTVHEKLKWAFNLYDINKDGYITKEEMLAIMKSIYDMMGRHTYPILREDAPAEHVERFFEKMDRNQDGVVTIEEFLEACQKDENIMSSMQLFENVI

SEQ ID NO: 44663 - protein, 188 aa, Homo sapiens
  Payload ID: 9104
  Gene Symbol: KCNIP4
  Gene Name: Kv channel interacting protein 4
  Uniprot ID: Q6PIL6
  ENSP ID: ENSP00000351892
MATVRHRPEALELLEAQSKFTKKELQILYRGFKNECPSGVVNEETFKEIYSQFFPQGDSTTYAHFLFNAFDTDHNGAVSFEDFIKGLSILLRGTVQEKLNWAFNLYDINKDGYITKEEMLDIMKAIYDMMGKCTYPVLKEDAPRQHVETFFQKMDKNKDGVVTIDEFIESCQKDENIMRSMQLFENVI

SEQ ID NO: 44664 - protein, 225 aa, Homo sapiens
  Payload ID: 9104
  Gene Symbol: KCNIP4
  Gene Name: Kv channel interacting protein 4
  Uniprot ID: Q6PIL6
  ENSP ID: ENSP00000371583
MSGCRKRCKREILKFAQYLLRLLTGSLHTDSVEDELEMATVRHRPEALELLEAQSKFTKKELQILYRGFKNECPSGVVNEETFKEIYSQFFPQGDSTTYAHFLFNAFDTDHNGAVSFEDFIKGLSILLRGTVQEKLNWAFNLYDINKDGYITKEEMLDIMKAIYDMMGKCTYPVLKEDAPRQHVETFFQKMDKNKDGVVTIDEFIESCQKDENIMRSMQLFENVI

SEQ ID NO: 44665 - protein, 229 aa, Homo sapiens
  Payload ID: 9104
  Gene Symbol: KCNIP4
  Gene Name: Kv channel interacting protein 4
  Uniprot ID: Q6PIL6
  ENSP ID: ENSP00000371585
MNLEGLEMIAVLIVIVLFVKLLEQFGLIEAGLEDSVEDELEMATVRHRPEALELLEAQSKFTKKELQILYRGFKNECPSGVVNEETFKEIYSQFFPQGDSTTYAHFLFNAFDTDHNGAVSFEDFIKGLSILLRGTVQEKLNWAFNLYDINKDGYITKEEMLDIMKAIYDMMGKCTYPVLKEDAPRQHVETFFQKMDKNKDGVVTIDEFIESCQKDENIMRSMQLFENVI

SEQ ID NO: 44666 - protein, 250 aa, Homo sapiens
  Payload ID: 9104
  Gene Symbol: KCNIP4
  Gene Name: Kv channel interacting protein 4
  Uniprot ID: Q6PIL6
  ENSP ID: ENSP00000371587
MNVRRVESISAQLEEASSTGGFLYAQNSTKRSIKERLMKLLPCSAAKTSSPAIQNSVEDELEMATVRHRPEALELLEAQSKFTKKELQILYRGFKNECPSGVVNEETFKEIYSQFFPQGDSTTYAHFLFNAFDTDHNGAVSFEDFIKGLSILLRGTVQEKLNWAFNLYDINKDGYITKEEMLDIMKAIYDMMGKCTYPVLKEDAPRQHVETFFQKMDKNKDGVVTIDEFIESCQKDENIMRSMQLFENVI

SEQ ID NO: 44667 - protein, 216 aa, Homo sapiens
  Payload ID: 9104
  Gene Symbol: KCNIP4
  Gene Name: Kv channel interacting protein 4
  Uniprot ID: Q6PIL6
  ENSP ID: ENSP00000399080
MNVRRVESISAQLEEASSTGDSVEDELEMATVRHRPEALELLEAQSKFTKKELQILYRGFKNECPSGVVNEETFKEIYSQFFPQGDSTTYAHFLFNAFDTDHNGAVSFEDFIKGLSILLRGTVQEKLNWAFNLYDINKDGYITKEEMLDIMKAIYDMMGKCTYPVLKEDAPRQHVETFFQKMDKNKDGVVTIDEFIESCQKDENIMRSMQLFENVI

SEQ ID NO: 44668 - protein, 188 aa, Homo sapiens; identical to SEQ ID NO: 44663
  Payload ID: 9104
  Gene Symbol: KCNIP4
  Gene Name: Kv channel interacting protein 4
  Uniprot ID: Q6PIL6
  ENSP ID: ENSP00000423257

SEQ ID NO: 44669 - protein, 34 aa, Homo sapiens
  Payload ID: 9104
  Gene Symbol: KCNIP4
  Gene Name: Kv channel interacting protein 4
  ENSP ID: ENSP00000445321
MNVRRVESISAQLEEASSTGEAVIEHSLCTKCCP

SEQ ID NO: 44670 - protein, 29 aa, Homo sapiens
  Payload ID: 9104
  Gene Symbol: KCNIP4
  Gene Name: Kv channel interacting protein 4
  ENSP ID: ENSP00000486886
MSGCRKRCKREILKFAQYLLRLLTGSLHT

SEQ ID NO: 44671 - protein, 176 aa, Homo sapiens
  Payload ID: 9105
  Gene Symbol: KXD1
  Gene Name: KxDL motif containing 1
  Uniprot ID: Q9BQD3
  ENSP ID: ENSP00000222307
MDLPDSASRVFCGRILSMVNTDDVNAIILAQKNMLDRFEKTNEMLLNFNNLSSARLQQMSERFLHHTRTLVEMKRDLDSIFRRIRTLKGKLARQHPEAFSHIPEASFLEEEDEDPIPPSTTTTIATSEQSTGSCDTSPDTVSPSLSPGFEDLSHVQPGSPAINGRSQTDDEEMTGE

SEQ ID NO: 44672 - protein, 176 aa, Homo sapiens; identical to SEQ ID NO: 44671
  Payload ID: 9105
  Gene Symbol: KXD1
  Gene Name: KxDL motif containing 1
  Uniprot ID: Q9BQD3
  ENSP ID: ENSP00000438903

SEQ ID NO: 44673 - protein, 176 aa, Homo sapiens; identical to SEQ ID NO: 44671
  Payload ID: 9105
  Gene Symbol: KXD1
  Gene Name: KxDL motif containing 1
  Uniprot ID: Q9BQD3
  ENSP ID: ENSP00000443549

SEQ ID NO: 44674 - protein, 128 aa, Homo sapiens
  Payload ID: 9105
  Gene Symbol: KXD1
  Gene Name: KxDL motif containing 1
  ENSP ID: ENSP00000468857
MDLPDSASRVFCGRILSMVNTDDVNAIILAQKNMLDRFEKTNEMLLNFNNLSSARLQQMSERFLHHTRTLVEMKRDLDSIFRRIRTLKGKLARQHPEAFSRKCHAGFLLPSTSALSTQGRLLEGHLGA

SEQ ID NO: 44675 - protein, 136 aa, Homo sapiens
  Payload ID: 9105
  Gene Symbol: KXD1
  Gene Name: KxDL motif containing 1
  ENSP ID: ENSP00000468949
MDLPDSASRVFCGRILSMVNTDDVNAIILAQKNMLDRFEKTNEMLLNFNNLSSARLQQMSERFLHHTRTLVEMKRDLDSIFRRIRTLKGKLARQHPEAFSHIPEASFLEEEDEDPIPPSTTTTIATSEQSTGSCDT

SEQ ID NO: 44676 - protein, 176 aa, Homo sapiens; identical to SEQ ID NO: 44671
  Payload ID: 9105
  Gene Symbol: KXD1
  Gene Name: KxDL motif containing 1
  Uniprot ID: Q9BQD3
  ENSP ID: ENSP00000468990

SEQ ID NO: 44677 - protein, 74 aa, Homo sapiens
  Payload ID: 9105
  Gene Symbol: KXD1
  Gene Name: KxDL motif containing 1
  ENSP ID: ENSP00000469288
MDLPDSASRVFCGRILSMVNTDDVNAIILAQKNMLDRFEKTNEMLLNFNNLSSARLQQMSERFLHHTRTLVEMK

SEQ ID NO: 44678 - protein, 167 aa, Homo sapiens
  Payload ID: 9105
  Gene Symbol: KXD1
  Gene Name: KxDL motif containing 1
  ENSP ID: ENSP00000469294
MDLPDSASRVFCGRILSMVNTDDVNAIILAQKNMLDRFEKTNEMLLNFNNLSSARLQQMSERFLHHTRTLVEMKRDLDSIFRRIRTLKGKLARQHPEAFSHIPEASFLEEEDEDPIPPSTTTTIATSEQSTGSCDTSPDTVSPSLSPGFEDLSHVQPGSPAINGRSQ

SEQ ID NO: 44679 - protein, 195 aa, Homo sapiens
  Payload ID: 9105
  Gene Symbol: KXD1
  Gene Name: KxDL motif containing 1
  ENSP ID: ENSP00000469648
MDLPDSASRVFCGRILSMVNTDDVNAIILAQKNMLDRFEKTNEMLLNFNNLSSARLQQMSERFLHHTRTLVEMKRDLDSIFRRIRLHCALKCLGQFQPWDKILTTLKGKLARQHPEAFSHIPEASFLEEEDEDPIPPSTTTTIATSEQSTGSCDTSPDTVSPSLSPGFEDLSHVQPGSPAINGRSQTDDEEMTGE

SEQ ID NO: 44680 - protein, 85 aa, Homo sapiens
  Payload ID: 9105
  Gene Symbol: KXD1
  Gene Name: KxDL motif containing 1
  ENSP ID: ENSP00000471127
  MOD_RES (1)..(1): Any amino acid
XGRILSMVNTDDVNAIILAQKNMLDRFEKTNEMLLNFNNLSSARLQQMSERFLHHTRTLVEMKRDLDSIFRRIRYPRGILPGGRG

SEQ ID NO: 44681 - protein, 176 aa, Homo sapiens; identical to SEQ ID NO: 44671
  Payload ID: 9105
  Gene Symbol: KXD1
  Gene Name: KxDL motif containing 1
  Uniprot ID: Q9BQD3
  ENSP ID: ENSP00000471554

SEQ ID NO: 44682 - protein, 131 aa, Homo sapiens
  Payload ID: 9105
  Gene Symbol: KXD1
  Gene Name: KxDL motif containing 1
  ENSP ID: ENSP00000472268
MDLPDSASRVFCGRILSMVNTDDVNAIILAQKNMLDRFEKTNEMLLNFNNLSSARLQQMSERFLHHTRTLVEMKRDLDSIFRRIRTLKGKLARQHPEAFSHIPEASFLEEEDEDPIPPSTTTTIATSEQST

SEQ ID NO: 44683 - protein, 128 aa, Homo sapiens; identical to SEQ ID NO: 44674
  Payload ID: 9105
  Gene Symbol: KXD1
  Gene Name: KxDL motif containing 1
  ENSP ID: ENSP00000472535

SEQ ID NO: 44684 - protein, 176 aa, Homo sapiens; identical to SEQ ID NO: 44671
  Payload ID: 9105
  Gene Symbol: KXD1
  Gene Name: KxDL motif containing 1
  Uniprot ID: Q9BQD3
  ENSP ID: ENSP00000472678

SEQ ID NO: 44685 - protein, 176 aa, Homo sapiens; identical to SEQ ID NO: 44671
  Payload ID: 9105
  Gene Symbol: KXD1
  Gene Name: KxDL motif containing 1
  Uniprot ID: Q9BQD3
  ENSP ID: ENSP00000472836

SEQ ID NO: 44686 - protein, 5 aa, Homo sapiens
  Payload ID: 9105
  Gene Symbol: KXD1
  Gene Name: KxDL motif containing 1
  ENSP ID: ENSP00000473057
MDLPD

SEQ ID NO: 44687 - protein, 465 aa, Homo sapiens
  Payload ID: 9106
  Gene Symbol: KYNU
  Gene Name: kynureninase
  Uniprot ID: Q16719
  ENSP ID: ENSP00000264170
MEPSSLELPADTVQRIAAELKCHPTDERVALHLDEEDKLRHFRECFYIPKIQDLPPVDLSLVNKDENAIYFLGNSLGLQPKMVKTYLEEELDKWAKIAAYGHEVGKRPWITGDESIVGLMKDIVGANEKEIALMNALTVNLHLLMLSFFKPTPKRYKILLEAKAFPSDHYAIESQLQLHGLNIEESMRMIKPREGEETLRIEDILEVIEKEGDSIAVILFSGVHFYTGQHFNIPAITKAGQAKGCYVGFDLAHAVGNVELYLHDWGVDFACWCSYKYLNAGAGGIAGAFIHEKHAHTIKPALVGWFGHELSTRFKMDNKLQLIPGVCGFRISNPPILLVCSLHASLEIFKQATMKALRKKSVLLTGYLEYLIKHNYGKDKAATKKPVVNIITPSHVEERGCQLTITFSVPNKDVFQELEKRGVVCDKRNPNGIRVAPVPLYNSFHDVYKFTNLLTSILDSAETKN

SEQ ID NO: 44688 - protein, 307 aa, Homo sapiens
  Payload ID: 9106
  Gene Symbol: KYNU
  Gene Name: kynureninase
  Uniprot ID: Q16719
  ENSP ID: ENSP00000364928
MEPSSLELPADTVQRIAAELKCHPTDERVALHLDEEDKLRHFRECFYIPKIQDLPPVDLSLVNKDENAIYFLGNSLGLQPKMVKTYLEEELDKWAKIAAYGHEVGKRPWITGDESIVGLMKDIVGANEKEIALMNALTVNLHLLMLSFFKPTPKRYKILLEAKAFPSDHYAIESQLQLHGLNIEESMRMIKPREGEETLRIEDILEVIEKEGDSIAVILFSGVHFYTGQHFNIPAITKAGQAKGCYVGFDLAHAVGNVELYLHDWGVDFACWCSYKYLNAGAGGIAGAFIHEKHAHTIKPARSEFFN

SEQ ID NO: 44689 - protein, 465 aa, Homo sapiens; identical to SEQ ID NO: 44687
  Payload ID: 9106
  Gene Symbol: KYNU
  Gene Name: kynureninase
  Uniprot ID: Q16719
  ENSP ID: ENSP00000386731

SEQ ID NO: 44690 - protein, 148 aa, Homo sapiens
  Payload ID: 9106
  Gene Symbol: KYNU
  Gene Name: kynureninase
  ENSP ID: ENSP00000387296
MEPSSLELPADTVQRIAAELKCHPTDERVALHLDEEDKLRHFRECFYIPKIQDLPPVDLSLVNKDENAIYFLGNSLGLQPKMVKTYLEEELDKWAKIAAYGHEVGKRPWITGDESIVGLMKDIVATLTDPQHNQPGNDLSMCNLKSSC

SEQ ID NO: 44691 - protein, 76 aa, Homo sapiens
  Payload ID: 9106
  Gene Symbol: KYNU
  Gene Name: kynureninase
  ENSP ID: ENSP00000401190
MEPSSLELPADTVQRIAAELKCHPTDERVALHLDEEDKLRHFRECFYIPKIQDLPPEQPMVMKWGSVLGLQEMRVL

SEQ ID NO: 44692 - protein, 168 aa, Homo sapiens
  Payload ID: 9106
  Gene Symbol: KYNU
  Gene Name: kynureninase
  ENSP ID: ENSP00000481930
  MOD_RES (1)..(1): Any amino acid
XKMVKTYLEEELDKWAKIAAYGHEVGKRPWITGDESIVGLMKDIVGANEKEIALMNALTVNLHLLMLSFFKPTPKRYKILLEAKAFPSDHYAIESQLQLHGLNIEESMRMIKPREGEETLRIEDILEVIEKEGDSIAVILFSGVHFYTGQHFNIPAITKAGQAKLTKS

SEQ ID NO: 44693 - protein, 157 aa, Homo sapiens
  Payload ID: 9106
  Gene Symbol: KYNU
  Gene Name: kynureninase
  ENSP ID: ENSP00000482009
  MOD_RES (1)..(1): Any amino acid
XAAYGHEVGKRPWITGDESIVGLMKDIVGANEKEIALMNALTVNLHLLMLSFFKPTPKRYKILLEAKAFPSDHYAIESQLQLHGLNIEESMRMIKPREGEETLRIEDILEVIEKEGDSIAVILFSGVHFYTGQHFNIPAITKAGQAKVATLGSSSVP

SEQ ID NO: 44694 - protein, 236 aa, Homo sapiens
  Payload ID: 9106
  Gene Symbol: KYNU
  Gene Name: kynureninase
  ENSP ID: ENSP00000484801
ADTVQRIAAELKCHPTDERVALHLDEEDKLRHFRECFYIPKIQDLPPVDLSLVNKDENAIYFLGNSLGLQPKMVKTYLEEELDKWAKIAAYGHEVGKRPWITGDESIVGLMKDIVGANEKEIALMNALTVNLHLLMLSFFKPTPKRYKILLEAKAFPSDHYAIESQLQLHGLNIEESMRMIKPREGEETLRIEDILEVIEKEGDSIAVILFSGVHFYTGQHFNIPAITKAGQAKVV

SEQ ID NO: 44695 - protein, 182 aa, Homo sapiens
  Payload ID: 9107
  Gene Symbol: KMO
  Gene Name: kynurenine 3-monooxygenase (kynurenine 3-hydroxylase)
  ENSP ID: ENSP00000355513
  MOD_RES (1)..(1): Any amino acid
XGMNAGFEDCLVFDELMDKFSNDLSLCLPVFSRLRIPDDHAISDLSMYNYIEMRAHVNSSWFIFQKNMERFLHAIMPSTFIPLYTMVTFSRIRYHEAVQRWHWQKKVINKGLFFLGSLIAISSTYLLIHYMSPRSFLRLRRPWNWIAHFRNTTCFPAKAVDSLEQISNLISRLLSHSEILQT

SEQ ID NO: 44696 - protein, 452 aa, Homo sapiens
  Payload ID: 9107
  Gene Symbol: KMO
  Gene Name: kynurenine 3-monooxygenase (kynurenine 3-hydroxylase)
  Uniprot ID: O15229
  ENSP ID: ENSP00000355515
MDSSVIQRKKVAVIGGGLVGSLQACFLAKRNFQIDVYEAREDTRVATFTRGRSINLALSHRGRQALKAVGLEDQIVSQGIPMRARMIHSLSGKKSAIPYGTKSQYILSVSRENLNKDLLTAAEKYPNVKMHFNHRLLKCNPEEGMITVLGSDKVPKDVTCDLIVGCDGAYSTVRSHLMKKPRFDYSQQYIPHGYMELTIPPKNGDYAMEPNYLHIWPRNTFMMIALPNMNKSFTCTLFMPFEEFEKLLTSNDVVDFFQKYFPDAIPLIGEKLLVQDFFLLPAQPMISVKCSSFHFKSHCVLLGDAAHAIVPFFGQGMNAGFEDCLVFDELMDKFSNDLSLCLPVFSRLRIPDDHAISDLSMYNYIEVTFSRIRYHEAVQRWHWQKKVINKGLFFLGSLIAISSTYLLIHYMSPRSFLRLRRPWNWIAHFRNTTCFPAKAVDSLEQISNLISR

SEQ ID NO: 44697 - protein, 473 aa, Homo sapiens
  Payload ID: 9107
  Gene Symbol: KMO
  Gene Name: kynurenine 3-monooxygenase (kynurenine 3-hydroxylase)
  Uniprot ID: O15229
  ENSP ID: ENSP00000355516
MDSSVIQRKKVAVIGGGLVGSLQACFLAKRNFQIDVYEAREDTRVATFTRGRSINLALSHRGRQALKAVGLEDQIVSQGIPMRARMIHSLSGKKSAIPYGTKSQYILSVSRENLNKDLLTAAEKYPNVKMHFNHRLLKCNPEEGMITVLGSDKVPKDVTCDLIVGCDGAYSTVRSHLMKKPRFDYSQQYIPHGYMELTIPPKNGDYAMEPNYLHIWPRNTFMMIALPNMNKSFTCTLFMPFEEFEKLLTSNDVVDFFQKYFPDAIPLIGEKLLVQDFFLLPAQPMISVKCSSFHFKSHCVLLGDAAHAIVPFFGQGMNAGFEDCLVFDELMDKFSNDLSLCLPVFSRLRIPDDHAISDLSMYNYIEKNMERFLHAIMPSTFIPLYTMVTFSRIRYHEAVQRWHWQKKVINKGLFFLGSLIAISSTYLLIHYMSPRSFLRLRRPWNWIAHFRNTTCFPAKAVDSLEQISNLISR

SEQ ID NO: 44698 - protein, 486 aa, Homo sapiens
  Payload ID: 9107
  Gene Symbol: KMO
  Gene Name: kynurenine 3-monooxygenase (kynurenine 3-hydroxylase)
  Uniprot ID: O15229
  ENSP ID: ENSP00000355517
MDSSVIQRKKVAVIGGGLVGSLQACFLAKRNFQIDVYEAREDTRVATFTRGRSINLALSHRGRQALKAVGLEDQIVSQGIPMRARMIHSLSGKKSAIPYGTKSQYILSVSRENLNKDLLTAAEKYPNVKMHFNHRLLKCNPEEGMITVLGSDKVPKDVTCDLIVGCDGAYSTVRSHLMKKPRFDYSQQYIPHGYMELTIPPKNGDYAMEPNYLHIWPRNTFMMIALPNMNKSFTCTLFMPFEEFEKLLTSNDVVDFFQKYFPDAIPLIGEKLLVQDFFLLPAQPMISVKCSSFHFKSHCVLLGDAAHAIVPFFGQGMNAGFEDCLVFDELMDKFSNDLSLCLPVFSRLRIPDDHAISDLSMYNYIEMRAHVNSSWFIFQKNMERFLHAIMPSTFIPLYTMVTFSRIRYHEAVQRWHWQKKVINKGLFFLGSLIAISSTYLLIHYMSPRSFLRLRRPWNWIAHFRNTTCFPAKAVDSLEQISNLISR

SEQ ID NO: 44699 - protein, 661 aa, Homo sapiens
  Payload ID: 9108
  Gene Symbol: KY
  Gene Name: kyphoscoliosis peptidase
  Uniprot ID: Q8NBH2
  ENSP ID: ENSP00000397598
MELKKDINAVSIDMLLIVHSEKRRAAQGTLSDQQANPSSLLQRGGGFQGVGNGVRRWQKLEGNDFHENLVEKQHPQQPQVITSYNSQGTQLTVEVHPRDAMPQLLKKFSLAKRLQGDKNGNTRPRQPGGKDAHAYPWDRSSLKSMSLDLQQFEKLDIYASQVTAKSGLDELVSDLLQEAHTDLERVRAIWIWICHHIEYDIAAAQEKDRQAFKPTDILRTQKTNCDGYAGLFERMCRLAGVQCMTVPGYSKGFGYQTGQSFSGEFDHAWNAVYLEGRWHLVDSTWGSGLVDTITSKFTFLYNEFYFLTHPALFIEDHFPDNKNWQLLKPPQSLRQFENNMYHKSEFYNKGMLSAHPETSMIRTVNGKATVTIESCAPTLFMFMLNGKQEHGLLSLRKNGMKLEVYPPTMGTHKLQIFAKGNSDIYSSVLEYTLKCNYVDMGVQLPAELHQPVGPSWFSEQMGIMKPSHPDPIIHTSDGRCSISFSVEEGINVLASLHGDDGPITEETQRRYIFQLHREKQTELKVQLPHAGKFALKIFVKKRQEPGNYIFVFNYLVCCANTKVNWPMFPESFGNWGQDNELLEPLSGVLPANRNVPFKLKLHGIAKVLVKGQDTWPLTLNHEGYWEGSCSTAGCQEVYVMVLENANHNFYSYILKYKVNAQ

SEQ ID NO: 44700 - protein, 640 aa, Homo sapiens
  Payload ID: 9108
  Gene Symbol: KY
  Gene Name: kyphoscoliosis peptidase
  Uniprot ID: Q8NBH2
  ENSP ID: ENSP00000421297
MELKKDINAVSIDMLLIVHSEKRRAAQGTLSDQQANPSSLLQRGGGFQGVGNGVRRWQKLEGNDFHGTQLTVEVHPRDAMPQLLKKFSLAKRLQGDKNGNTRPRQPGGKDAHAYPWDRSSLKSMSLDLQQFEKLDIYASQVTAKSGLDELVSDLLQEAHTDLERVRAIWIWICHHIEYDIAAAQEKDRQAFKPTDILRTQKTNCDGYAGLFERMCRLAGVQCMTVPGYSKGFGYQTGQSFSGEFDHAWNAVYLEGRWHLVDSTWGSGLVDTITSKFTFLYNEFYFLTHPALFIEDHFPDNKNWQLLKPPQSLRQFENNMYHKSEFYNKGMLSAHPETSMIRTVNGKATVTIESCAPTLFMFMLNGKQEHGLLSLRKNGMKLEVYPPTMGTHKLQIFAKGNSDIYSSVLEYTLKCNYVDMGVQLPAELHQPVGPSWFSEQMGIMKPSHPDPIIHTSDGRCSISFSVEEGINVLASLHGDDGPITEETQRRYIFQLHREKQTELKVQLPHAGKFALKIFVKKRQEPGNYIFVFNYLVCCANTKVNWPMFPESFGNWGQDNELLEPLSGVLPANRNVPFKLKLHGIAKVLVKGQDTWPLTLNHEGYWEGSCSTAGCQEVYVMVLENANHNFYSYILKYKVNAQ

SEQ ID NO: 44701 - protein, 308 aa, Homo sapiens
  Payload ID: 9108
  Gene Symbol: KY
  Gene Name: kyphoscoliosis peptidase
  ENSP ID: ENSP00000426777
MELKKDINAVSIDMLLIVHSEKRRAAQGTLSDQQANPSSLLQRGGGFQGVGNGVRRWQKLEGNDFHENLVEKQHPQQPQVITSYNSQGTQLTVEVHPRDAMPQLLKKFSLAKRLQGDKNGNTRPRQPGGKDAHAYPWDRSSLKSMSLDLQQFEKLDIYASQVTAKSGLDELVSDLLQEAHTDLERVRAIWIWICHHIEYDIAAAQEKDRQAFKPTDILRTQKTNCDGYAGLFERMCRLAGVQCMTVPGYSKGFGYQTGQSFSGEFDHAWNAVYLEGRWHLVDSTWGSGLVDTITSKFTFLEWEGHGHH

SEQ ID NO: 44702 - protein, 143 aa, Homo sapiens
  Payload ID: 9109
  Gene Symbol: LAGE3
  Gene Name: L antigen family, member 3
  Uniprot ID: Q14657
  ENSP ID: ENSP00000349923
MRDADADAGGGADGGDGRGGHSCRGGVDTAAAPAGGAPPAHAPGPGRDAASAARGSRMRPHIFTLSVPFPTPLEAEIAHGSLAPDAEPHQRVVGKDLTVSGRILVVRWKAEDCRLLRISVINFLDQLSLVVRTMQRFGPPVSR

SEQ ID NO: 44703 - protein, 105 aa, Homo sapiens
  Payload ID: 9109
  Gene Symbol: LAGE3
  Gene Name: L antigen family, member 3
  ENSP ID: ENSP00000478022
MQTQAEALTAGMAGVATAAAGAWTQPQLRPVELPQRTRQVRAETPRLRQGVTNAAAHIHPQRAFPDPLGGGNRPWVPGTRCRAPPKGGWEGSHSEWQDPGRPLES

SEQ ID NO: 44704 - protein, 743 aa, Homo sapiens
  Payload ID: 9110
  Gene Symbol: L3MBTL1
  Gene Name: l(3)mbt-like 1 (Drosophila)
  ENSP ID: ENSP00000362226
MRRREGHGTDSEMGQGPVRESQSSDPPALQFRISEYKPLNMAGVEQPPSPELRQEGVTEYEDGGAPAGDGEAGPQQAEDHPQNPPEDPNQDPPEDDSTCQCQACGPHQAAGPDLGSSNDGCPQLFQERSVIVENSSGSTSASELLKPMKKRKRREYQSPSEEESEPEAMEKQEEGKDPEGQPTASTPESEEWSSSQPATGEKKECWSWESYLEEQKAITAPVSLFQDSQAVTHNKNGFKLGMKLEGIDPQHPSMYFILTVAEVCGYRLRLHFDGYSECHDFWVNANSPDIHPAGWFEKTGHKLQPPKGYKEEEFSWSQYLRSTRAQAAPKHLFVSQSHSPPPLGFQVGMKLEAVDRMNPSLVCVASVTDVVDSRFLVHFDNWDDTYDYWCDPSSPYIHPVGWCQKQGKPLTPPQDYPDPDNFCWEKYLEETGASAVPTWAFKVRPPHSFLVNMKLEAVDRRNPALIRVASVEDVEDHRIKIHFDGWSHGYDFWIDADHPDIHPAGWCSKTGHPLQPPLGPREPSSASPGGCPPLSYRSLPHTRTSKYSFHHRLFFPRKCPTPGCDGSGHVTGKFTAHHCLSGCPLAERNQSRLKAELSDSEASARKKNLSGFSPRKKPRHHGRIGRPPKYRKIPQEDFQTLTPDVVHQSLFMSALSAHPDRSLSVCWEQHCKLLPGVAGISASTVAKWTIDEVFGFVQTLTGCEDQARLFKDEVRCKCRVGDRAGVTVLKTAGSRCPPQRHFC

SEQ ID NO: 44705 - protein, 772 aa, Homo sapiens
  Payload ID: 9110
  Gene Symbol: L3MBTL1
  Gene Name: l(3)mbt-like 1 (Drosophila)
  Uniprot ID: Q9Y468
  ENSP ID: ENSP00000362227
MRRREGHGTDSEMGQGPVRESQSSDPPALQFRISEYKPLNMAGVEQPPSPELRQEGVTEYEDGGAPAGDGEAGPQQAEDHPQNPPEDPNQDPPEDDSTCQCQACGPHQAAGPDLGSSNDGCPQLFQERSVIVENSSGSTSASELLKPMKKRKRREYQSPSEEESEPEAMEKQEEGKDPEGQPTASTPESEEWSSSQPATGEKKECWSWESYLEEQKAITAPVSLFQDSQAVTHNKNGFKLGMKLEGIDPQHPSMYFILTVAEVCGYRLRLHFDGYSECHDFWVNANSPDIHPAGWFEKTGHKLQPPKGYKEEEFSWSQYLRSTRAQAAPKHLFVSQSHSPPPLGFQVGMKLEAVDRMNPSLVCVASVTDVVDSRFLVHFDNWDDTYDYWCDPSSPYIHPVGWCQKQGKPLTPPQDYPDPDNFCWEKYLEETGASAVPTWAFKVRPPHSFLVNMKLEAVDRRNPALIRVASVEDVEDHRIKIHFDGWSHGYDFWIDADHPDIHPAGWCSKTGHPLQPPLGPREPSSASPGGCPPLSYRSLPHTRTSKYSFHHRKCPTPGCDGSGHVTGKFTAHHCLSGCPLAERNQSRLKAELSDSEASARKKNLSGFSPRKKPRHHGRIGRPPKYRKIPQEDFQTLTPDVVHQSLFMSALSAHPDRSLSVCWEQHCKLLPGVAGISASTVAKWTIDEVFGFVQTLTGCEDQARLFKDEARIVRVTHVSGKTLVWTVAQLGDLVCSDHLQEGKGILETGVHSLLCSLPTHLLAKLSFASDSQY

SEQ ID NO: 44706 - protein, 138 aa, Homo sapiens
  Payload ID: 9110
  Gene Symbol: L3MBTL1
  Gene Name: l(3)mbt-like 1 (Drosophila)
  ENSP ID: ENSP00000387971
MHLVAGDSPGSGPHLPATAFIIPASSATLGLPSSALDVSCFPREPIHVGAPEQVAGCEPVSATVLPQLSAGPASSSTSTVRLLEWTEAAAPPPGGGLRFRISEYKPLNMAGVEQPPSPELRQEGVTEYEDGGAPAGDG

SEQ ID NO: 44707 - protein, 840 aa, Homo sapiens
  Payload ID: 9110
  Gene Symbol: L3MBTL1
  Gene Name: l(3)mbt-like 1 (Drosophila)
  Uniprot ID: Q9Y468
  ENSP ID: ENSP00000398516
MHLVAGDSPGSGPHLPATAFIIPASSATLGLPSSALDVSCFPREPIHVGAPEQVAGCEPVSATVLPQLSAGPASSSTSTVRLLEWTEAAAPPPGGGLRFRISEYKPLNMAGVEQPPSPELRQEGVTEYEDGGAPAGDGEAGPQQAEDHPQNPPEDPNQDPPEDDSTCQCQACGPHQAAGPDLGSSNDGCPQLFQERSVIVENSSGSTSASELLKPMKKRKRREYQSPSEEESEPEAMEKQEEGKDPEGQPTASTPESEEWSSSQPATGEKKECWSWESYLEEQKAITAPVSLFQDSQAVTHNKNGFKLGMKLEGIDPQHPSMYFILTVAEVCGYRLRLHFDGYSECHDFWVNANSPDIHPAGWFEKTGHKLQPPKGYKEEEFSWSQYLRSTRAQAAPKHLFVSQSHSPPPLGFQVGMKLEAVDRMNPSLVCVASVTDVVDSRFLVHFDNWDDTYDYWCDPSSPYIHPVGWCQKQGKPLTPPQDYPDPDNFCWEKYLEETGASAVPTWAFKVRPPHSFLVNMKLEAVDRRNPALIRVASVEDVEDHRIKIHFDGWSHGYDFWIDADHPDIHPAGWCSKTGHPLQPPLGPREPSSASPGGCPPLSYRSLPHTRTSKYSFHHRKCPTPGCDGSGHVTGKFTAHHCLSGCPLAERNQSRLKAELSDSEASARKKNLSGFSPRKKPRHHGRIGRPPKYRKIPQEDFQTLTPDVVHQSLFMSALSAHPDRSLSVCWEQHCKLLPGVAGISASTVAKWTIDEVFGFVQTLTGCEDQARLFKDEARIVRVTHVSGKTLVWTVAQLGDLVCSDHLQEGKGILETGVHSLLCSLPTHLLAKLSFASDSQY

SEQ ID NO: 44708 - protein, 840 aa, Homo sapiens; identical to SEQ ID NO: 44707
  Payload ID: 9110
  Gene Symbol: L3MBTL1
  Gene Name: l(3)mbt-like 1 (Drosophila)
  Uniprot ID: Q9Y468
  ENSP ID: ENSP00000402107

SEQ ID NO: 44709 - protein, 538 aa, Homo sapiens
  Payload ID: 9110
  Gene Symbol: L3MBTL1
  Gene Name: l(3)mbt-like 1 (Drosophila)
  ENSP ID: ENSP00000410139
QKAITAPVSLFQDSQAVTHNKNGFKLGMKLEGIDPQHPSMYFILTVAEVCGYRLRLHFDGYSECHDFWVNANSPDIHPAGWFEKTGHKLQPPKGYKEEEFSWSQYLRSTRAQAAPKHLFVSQSHSPPPLGFQVGMKLEAVDRMNPSLVCVASVTDVVDSRFLVHFDNWDDTYDYWCDPSSPYIHPVGWCQKQGKPLTPPQDYPDPDNFCWEKYLEETGASAVPTWAFKVRPPHSFLVNMKLEAVDRRNPALIRVASVEDVEDHRIKIHFDGWSHGYDFWIDADHPDIHPAGWCSKTGHPLQPPLGPREPSSASPGGCPPLSYRSLPHTRTSKYSFHHRKCPTPGCDGSGHVTGKFTAHHCLSGCPLAERNQSRLKAELSDSEASARKKNLSGFSPRKKPRHHGRIGRPPKYRKIPQEDFQTLTPDVVHQSLFMSALSAHPDRSLSVCWEQHCKLLPGVAGISASTVAKWTIDEVFGFVQTLTGCEDQARLFKDEMIDGEAFLLLTQADIVKIMSVKLGPALKIYNAILMFKNADDTLK

SEQ ID NO: 44710 - protein, 45 aa, Homo sapiens
  Payload ID: 9110
  Gene Symbol: L3MBTL1
  Gene Name: l(3)mbt-like 1 (Drosophila)
  ENSP ID: ENSP00000412938
  MOD_RES (1)..(1): Any amino acid
XDFWVNANSPDIHPAGWFEKTGHKLQPPKESPTPGLPGGHEAGGC

SEQ ID NO: 44711 - protein, 84 aa, Homo sapiens
  Payload ID: 9110
  Gene Symbol: L3MBTL1
  Gene Name: l(3)mbt-like 1 (Drosophila)
  ENSP ID: ENSP00000415971
MAGVEQPPSPELRQEGVTEYEDGGAPAGDGEAGPQQAEDHPQNPPEDPNQDPPEDDSTCQCQACGPHQAAGPDLGSSNDGCPQL

SEQ ID NO: 44712 - protein, 705 aa, Homo sapiens
  Payload ID: 9111
  Gene Symbol: L3MBTL2
  Gene Name: l(3)mbt-like 2 (Drosophila)
  Uniprot ID: Q969R5
  ENSP ID: ENSP00000216237
MEKPRSIEETPSSEPMEEEEDDDLELFGGYDSFRSYNSSVGSESSSYLEESSEAENEDREAGELPTSPLHLLSPGTPRSLDGSGSEPAVCEMCGIVGTREAFFSKTKRFCSVSCSRSYSSNSKKASILARLQGKPPTKKAKVLHKAAWSAKIGAFLHSQGTGQLADGTPTGQDALVLGFDWGKFLKDHSYKAAPVSCFKHVPLYDQWEDVMKGMKVEVLNSDAVLPSRVYWIASVIQTAGYRVLLRYEGFENDASHDFWCNLGTVDVHPIGWCAINSKILVPPRTIHAKFTDWKGYLMKRLVGSRTLPVDFHIKMVESMKYPFRQGMRLEVVDKSQVSRTRMAVVDTVIGGRLRLLYEDGDSDDDFWCHMWSPLIHPVGWSRRVGHGIKMSERRSDMAHHPTFRKIYCDAVPYLFKKVRAVYTEGGWFEEGMKLEAIDPLNLGNICVATVCKVLLDGYLMICVDGGPSTDGLDWFCYHASSHAIFPATFCQKNDIELTPPKGYEAQTFNWENYLEKTKSKAAPSRLFNMDCPNHGFKVGMKLEAVDLMEPRLICVATVKRVVHRLLSIHFDGWDSEYDQWVDCESPDIYPVGWCELTGYQLQPPVAAEPATPLKAKEATKKKKKQFGKKRKRIPPTKTRPLRQGSKKPLLEDDPQGARKISSEPVPGEIIAVRVKEEHLDVASPDKASSPELPVSVENIKQETDD

SEQ ID NO: 44713 - protein, 288 aa, Homo sapiens
  Payload ID: 9111
  Gene Symbol: L3MBTL2
  Gene Name: l(3)mbt-like 2 (Drosophila)
  ENSP ID: ENSP00000399405
  MOD_RES (1)..(1): Any amino acid
XRPHLQNQWRKRKMTTWSCLVAMIVSGVITAVWAVRAAPIWRSQVKQKMRIGKQGNCRPPRCICSALGLLAPWMAVVLSQGKPPTKKAKVLHKAAWSAKIGAFLHSQGTGQLADGTPTGQDALVLGFDWGKFLKDHSYKAAPVSCFKHVPLYDQWEDVMKGMKVEVLNSDAVLPSRVYWIASVIQTAGYRVLLRYEGFENDASHDFWCNLGTVDVHPIGWCAINSKILVPPRTIHAKFTDWKGYLMKRLVGSRTLPVDFHIKVGSEPLTDVPPSALPFFCILHATHWS

SEQ ID NO: 44714 - protein, 232 aa, Homo sapiens
  Payload ID: 9111
  Gene Symbol: L3MBTL2
  Gene Name: l(3)mbt-like 2 (Drosophila)
  ENSP ID: ENSP00000403767
ETPSSEPMEEEEDDDLELFGGYDSFRSYNSSVGSESSSYLEESSEAENEDREAGELPTSPLHLLSPGTPRSLDGSGSEPAVCEMCGIVGTREAFFSKTKRFCSVSCSRSYSSNSKKASILARLQGKPPTKKAKVLHKAAWSAKIGAFLHSQGTGQLADGTPTGQDALVLGFDWGKFLKDHSYKAAPVSCFKHGIGCCFGMKALKMTPAMTSGATWEQWMSTPLAGVPSTARS

SEQ ID NO: 44715 - protein, 40 aa, Homo sapiens
  Payload ID: 9111
  Gene Symbol: L3MBTL2
  Gene Name: l(3)mbt-like 2 (Drosophila)
  ENSP ID: ENSP00000405849
MEKPRSIERWGVAVLPRLVSNSWVQAIHLPQPPKVLGLQM

SEQ ID NO: 44716 - protein, 614 aa, Homo sapiens
  Payload ID: 9111
  Gene Symbol: L3MBTL2
  Gene Name: l(3)mbt-like 2 (Drosophila)
  Uniprot ID: Q969R5
  ENSP ID: ENSP00000414423
MEKPRSIEETPSSEPMEEEEDDDLELFGGYDSFRSYNSSVGSESSSYLEESSEAENEDREAGELPTSPLHLLSPGTPRSLDGSGSEPAVCEMCGIVGTREAFFSKTKRFCSVSCSRSYSSNSKKASILARLQGKPPTKKAKVLHKAAWSAKIGAFLHSQGTGQLADGTPTGQDALVLGFDWGKFLKDHSYKAAPVSCFKHVPLYDQWEDVMKGMKVEVLNSDAVLPSRVYWIASVIQTAGYRVLLRYEGFENDASHDFWCNLGTVDVHPIGWCAINSKILVPPRTIHAKFTDWKGYLMKRLVGSRTLPVDFHIKMVESMKYPFRQGMRLEVVDKSQVSRTRMAVVDTVIGGRLRLLYEDGDSDDDFWCHMWSPLIHPVGWSRRVGHGIKMSERRSDMAHHPTFRKIYCDAVPYLFKKVRAVYTEGGWFEEGMKLEAIDPLNLGNICVATVCKVLLDGYLMICVDGGPSTDGLDWFCYHASSHAIFPATFCQKNDIELTPPKGYEAQTFNWENYLEKTKSKAAPSRLFNMDCPNHGFKVGMKLEAVDLMEPRLICVATVKRVVHRLLSIHFDGWDSEYDQWVDCESPDIYPVGWCELTGYQLQPPVAAGKLPRSL

SEQ ID NO: 44717 - protein, 780 aa, Homo sapiens
  Payload ID: 9112
  Gene Symbol: L3MBTL3
  Gene Name: l(3)mbt-like 3 (Drosophila)
  Uniprot ID: Q96JM7
  ENSP ID: ENSP00000354526
MTESASSTSGQEFDVFSVMDWKDGVGTLPGSDLKFRVNEFGALEVITDENEMENVKKATATTTWMVPTAQEAPTSPPSSRPVFPPAYWTSPPGCPTVFSEKTGMPFRLKDPVKVEGLQFCENCCQYGNVDECLSGGNYCSQNCARHIKDKDQKEERDVEEDNEEEDPKCSRKKKPKLSLKADTKEDGEERDDEMENKQDVRILRGSQRARRKRRGDSAVLKQGLPPKGKKAWCWASYLEEEKAVAVPAKLFKEHQSFPYNKNGFKVGMKLEGVDPEHQSVYCVLTVAEVCGYRIKLHFDGYSDCYDFWVNADALDIHPVGWCEKTGHKLHPPKGYKEEEFNWQTYLKTCKAQAAPKSLFENQNITVIPSGFRVGMKLEAVDKKNPSFICVATVTDMVDNRFLVHFDNWDESYDYWCEASSPHIHPVGWCKEHRRTLITPPGYPNVKHFSWDKYLEETNSLPAPARAFKVKPPHGFQKKMKLEVVDKRNPMFIRVATVADTDDHRVKVHFDGWNNCYDYWIDADSPDIHPVGWCSKTGHPLQPPLSPLELMEASEHGGCSTPGCKGIGHFKRARHLGPHSAANCPYSEINLNKDRIFPDRLSGEMPPASPSFPRNKRTDANESSSSPEIRDQHADDVKEDFEERTESEMRTSHEARGAREEPTVQQAQRRSAVFLSFKSPIPCLPLRWEQQSKLLPTVAGIPASKVSKWSTDEVSEFIQSLPGCEEHGKVFKDEQIDGEAFLLMTQTDIVKIMSIKLGPALKIFNSILMFKAAEKNSHNEL

SEQ ID NO: 44718 - protein, 780 aa, Homo sapiens; identical to SEQ ID NO: 44717
  Payload ID: 9112
  Gene Symbol: L3MBTL3
  Gene Name: l(3)mbt-like 3 (Drosophila)
  Uniprot ID: Q96JM7
  ENSP ID: ENSP00000357118

SEQ ID NO: 44719 - protein, 755 aa, Homo sapiens
  Payload ID: 9112
  Gene Symbol: L3MBTL3
  Gene Name: l(3)mbt-like 3 (Drosophila)
  Uniprot ID: Q96JM7
  ENSP ID: ENSP00000357121
MTESASSTSGQEFDVFSVMDWKDGVGTLPGSDLKFRVNEFGALEVITDENEMENVKKATATTTWMVPTAQEVFSEKTGMPFRLKDPVKVEGLQFCENCCQYGNVDECLSGGNYCSQNCARHIKDKDQKEERDVEEDNEEEDPKCSRKKKPKLSLKADTKEDGEERDDEMENKQDVRILRGSQRARRKRRGDSAVLKQGLPPKGKKAWCWASYLEEEKAVAVPAKLFKEHQSFPYNKNGFKVGMKLEGVDPEHQSVYCVLTVAEVCGYRIKLHFDGYSDCYDFWVNADALDIHPVGWCEKTGHKLHPPKGYKEEEFNWQTYLKTCKAQAAPKSLFENQNITVIPSGFRVGMKLEAVDKKNPSFICVATVTDMVDNRFLVHFDNWDESYDYWCEASSPHIHPVGWCKEHRRTLITPPGYPNVKHFSWDKYLEETNSLPAPARAFKVKPPHGFQKKMKLEVVDKRNPMFIRVATVADTDDHRVKVHFDGWNNCYDYWIDADSPDIHPVGWCSKTGHPLQPPLSPLELMEASEHGGCSTPGCKGIGHFKRARHLGPHSAANCPYSEINLNKDRIFPDRLSGEMPPASPSFPRNKRTDANESSSSPEIRDQHADDVKEDFEERTESEMRTSHEARGAREEPTVQQAQRRSAVFLSFKSPIPCLPLRWEQQSKLLPTVAGIPASKVSKWSTDEVSEFIQSLPGCEEHGKVFKDEQIDGEAFLLMTQTDIVKIMSIKLGPALKIFNSILMFKAAEKNSHNEL

SEQ ID NO: 44720 - protein, 780 aa, Homo sapiens; identical to SEQ ID NO: 44717
  Payload ID: 9112
  Gene Symbol: L3MBTL3
  Gene Name: l(3)mbt-like 3 (Drosophila)
  Uniprot ID: Q96JM7
  ENSP ID: ENSP00000431962

SEQ ID NO: 44721 - protein, 190 aa, Homo sapiens
  Payload ID: 9112
  Gene Symbol: L3MBTL3
  Gene Name: l(3)mbt-like 3 (Drosophila)
  ENSP ID: ENSP00000433257
MTESASSTSGQEFDVFSVMDWKDGVGTLPGSDLKFRVNEFGALEVITDENEMENVKKATATTTWMVPTAQEAPTSPPSSRPVFPPAYWTSPPGCPTVFSEKTGMPFRLKDPVKVEGLQFCENCCQYGNVDECLSGGNYCSQNCARHIKDKDQKEERDVEEDNEEEDPKCSRKKKPKLSLKADTKEDGEER

SEQ ID NO: 44722 - protein, 163 aa, Homo sapiens
  Payload ID: 9112
  Gene Symbol: L3MBTL3
  Gene Name: l(3)mbt-like 3 (Drosophila)
  ENSP ID: ENSP00000436617
MTESASSTSGQEFDVFSVMDWKDGVGTLPGSDLKFRVNEFGALEVITDENEMENVKKATATTTWMVPTAQEAYTGDLAKSLPLFFSSTPMVVTNTYMLMTPKSTSPAPTSPPSSRPVFPPAYWTSPPGCPTVFSEKTGMPFRLKDPVKVEGLQFCENCCQYGN

SEQ ID NO: 44723 - protein, 755 aa, Homo sapiens; identical to SEQ ID NO: 44719
  Payload ID: 9112
  Gene Symbol: L3MBTL3
  Gene Name: l(3)mbt-like 3 (Drosophila)
  Uniprot ID: Q96JM7
  ENSP ID: ENSP00000436706

SEQ ID NO: 44724 - protein, 755 aa, Homo sapiens; identical to SEQ ID NO: 44719
  Payload ID: 9112
  Gene Symbol: L3MBTL3
  Gene Name: l(3)mbt-like 3 (Drosophila)
  Uniprot ID: Q96JM7
  ENSP ID: ENSP00000437185

SEQ ID NO: 44725 - protein, 623 aa, Homo sapiens
  Payload ID: 9113
  Gene Symbol: L3MBTL4
  Gene Name: l(3)mbt-like 4 (Drosophila)
  Uniprot ID: Q8NA19
  ENSP ID: ENSP00000284898
MKQPNRKRKLNMDSKERLDQDGRLEQAEEEKKPKDSTTPLSHVPSAAAQGAWSWEWYLKEQKAVAAPVELFSKDQSFPEHENGFQIGMRLEGIDPRHPSVFCVLSVAEVCGYRLRLHFDGYLSCYDFWTNAGSPDIHPVGWCEKTKHELHIPKGYRKDKFVWMDYLKACKLQNAPKKLFRNRSPNGPMSKEFQVGMKLEAVDRKNPSLVCVATIADIVEDRLLVHFDNWDDSYDYWCDVNSPYVQPVGWCQENGRTLIAPQGYPNPENFSWTEYLEATQTNAVPAKVFKMRLPHGFLPNMKLEVVDKRNPRLIRVATIVDVDDQRVKVHFDGWDHKYDYWVEADSPDIHPIGWCDVTGHPLEVPQRTNDLKILPGQAVCPTPGCRGIGHIRGPRYSGHHSAFGCPYSDMNLKKEATLHDRLREQTQANLESDSSHSKSKSLCSLNFNGKHEKVNSQPRLVQQAKCLKIKGKEDIDLDNLFRVLVLHPRGLEYSVEQAQQVLHQSVSMSTVSAHPFRDLPLGREQHCKLLPGVADIRASQVARWTVDEVAEFVQSLLGCEEHAKCFKKEQIDGKAFLLLTQTDIVKVMKIKLGPALKIYNSILMFRHSQELPEEDIASGQEVRG

SEQ ID NO: 44726 - protein, 614 aa, Homo sapiens
  Payload ID: 9113
  Gene Symbol: L3MBTL4
  Gene Name: l(3)mbt-like 4 (Drosophila)
  ENSP ID: ENSP00000318543
MKQPNRKRKLNMDSKERLDQDGRLEQAEEEKKPKDSTTPLSHVPSAAAQGAWSWEWYLKEQKAVAAPVELFSKDQSFPEHENGFQIGMRLEGIDPRHPSVFCVLSVAEVCGYRLRLHFDGYLSCYDFWTNAGSPDIHPVGWCEKTKHELHIPKGYRKDKFVWMDYLKACKLQNAPKKLFRNRSPNGPMSKEFQVGMKLEAVDRKNPSLVCVATIADIVEDRLLVHFDNWDDSYDYWCDVNSPYVQPVGWCQENGRTLIAPQGYPNPENFSWTEYLEATQTNAVPAKVFKMRLPHGFLPNMKLEVVDKRNPRLIRVATIVDVDDQRVKVHFDGWDHKYDYWVEADSPDIHPIGWCDVTGHPLEVPQRTNDLKILPGQAVCPTPGCRGIGHIRGPRYSGHHSAFGCPYSDMNLKKEATLHDRLREQTQANLESDSSHSKSKSLCSLNFNGKHEKVNSQPRLVQQAKCLKIKGKEDIDLDNLFREYSVEQAQQVLHQSVSMSTVSAHPFRDLPLGREQHCKLLPGVADIRASQVARWTVDEVAEFVQSLLGCEEHAKCFKKEQIDGKAFLLLTQTDIVKVMKIKLGPALKIYNSILMFRHSQELPEEDIASGQEVRG

SEQ ID NO: 44727 - protein, 534 aa, Homo sapiens
  Payload ID: 9113
  Gene Symbol: L3MBTL4
  Gene Name: l(3)mbt-like 4 (Drosophila)
  Uniprot ID: Q8NA19
  ENSP ID: ENSP00000382975
MKQPNRKRKLNMDSKERLDQDGRLEQAEEEKKPKDSTTPLSHVPSAAAQGAWSWEWYLKEQKAVAAPVELFSKDQSFPEHENGFQIGMRLEGIDPRHPSVFCVLSVAEVCGYRLRLHFDGYLSCYDFWTNAGSPDIHPVGWCEKTKHELHIPKGYRKDKFVWMDYLKACKLQNAPKKLFRNRSPNGPMSKEFQVGMKLEAVDRKNPSLVCVATIADIVEDRLLVHFDNWDDSYDYWCDVNSPYVQPVGWCQENGRTLIAPQGYPNPENFSWTEYLEATQTNAVPAKVFKMRLPHGFLPNMKLEVVDKRNPRLIRVATIVDVDDQRVKVHFDGWDHKYDYWVEADSPDIHPIGWCDVTGHPLEVPQRTNDLKILPGQAVCPTPGCRGIGHIRGPRYSGHHSAFGCPYSDMNLKKEATLHDRLREQTQANLESDSSHSKSKSLCSLNFNGKHEKVNSQPRLVQQAKCLKIKGKEDIDLDNLFRGRVRWLMPVIPALWEAEAGRSRDQEIKTILANAVKPRLYQKYKKLARRGGGCL

SEQ ID NO: 44728 - protein, 623 aa, Homo sapiens; identical to SEQ ID NO: 44725
  Payload ID: 9113
  Gene Symbol: L3MBTL4
  Gene Name: l(3)mbt-like 4 (Drosophila)
  Uniprot ID: Q8NA19
  ENSP ID: ENSP00000382976

SEQ ID NO: 44729 - protein, 122 aa, Homo sapiens
  Payload ID: 9113
  Gene Symbol: L3MBTL4
  Gene Name: l(3)mbt-like 4 (Drosophila)
  ENSP ID: ENSP00000462090
MKQPNRKRKLNMDSKERLDQDGRLEQAEEEKKPKDSTTPLSHVPSAAAQGAWSWEWYLKEQKAVAAPVELFSKDQSFPEHENGFQIGMRLEGIDPRHPSVFCVLSVAEVCGYRLRLHFDGYL

SEQ ID NO: 44730 - protein, 80 aa, Homo sapiens
  Payload ID: 9113
  Gene Symbol: L3MBTL4
  Gene Name: l(3)mbt-like 4 (Drosophila)
  ENSP ID: ENSP00000462295
MKQPNRKRKLNMDSKERLDQDGRLEQAEEEKKPKDSTTPLSHVPSAAAQGAWSWEWYLKEQKAVAAPVELFSKDQSFPEH

SEQ ID NO: 44731 - protein, 208 aa, Homo sapiens
  Payload ID: 9113
  Gene Symbol: L3MBTL4
  Gene Name: l(3)mbt-like 4 (Drosophila)
  ENSP ID: ENSP00000463600
MKQPNRKRKLNMDSKERLDQDGRLEQAEEEKKPKDSTTPLSHVPSAAAQGAWSWEWYLKEQKAVAAPVELFSKDQSFPEHENGFQIGMRLEGIDPRHPSVFCVLSVAEVCGYRLRLHFDGYLSCYDFWTNAGSPDIHPVGWCEKTKHELHIPKGYRKDKFVWMDYLKACKLQNAPKKLFRNRSPNGPMSKEFQVGMKLEAVDRKNPSL

SEQ ID NO: 44732 - protein, 1248 aa, Homo sapiens
  Payload ID: 9114
  Gene Symbol: L1CAM
  Gene Name: L1 cell adhesion molecule
  Uniprot ID: P32004
  ENSP ID: ENSP00000354712
MVVALRYVWPLLLCSPCLLIQIPEELMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYSDNEEKAFGSSQPSLNGDIKPLGSDDSLADYGGSVDVQFNEDGSFIGQYSGKKEKEAAGGNDSSGATSPINPAVALE

SEQ ID NO: 44733 - protein, 1253 aa, Homo sapiens
  Payload ID: 9114
  Gene Symbol: L1CAM
  Gene Name: L1 cell adhesion molecule
  Uniprot ID: P32004
  ENSP ID: ENSP00000355380
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYSDNEEKAFGSSQPSLNGDIKPLGSDDSLADYGGSVDVQFNEDGSFIGQYSGKKEKEAAGGNDSSGATSPINPAVALE

SEQ ID NO: 44734 - protein, 1248 aa, Homo sapiens; identical to SEQ ID NO: 44732
  Payload ID: 9114
  Gene Symbol: L1CAM
  Gene Name: L1 cell adhesion molecule
  Uniprot ID: P32004
  ENSP ID: ENSP00000359072

SEQ ID NO: 44735 - protein, 153 aa, Homo sapiens
  Payload ID: 9114
  Gene Symbol: L1CAM
  Gene Name: L1 cell adhesion molecule
  ENSP ID: ENSP00000359075
EEKGGASLSPQYVSYNQSSYTQWDLQPDTDYEIHLFKERMFRHQMAVKTNGTVKDKEDTQVDSEARPMKDETFGEYSDNEEKAFGSSQPSLNGDIKPLGSDDSLADYGGSVDVQFNEDGSFIGQYSGKKEKEAAGGNDSSGATSPINPAVALE

SEQ ID NO: 44736 - protein, 1257 aa, Homo sapiens
  Payload ID: 9114
  Gene Symbol: L1CAM
  Gene Name: L1 cell adhesion molecule
  Uniprot ID: P32004
  ENSP ID: ENSP00000359077
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYRSLESDNEEKAFGSSQPSLNGDIKPLGSDDSLADYGGSVDVQFNEDGSFIGQYSGKKEKEAAGGNDSSGATSPINPAVALE

SEQ ID NO: 44737 - protein, 128 aa, Homo sapiens
  Payload ID: 9114
  Gene Symbol: L1CAM
  Gene Name: L1 cell adhesion molecule
  ENSP ID: ENSP00000384902
MVVALRYVWPLLLCSPCLLIQIPEELMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAE

SEQ ID NO: 44738 - protein, 90 aa, Homo sapiens
  Payload ID: 9114
  Gene Symbol: L1CAM
  Gene Name: L1 cell adhesion molecule
  ENSP ID: ENSP00000392524
MVVALRYVWPLLLCSPCLLIQIPEELMEPPVITEQSPRRLVVFPTDDISLKCEASGKPEVQFRWTRDGVHFKPKEELGVTVYQSPHSGSF

SEQ ID NO: 44739 - protein, 83 aa, Homo sapiens
  Payload ID: 9114
  Gene Symbol: L1CAM
  Gene Name: L1 cell adhesion molecule
  ENSP ID: ENSP00000396079
MVVALRYVWPLLLCSPCLLIQIPEEYEGHHVMEPPVITEQSPRRLVVFPTDDISLKCEASGKPEVQFRWTRDGVHFKPKEELG

SEQ ID NO: 44740 - protein, 190 aa, Homo sapiens
  Payload ID: 9114
  Gene Symbol: L1CAM
  Gene Name: L1 cell adhesion molecule
  ENSP ID: ENSP00000397792
  MOD_RES (1)..(1): Any amino acid
XDPSLQPSITWRGDGRDLQELGDSDKYFIEDGRLVIHSLDYSDQGNYSCVASTELDVVESRAQLLVVEYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVS

SEQ ID NO: 44741 - protein, 150 aa, Homo sapiens
  Payload ID: 9114
  Gene Symbol: L1CAM
  Gene Name: L1 cell adhesion molecule
  ENSP ID: ENSP00000402407
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEE

SEQ ID NO: 44742 - protein, 441 aa, Homo sapiens
  Payload ID: 9115
  Gene Symbol: L2HGDH
  Gene Name: L-2-hydroxyglutarate dehydrogenase
  ENSP ID: ENSP00000261699
MVPALRYLVGACGRARGLFAGGSPGACGFASGRPRPLCGGSRSASTSSFDIVIVGGGIVGLASARALILRHPSLSIGVLEKEKDLAVHQTGHNSGVIHSGIYYKPESLKAKLCVQGAALLYEYCQQKGISYKQCGKLIVAVEQEEIPRLQALYEKGLQNGVPGLRLIQQEDIKKKEPYCRGLMAIDCPHTGIVDYRQVALSFAQDFQEAGGSVLTNFEVKGIEMAKESPSRSIDGMQYPIVIKNTKGEEIRCQYVVTCAGLYSDRISELSGCTPDPRIVPFRGDYLLLKPEKCYLVKGNIYPVPDSRFPFLGVHFTPRMDGSIWLGPNAVLAFKREGYRPFDFSATDVMDIIINSGLIKLASQNFSYGVTEMYKACFLGATVKYLQKFIPEITISDILRQVAVRGPSWLWQQPMKVSDNNIYCFLWRCFALLLTGSACSFK

SEQ ID NO: 44743 - protein, 463 aa, Homo sapiens
  Payload ID: 9115
  Gene Symbol: L2HGDH
  Gene Name: L-2-hydroxyglutarate dehydrogenase
  Uniprot ID: Q9H9P8
  ENSP ID: ENSP00000267436
MVPALRYLVGACGRARGLFAGGSPGACGFASGRPRPLCGGSRSASTSSFDIVIVGGGIVGLASARALILRHPSLSIGVLEKEKDLAVHQTGHNSGVIHSGIYYKPESLKAKLCVQGAALLYEYCQQKGISYKQCGKLIVAVEQEEIPRLQALYEKGLQNGVPGLRLIQQEDIKKKEPYCRGLMAIDCPHTGIVDYRQVALSFAQDFQEAGGSVLTNFEVKGIEMAKESPSRSIDGMQYPIVIKNTKGEEIRCQYVVTCAGLYSDRISELSGCTPDPRIVPFRGDYLLLKPEKCYLVKGNIYPVPDSRFPFLGVHFTPRMDGSIWLGPNAVLAFKREGYRPFDFSATDVMDIIINSGLIKLASQNFSYGVTEMYKACFLGATVKYLQKFIPEITISDILRGPAGVRAQALDRDGNLVEDFVFDAGVGDIGNRILHVRNAPSPAATSSIAISGMIADEVQQRFEL

SEQ ID NO: 44744 - protein, 463 aa, Homo sapiens; identical to SEQ ID NO: 44743
  Payload ID: 9115
  Gene Symbol: L2HGDH
  Gene Name: L-2-hydroxyglutarate dehydrogenase
  Uniprot ID: Q9H9P8
  ENSP ID: ENSP00000405559

SEQ ID NO: 44745 - protein, 236 aa, Homo sapiens
  Payload ID: 9115
  Gene Symbol: L2HGDH
  Gene Name: L-2-hydroxyglutarate dehydrogenase
  ENSP ID: ENSP00000450494
MVPALRYLVGACGRARGLFAGGSPGACGFASGRPRPLCGGSRSASTSSFDIVIVGGGIVGLASARALILRHPSLSIGVLEKEKDLAVHQTGHNSGVIHSGIYYKPESLKAKLCVQGAALLYEYCQQKGISYKQCGKLIVAVEQEEIPRLQALYEKGLQNGVPGLRLIQQEDIKKKEPYCRGLMAIDCPHTGIVDYRQVALSFAQDFQEAGGSVLTNFEVKGIEMAKESPSRSIDAE

SEQ ID NO: 44746 - protein, 66 aa, Homo sapiens
  Payload ID: 9115
  Gene Symbol: L2HGDH
  Gene Name: L-2-hydroxyglutarate dehydrogenase
  ENSP ID: ENSP00000451194
MVPALRYLVGACGRARGLFAGGSPGACGFASGRPRPLCGGSRSASTRRNSLCEGCKAWRGFGYFDD

SEQ ID NO: 44747 - protein, 211 aa, Homo sapiens
  Payload ID: 9115
  Gene Symbol: L2HGDH
  Gene Name: L-2-hydroxyglutarate dehydrogenase
  ENSP ID: ENSP00000452483
MVPALRYLVGACGRARGLFAGGSPGACGFASGRPRPLCGGSRSASTSSFDIVIVGGGIVGLASARALILRHPSLSIGVLEKEKDLAVHQTGHNSGVIHSGIYYKPESLKAKLCVQGAALLYEYCQQKGISYKQCGKLIVAVEQEEIPRLQALYEKGLQNGVPGLRLIQQEDIKKKEPYCRISSCVSITYQKTIIFPLCCSIAFMISGSNGY

SEQ ID NO: 44748 - protein, 131 aa, Homo sapiens
  Payload ID: 9116
  Gene Symbol:
  Gene Name: L34079.2
  ENSP ID: ENSP00000472698
  MOD_RES (1)..(1): Any amino acid
XRPPPLTQRTTTPSSSSPLGPPLRRTGPRSRPCCYQMRLLSACAQTARARIRSVWEKLEKEEQIHSVDIGNDGSAFVEVLVGSSAGGAGEQDYEVLLVTSSFMSPSESRSGSNPNRVRMFGPDKLVRAAAE

SEQ ID NO: 44749 - protein, 354 aa, Homo sapiens
  Payload ID: 9117
  Gene Symbol: L3HYPDH
  Gene Name: L-3-hydroxyproline dehydratase (trans-)
  Uniprot ID: Q96EM0
  ENSP ID: ENSP00000247194
MESALAVPRLPPHDPGTPVLSVVDMHTGGEPLRIVLAGCPEVSGPTLLAKRRYMRQHLDHVRRRLMFEPRGHRDMYGAVLVPSELPDAHLGVLFLHNEGYSSMCGHAVLALGRFALDFGLVPAPPAGTREARVNIHCPCGLVTAFVACEDGRSHGPVRFHSVPAFVLATDLMVDVPGHGKVMVDIAYGGAFYAFVTAEKLGLDICSAKTRDLVDAASAVTEAVKAQFKINHPDSEDLAFLYGTILTDGKDAYTKEPTTNICVFADEQVDRSPTGSGVTARIALQYHKGLLELNQMRAFKSSATGSVFTGKAVREAKCGDFKAVIVEVSGQAHYTGTASFIIEDDDPLRDGFLLK

SEQ ID NO: 44750 - protein, 142 aa, Homo sapiens
  Payload ID: 9117
  Gene Symbol: L3HYPDH
  Gene Name: L-3-hydroxyproline dehydratase (trans-)
  ENSP ID: ENSP00000423874
MVDVPGHGKVMVDIAYGGAFYAFVTAEKLGLDICSAKTRDLVDAASAVTEAVKAQFKINHPDSEDLAFLYGTILTDGKDAYTKEPTTNICVFADEQVDRSPTGSGVTARIALQYHKGLLELNQMRAFKSSATGSVFTGKAVR

SEQ ID NO: 44751 - protein, 145 aa, Homo sapiens
  Payload ID: 9117
  Gene Symbol: L3HYPDH
  Gene Name: L-3-hydroxyproline dehydratase (trans-)
  ENSP ID: ENSP00000431608
MVDVPGHGKVMVDIAYGGAFYAFVTAEKLGLDICSAKTRDLVDAASAVTEAVKAQFKINHPDSEDLAFLYGTILTDGKDAYTKEPTTNICVFADEQVDRSPTGSGVTARIALQYHKGLLELNQMRAFKSSATGSVFTGKAVRELL

SEQ ID NO: 44752 - protein, 1019 aa, Homo sapiens
  Payload ID: 9118
  Gene Symbol: LARP1
  Gene Name: La ribonucleoprotein domain family, member 1
  Uniprot ID: Q6PKG0
  ENSP ID: ENSP00000336721
MLWRVLLSKRPPFPHPELDFQEAPIPSCPGRLPGRKNSVALAAAPRKEPTGDREKPLPFPVLAPFSNPEHSAPAKVVRAAVPKQRKGSKVGDFGDAINWPTPGEIAHKSVQPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAGGARASFRGRGRGRGRGRGRGRGGTRTHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMPRKRKTRHSSNPPLESHVGWVMDSREHRPRTASISSSPSEGTPTVGSYGCTPQSLPKFQHPSHELLKENGFTQHVYHKYRRRCLNERKRLGIGQSQEMNTLFRFWSFFLRDHFNKKMYEEFKQLALEDAKEGYRYGLECLFRYYSYGLEKKFRLDIFKDFQEETVKDYEAGQLYGLEKFWAFLKYSKAKNLDIDPKLQEYLGKFRRLEDFRVDPPMGEEGNHKRHSVVAGGGGGEGRKRCPSQSSSRPAAMISQPPTPPTGQPVREDAKWTSQHSNTQTLGK

SEQ ID NO: 44753 - protein, 150 aa, Homo sapiens
  Payload ID: 9118
  Gene Symbol: LARP1
  Gene Name: La ribonucleoprotein domain family, member 1
  ENSP ID: ENSP00000427731
  MOD_RES (1)..(1): Any amino acid
XRGGQKKKGNKHKWVPLQIDMKPEVPREKLASRPTRPPEPRHIPANRGEIKGSESATYVPVAPPTPAWQPEIKPEPAWHDQDETSSVKSDGAAHFDYQFGYRKFDGVEGPRTPKYMNNITYYFDNVSSTELYSVDQELLKDYIKRQIEYY

SEQ ID NO: 44754 - protein, 61 aa, Homo sapiens
  Payload ID: 9118
  Gene Symbol: LARP1
  Gene Name: La ribonucleoprotein domain family, member 1
  ENSP ID: ENSP00000428251
  MOD_RES (1)..(1): Any amino acid
XNGQSPPEHSAPAKVVRAAVPKQRKGSKVGDFGDAINWPTPGEIAHKSVQMKLLRLAEVNY

SEQ ID NO: 44755 - protein, 815 aa, Homo sapiens
  Payload ID: 9118
  Gene Symbol: LARP1
  Gene Name: La ribonucleoprotein domain family, member 1
  ENSP ID: ENSP00000428589
MATQVEPLLPGGATLLQAEEHGGLVRKKPPPAPEGKGEPGPNDVRGGEPDGSARRPRPPCAKPHKEGTGQQERESPRPLQLPGAEGPAISDGEEGGGEPGAGGGAAGAAGAGRRDFVEAPPPKVNPWTKNALPPVLTTVNGQSPPEHSAPAKVVRAAVPKQRKGSKVGDFGDAINWPTPGEIAHKSVQPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAGGARASFRGRGRGRGRGRGRGRGGTRTHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMP

SEQ ID NO: 44756 - protein, 67 aa, Homo sapiens
  Payload ID: 9118
  Gene Symbol: LARP1
  Gene Name: La ribonucleoprotein domain family, member 1
  ENSP ID: ENSP00000429624
  MOD_RES (1)..(1): Any amino acid
XGAEGPAISDGEEGGGEPGAGGGAAGAAGAGRRDFVEAPPPKVNPWTKNALPPVLTTVNGQSPPDTL

SEQ ID NO: 44757 - protein, 92 aa, Homo sapiens
  Payload ID: 9118
  Gene Symbol: LARP1
  Gene Name: La ribonucleoprotein domain family, member 1
  ENSP ID: ENSP00000429710
MKEQEKGEGSDSKESPKTKSDESGEEKNGDEDCQRGGQKKKGNKHKWVPLQIDMKPEVPREKLASRPTRPPEPRHIPANRGEIKGSESATYV

SEQ ID NO: 44758 - protein, 167 aa, Homo sapiens
  Payload ID: 9118
  Gene Symbol: LARP1
  Gene Name: La ribonucleoprotein domain family, member 1
  ENSP ID: ENSP00000429852
  MOD_RES (1)..(1): Any amino acid
XRPLQLPGAEGPAISDGEEGGGEPGAGGGAAGAAGAGRRDFVEAPPPKVNPWTKNALPPVLTTVNGQSPPEHSAPAKVVRAAVPKQRKGSKPQSHKPQPTRKLPPKKDMKEQEKGEGSDSKESPKTKSDESGEEKNGDEDCQRGGQKKKGNKHKWVPLQIDMKPEVP

SEQ ID NO: 44759 - protein, 610 aa, Homo sapiens
  Payload ID: 9118
  Gene Symbol: LARP1
  Gene Name: La ribonucleoprotein domain family, member 1
  ENSP ID: ENSP00000429904
MKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAGGARASFRGRGRGRGRGRGRGRGGTRTHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMP

SEQ ID NO: 44760 - protein, 36 aa, Homo sapiens
  Payload ID: 9118
  Gene Symbol: LARP1
  Gene Name: La ribonucleoprotein domain family, member 1
  ENSP ID: ENSP00000430169
  MOD_RES (1)..(1): Any amino acid
XRHSSNPPLESHVGWVMDSREHRPRTASIRDGTDCK

SEQ ID NO: 44761 - protein, 281 aa, Homo sapiens
  Payload ID: 9118
  Gene Symbol: LARP1
  Gene Name: La ribonucleoprotein domain family, member 1
  ENSP ID: ENSP00000430438
DESGEEKNGDEDCQRGGQKKKGNKHKWVPLQIDMKPEVPREKLASRPTRPPEPRHIPANRGEIKAHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKK

SEQ ID NO: 44762 - protein, 183 aa, Homo sapiens
  Payload ID: 9118
  Gene Symbol: LARP1
  Gene Name: La ribonucleoprotein domain family, member 1
  ENSP ID: ENSP00000430815
  MOD_RES (1)..(1): Any amino acid
XQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMPRKRKTRHSSNPPLESHVGWVMDSREHRPRTASISKMAPVCVSCFPKQALRATYL

SEQ ID NO: 44763 - protein, 195 aa, Homo sapiens
  Payload ID: 9118
  Gene Symbol: LARP1
  Gene Name: La ribonucleoprotein domain family, member 1
  ENSP ID: ENSP00000431072
ELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETVTPVPTKTEEVSNLKTLPKGLSASLPDLDSENWIEVKKRPRPSPARPKKSEESRFSHLTSLPQQLPSQQLMSK

SEQ ID NO: 44764 - protein, 914 aa, Homo sapiens
  Payload ID: 9119
  Gene Symbol: LARP1B
  Gene Name: La ribonucleoprotein domain family, member 1B
  Uniprot ID: Q659C4
  ENSP ID: ENSP00000321997
MENWPTPSELVNTGFQSVLSQGNKKPQNRKEKEEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTESAPNSPRIGSPLSPKKNSETSILQAMSRGLSTSLPDLDSEPWIEVKKRHQPAPVKLRESVSVPEGSLNQLCSSEEPEQEELDFLFDEEIEQIGRKNTFTDWSDNDSDYEIDDQDLNKILIVTQTPPYVKKHPGGDRTGTHMSRAKITSELAKVINDGLYYYEQDLWMEEDENKHTAIKQEVENFKKLNLISKEQFENLTPELPFEPNQEVPVAPSQSRQGGVQGVLHIPKKDLTDELAQKLFDVSEITSAAMVHSLPTAVPESPRIHPTRTPKTPRTPRLQDPNKTPRFYPVVKEPKAIDVKSPRKRKTRHSTNPPLECHVGWVMDSRDRGPGTSSVSTSNASPSEGAPLAGSYGCTPHSFPKFQHPSHELLKENGFTQQVYHKYRRRCLSERKRLGIGQSQEMNTLFRFWSFFLRDHFNKKMYEEFRQLAWEDAKENYRYGLECLFRFYSYGLEKKFRREIFQDFQEETKKDYESGQLYGLEKFWAYLKYSQSKTQSIDPKLQEYLCSFKRLEDFRVDPPISDEFGRKRHSSTSGEESNRHRLPPNSSTKPPNAAKPTSTSELQVPINSPRRNISPESSDNSH

SEQ ID NO: 44765 - protein, 335 aa, Homo sapiens
  Payload ID: 9119
  Gene Symbol: LARP1B
  Gene Name: La ribonucleoprotein domain family, member 1B
  Uniprot ID: Q659C4
  ENSP ID: ENSP00000377829
MENWPTPSELVNTGFQSVLSQGNKKPQNRKEKEEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTVRVMIF

SEQ ID NO: 44766 - protein, 358 aa, Homo sapiens
  Payload ID: 9119
  Gene Symbol: LARP1B
  Gene Name: La ribonucleoprotein domain family, member 1B
  ENSP ID: ENSP00000390395
MENWPTPSELVNTGFQSVLSQGNKKPQNRKEKEEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTGNIFSSRANDVTVGYLVQFTYLFIYFQFI

SEQ ID NO: 44767 - protein, 518 aa, Homo sapiens
  Payload ID: 9119
  Gene Symbol: LARP1B
  Gene Name: La ribonucleoprotein domain family, member 1B
  ENSP ID: ENSP00000422850
MENWPTPSELVNTGFQSVLSQGNKKPQNRKEKEEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTESAPNSPRIGSPLSPKKNSETSILQAMSRGLSTSLPDLDSEPWIEVKKRHQPAPVKLRESVSVPEGSLNQLCSSEEPEQEELDFLFDEEIEQIGRKNTFTDWSDNDSDYEIDDQDLNKILIVTQTPPYVKKHPGGDRTGTHMSRAKITSELAKVINDGLYYYEQDLWMEEDENKHTAIKVTILRTPFLV

SEQ ID NO: 44768 - protein, 25 aa, Homo sapiens
  Payload ID: 9119
  Gene Symbol: LARP1B
  Gene Name: La ribonucleoprotein domain family, member 1B
  ENSP ID: ENSP00000423686
NDGLYYYEQDLWMEEDENKHTAIKI

SEQ ID NO: 44769 - protein, 491 aa, Homo sapiens
  Payload ID: 9119
  Gene Symbol: LARP1B
  Gene Name: La ribonucleoprotein domain family, member 1B
  ENSP ID: ENSP00000424383
  MOD_RES (1)..(1): Any amino acid
XEEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTESAPNSPRIGSPLSPKKNSETSILQAMSRGLSTSLPDLDSEPWIEVKKRHQPAPVKLRESVSVPEGSLNQLCSSEEPEQEELDFLFDEEIEQIGRKNTFTDWSDNDSDYEIDDQDLNKILIVTQTPPYVKKHPGGDRTGTHMSRAKITSELAKVINDGLYYYEQDLWMEEDENKHTAIKVIVSGQHLSTDALF

SEQ ID NO: 44770 - protein, 574 aa, Homo sapiens
  Payload ID: 9119
  Gene Symbol: LARP1B
  Gene Name: La ribonucleoprotein domain family, member 1B
  ENSP ID: ENSP00000427281
MENWPTPSELVNTGFQSVLSQGNKKPQNRKEKEEKVEKRSNSDSKENRETKLNGPGENVSEDEAQSSNQRKRGWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTESAPNSPRIGSPLSPKKNSETSILQAMSRGLSTSLPDLDSEPWIEVKKRHQPAPVKLRESVSVPEGSLNQLCSSEEPEQEELDFLFDEEIEQIGRKNTFTDWSDNDSDYEIDDQDLNKILIVTQTPPYVKKHPGGDRTGTHMSRAKITSELAKVINDGLYYYEQDLWMEEDENKHTAIKQEVENFKKLNLISKEQFENLTPELPFEPNQEVPVAPSQSRQDLTDELAQKLFDVSEITSAAMVHSLPTAVPESPRIHPTRTPKTPRTPRLQDPNKTPRFYPVVKEPKAIDVKS

SEQ ID NO: 44771 - protein, 653 aa, Homo sapiens
  Payload ID: 9120
  Gene Symbol: LARP4
  Gene Name: La ribonucleoprotein domain family, member 4
  Uniprot ID: Q71RC2
  ENSP ID: ENSP00000293618
MLLFVEQVASKGTGLNPNAKVWQEIAPGNTDATPVTHGTESSWHEIAATSGAHPEGNAELSEDICKEYEVMYSSSCETTRNTTGIEESTDGMILGPEDLSYQIYDVSGESNSAVSTEDLKECLKKQLEFCFSRENLSKDLYLISQMDSDQFIPIWTVANMEEIKKLTTDPDLILEVLRSSPMVQVDEKGEKVRPSHKRCIVILREIPETTPIEEVKGLFKSENCPKVISCEFAHNSNWYITFQSDTDAQQAFKYLREEVKTFQGKPIMARIKAINTFFAKNGYRLMDSSIYSHPIQTQAQYASPVFMQPVYNPHQQYSVYSIVPQSWSPNPTPYFETPLAPFPNGSFVNGFNSPGSYKTNAAAMNMGRPFQKNRRTLFRGRRRREDDRISRPHPSTAESKAPTPKFDLLASNFPPLPGSSSRMPGELVLENRMSDVVKGVYKEKDNEELTISCPVPADEQTECTSAQQLNMSTSSPCAAELTALSTTQQEKDLIEDSSVQKDGLNQTTIPVSPPSTTKPSRASTASPCNNNINAATAVALQEPRKLSYAEVCQKPPKEPSSVLVQPLRELRSNVVSPTKNEDNGAPENSVEKPHEKPEARASKDYSGFRGNIIPRGAAGKIREQRRQFSHRAIPQGVTRRNGKEQYVPPRSPK

SEQ ID NO: 44772 - protein, 653 aa, Homo sapiens
  Payload ID: 9120
  Gene Symbol: LARP4
  Gene Name: La ribonucleoprotein domain family, member 4
  Uniprot ID: Q71RC2
  ENSP ID: ENSP00000340901
MLLFVEQVASKGTGLNPNAKVWQEIAPGNTDATPVTHGTESSWHEIAATSGAHPEGNAELSEDICKEYEVMYSSSCETTRNTTGIEESTDGMILGPEDLSYQIYDVSGESNSAVSTEDLKECLKKQLEFCFSRENLSKDLYLISQMDSDQFIPIWTVANMEEIKKLTTDPDLILEVLRSSPMVQVDEKGEKVRPSHKRCIVILREIPETTPIEEVKGLFKSENCPKVISCEFAHNSNWYITFQSDTDAQQAFKYLREEVKTFQGKPIMAPFPNGSFVNGFNSPGSYKTNAAAMNMGRPFQKNRVKPQFRSSGGSEHSTEGSVSLGDGQLNRYSSRNFPAERHNPTVTGHQEQTYLQKETSTLQVEQNGDYGRGRRTLFRGRRRREDDRISRPHPSTAESKAPTPKFDLLASNFPPLPGSSSRMPGELVLENRMSDVVKGVYKEKDNEELTISCPVPADEQTECTSAQQLNMSTSSPCAAELTALSTTQQEKDLIEDSSVQKDGLNQTTIPVSPPSTTKPSRASTASPCNNNINAATAVALQEPRKLSYAEVCQKPPKEPSSVLVQPLRELRSNVVSPTKNEDNGAPENSVEKPHEKPEARASKDYSGFRGNIIPRGAAGKIREQRRQFSHRAIPQGVTRRNGKEQYVPPRSPK

SEQ ID NO: 44773 - protein, 724 aa, Homo sapiens
  Payload ID: 9120
  Gene Symbol: LARP4
  Gene Name: La ribonucleoprotein domain family, member 4
  Uniprot ID: Q71RC2
  ENSP ID: ENSP00000381490
MLLFVEQVASKGTGLNPNAKVWQEIAPGNTDATPVTHGTESSWHEIAATSGAHPEGNAELSEDICKEYEVMYSSSCETTRNTTGIEESTDGMILGPEDLSYQIYDVSGESNSAVSTEDLKECLKKQLEFCFSRENLSKDLYLISQMDSDQFIPIWTVANMEEIKKLTTDPDLILEVLRSSPMVQVDEKGEKVRPSHKRCIVILREIPETTPIEEVKGLFKSENCPKVISCEFAHNSNWYITFQSDTDAQQAFKYLREEVKTFQGKPIMARIKAINTFFAKNGYRLMDSSIYSHPIQTQAQYASPVFMQPVYNPHQQYSVYSIVPQSWSPNPTPYFETPLAPFPNGSFVNGFNSPGSYKTNAAAMNMGRPFQKNRVKPQFRSSGGSEHSTEGSVSLGDGQLNRYSSRNFPAERHNPTVTGHQEQTYLQKETSTLQVEQNGDYGRGRRTLFRGRRRREDDRISRPHPSTAESKAPTPKFDLLASNFPPLPGSSSRMPGELVLENRMSDVVKGVYKEKDNEELTISCPVPADEQTECTSAQQLNMSTSSPCAAELTALSTTQQEKDLIEDSSVQKDGLNQTTIPVSPPSTTKPSRASTASPCNNNINAATAVALQEPRKLSYAEVCQKPPKEPSSVLVQPLRELRSNVVSPTKNEDNGAPENSVEKPHEKPEARASKDYSGFRGNIIPRGAAGKIREQRRQFSHRAIPQGVTRRNGKEQYVPPRSPK

SEQ ID NO: 44774 - protein, 730 aa, Homo sapiens
  Payload ID: 9120
  Gene Symbol: LARP4
  Gene Name: La ribonucleoprotein domain family, member 4
  Uniprot ID: Q71RC2
  ENSP ID: ENSP00000415464
MLLFVEQVASKGTGLNPNAKVWQEIAPGNTDATPVTHGTESSWHEIAATSGAHPEVSVFNTGNAELSEDICKEYEVMYSSSCETTRNTTGIEESTDGMILGPEDLSYQIYDVSGESNSAVSTEDLKECLKKQLEFCFSRENLSKDLYLISQMDSDQFIPIWTVANMEEIKKLTTDPDLILEVLRSSPMVQVDEKGEKVRPSHKRCIVILREIPETTPIEEVKGLFKSENCPKVISCEFAHNSNWYITFQSDTDAQQAFKYLREEVKTFQGKPIMARIKAINTFFAKNGYRLMDSSIYSHPIQTQAQYASPVFMQPVYNPHQQYSVYSIVPQSWSPNPTPYFETPLAPFPNGSFVNGFNSPGSYKTNAAAMNMGRPFQKNRVKPQFRSSGGSEHSTEGSVSLGDGQLNRYSSRNFPAERHNPTVTGHQEQTYLQKETSTLQVEQNGDYGRGRRTLFRGRRRREDDRISRPHPSTAESKAPTPKFDLLASNFPPLPGSSSRMPGELVLENRMSDVVKGVYKEKDNEELTISCPVPADEQTECTSAQQLNMSTSSPCAAELTALSTTQQEKDLIEDSSVQKDGLNQTTIPVSPPSTTKPSRASTASPCNNNINAATAVALQEPRKLSYAEVCQKPPKEPSSVLVQPLRELRSNVVSPTKNEDNGAPENSVEKPHEKPEARASKDYSGFRGNIIPRGAAGKIREQRRQFSHRAIPQGVTRRNGKEQYVPPRSPK

SEQ ID NO: 44775 - protein, 84 aa, Homo sapiens
  Payload ID: 9120
  Gene Symbol: LARP4
  Gene Name: La ribonucleoprotein domain family, member 4
  ENSP ID: ENSP00000428516
MYSSSCETTRNTTGIEESTDGMILGPEDLSYQIYDVSGESNSAVSTEDLKECLKKQLEFCFSRENLSKDLYLISQMDSDQFIPI

SEQ ID NO: 44776 - protein, 723 aa, Homo sapiens
  Payload ID: 9120
  Gene Symbol: LARP4
  Gene Name: La ribonucleoprotein domain family, member 4
  Uniprot ID: Q71RC2
  ENSP ID: ENSP00000429077
MLLFVEVASKGTGLNPNAKVWQEIAPGNTDATPVTHGTESSWHEIAATSGAHPEGNAELSEDICKEYEVMYSSSCETTRNTTGIEESTDGMILGPEDLSYQIYDVSGESNSAVSTEDLKECLKKQLEFCFSRENLSKDLYLISQMDSDQFIPIWTVANMEEIKKLTTDPDLILEVLRSSPMVQVDEKGEKVRPSHKRCIVILREIPETTPIEEVKGLFKSENCPKVISCEFAHNSNWYITFQSDTDAQQAFKYLREEVKTFQGKPIMARIKAINTFFAKNGYRLMDSSIYSHPIQTQAQYASPVFMQPVYNPHQQYSVYSIVPQSWSPNPTPYFETPLAPFPNGSFVNGFNSPGSYKTNAAAMNMGRPFQKNRVKPQFRSSGGSEHSTEGSVSLGDGQLNRYSSRNFPAERHNPTVTGHQEQTYLQKETSTLQVEQNGDYGRGRRTLFRGRRRREDDRISRPHPSTAESKAPTPKFDLLASNFPPLPGSSSRMPGELVLENRMSDVVKGVYKEKDNEELTISCPVPADEQTECTSAQQLNMSTSSPCAAELTALSTTQQEKDLIEDSSVQKDGLNQTTIPVSPPSTTKPSRASTASPCNNNINAATAVALQEPRKLSYAEVCQKPPKEPSSVLVQPLRELRSNVVSPTKNEDNGAPENSVEKPHEKPEARASKDYSGFRGNIIPRGAAGKIREQRRQFSHRAIPQGVTRRNGKEQYVPPRSPK

SEQ ID NO: 44777 - protein, 491 aa, Homo sapiens
  Payload ID: 9120
  Gene Symbol: LARP4
  Gene Name: La ribonucleoprotein domain family, member 4
  ENSP ID: ENSP00000429631
EVKGLFKSENCPKVISCEFAHNSNWYITFQSDTDAQQAFKYLREEVKTFQGKPIMARIKAINTFFAKNGYRLMDSSIYSHPIQTQAQYASPVFMQPVYNPHQQYSVYSIVPQSWSPNPTPYFETPLAPFPNGSFVNGFNSPGSYKTNAAAMNMGRPFQKNRVKPQFRSSGGSEHSTEGSVSLGDGQLNRYSSRNFPAERHNPTVTGHQEQTYLQKETSTLQVEQNGDYGRGRRTLFRGRRRREDDRISRPHPSTAESKAPTPKFDLLASNFPPLPGSSSRMPGELVLENRMSDVVKGVYKEKDNEELTISCPVPADEQTECTSAQQLNMSTSSPCAAELTALSTTQQEKDLIEDSSVQKDGLNQTTIPVSPPSTTKPSREPRKLSYAEVCQKPPKEPSSVLVQPLRELRSNVVSPTKNEDNGAPENSVEKPHEKPEARASKDYSGFRGNIIPRGAAGKIREQRRQFSHRAIPQGVTRRNGKEQYVPPRSPK

SEQ ID NO: 44778 - protein, 445 aa, Homo sapiens
  Payload ID: 9120
  Gene Symbol: LARP4
  Gene Name: La ribonucleoprotein domain family, member 4
  Uniprot ID: Q71RC2
  ENSP ID: ENSP00000429781
MLLFVEQVASKGTGLNPNAKVWQEIAPGNTDATPVTHGTESSWHEIAATSGAHPEGNAELSEDICKEYEVMYSSSCETTRNTTGIEESTDGMILGPEDLSYQIYDVSGESNSAVSTEDLKECLKKQLEFCFSRENLSKDLYLISQMDSDQFIPIWTVANMEEIKKLTTDPDLILEVLRSSPMVQVDEKGEKVRPSHKRCIVILREIPETTPIEEVKGLFKSENCPKVISCEFAHNSNWYITFQSDTDAQQAFKYLREEVKTFQGKPIMARIKAINTFFAKNGYRLMDSSIYSHPIQTQAQYASPVFMQPVYNPHQQYSVYSIVPQSWSPNPTPYFETPLAPFPNGSFVNGFNSPGSYKTNAAAMNMGRPFQKNRVKPQFRSSGGSEHSTEGSVSLGDGQLNRYSSRNFPAERHNPTVTGHQEQTYLQKETSTLQVEQNGDYGRGR

SEQ ID NO: 44779 - protein, 37 aa, Homo sapiens
  Payload ID: 9120
  Gene Symbol: LARP4
  Gene Name: La ribonucleoprotein domain family, member 4
  ENSP ID: ENSP00000430551
MYSSSCETTRNTTGIEESTDGMILGPEDLSYQIYDVS

SEQ ID NO: 44780 - protein, 375 aa, Homo sapiens
  Payload ID: 9120
  Gene Symbol: LARP4
  Gene Name: La ribonucleoprotein domain family, member 4
  ENSP ID: ENSP00000430851
MYSSSCETTRNTTGIEESTDGMILGPEDLSYQIYDVSGESNSAVSTEDLKECLKKQLEFCFSRENLSKDLYLISQMDSDQFIPIWTVANMEEIKKLTTDPDLILEVLRSSPMVQVDEKGEKVRPSHKRCIVILREIPETTPIEEVKGLFKSENCPKVISCEFAHNSNWYITFQSDTDAQQAFKYLREEVKTFQGKPIMARIKAINTFFAKNGYRLMDSSIYSHPIQTQAQYASPVFMQPVYNPHQQYSVYSIVPQSWSPNPTPYFETPLAPFPNGSFVNGFNSPGSYKTNAAAMNMGRPFQKNRVKPQFRSSGGSEHSTEGSVSLGDGQLNRYSSRNFPAERHNPTVTGHQEQTYLQKETSTLQVEQNGDYGRGR

SEQ ID NO: 44781 - protein, 115 aa, Homo sapiens
  Payload ID: 9120
  Gene Symbol: LARP4
  Gene Name: La ribonucleoprotein domain family, member 4
  ENSP ID: ENSP00000446540
MDGMLAIQACPTPQQVASKGTGLNPNAKVWQEIAPGNTDATPVTHGTESSWHEIAATSGAHPEGNAELSEDICKEYEVMYSSSCETTRNTTGIEESTDGMILGPEDLSYQIYDVS

SEQ ID NO: 44782 - protein, 125 aa, Homo sapiens
  Payload ID: 9120
  Gene Symbol: LARP4
  Gene Name: La ribonucleoprotein domain family, member 4
  ENSP ID: ENSP00000446966
MYSSSCETTRNTTGIEESTDGMILGPEDLSYQIYDVSGESNSAVSTEDLKECLKKQLEFCFSRENLSKDLYLISQMDSDQFIPIWTVANMEEIKKLTTDPDLILEVLRSSPMVQVDEKGEKVRPS

SEQ ID NO: 44783 - protein, 61 aa, Homo sapiens
  Payload ID: 9120
  Gene Symbol: LARP4
  Gene Name: La ribonucleoprotein domain family, member 4
  ENSP ID: ENSP00000447397
MYSSSCETTRNTTGIEESTDGMILGPEDLSYQIYDVSGESNSAVSTEDLKECLKKQLEFCF

SEQ ID NO: 44784 - protein, 169 aa, Homo sapiens
  Payload ID: 9120
  Gene Symbol: LARP4
  Gene Name: La ribonucleoprotein domain family, member 4
  ENSP ID: ENSP00000447408
MLLFVEQVASKGTGLNPNAKVWQEIAPGNTDATPVTHGTESSWHEIAATSGAHPEGNAELSEDICKEYEVMYSSSCETTRNTTGIEESTDGMILGPEDLSYQIYDVSESNSAVSTEDLKECLKKQLEFCFSRENLSKDLYLISQMDSDQFIPIWTVANMEEIKKLTTDP

SEQ ID NO: 44785 - protein, 56 aa, Homo sapiens
  Payload ID: 9120
  Gene Symbol: LARP4
  Gene Name: La ribonucleoprotein domain family, member 4
  ENSP ID: ENSP00000448180
MYSSSCETTRNTTGIEESTDGMILGPEDLSYQIYDVSGESNSAVSTEDLKECLKKQ

SEQ ID NO: 44786 - protein, 191 aa, Homo sapiens
  Payload ID: 9120
  Gene Symbol: LARP4
  Gene Name: La ribonucleoprotein domain family, member 4
  ENSP ID: ENSP00000448756
MLLFVEVASKGTGLNPNAKVWQEIAPGNTDATPVTHGTESSWHEIAATSGAHPEGNAELSEDICKEYEVMYSSSCETTRNTTGIEESTDGMILGPEDLSYQIYDVSESNSAVSTEDLKECLKKQLEFCFSRENLSKDLYLISQMDSDQFIPIWTVANMEEIKKLTTDPDLILEVLRSSPMVQVDEKGEKVR

SEQ ID NO: 44787 - protein, 36 aa, Homo sapiens
  Payload ID: 9120
  Gene Symbol: LARP4
  Gene Name: La ribonucleoprotein domain family, member 4
  ENSP ID: ENSP00000449090
MYSSSCETTRNTTGIEESTDGMILGPEDLSYQIYDV

SEQ ID NO: 44788 - protein, 374 aa, Homo sapiens [sequence omitted]

SEQ ID NO: 44789 - protein, 188 aa, Homo sapiens [sequence omitted]

SEQ ID NO: 44790 - protein, 188 aa, Homo sapiens
  Payload ID: 9120
  Gene Symbol: LARP4
  Gene Name: La ribonucleoprotein domain family, member 4
  ENSP ID: ENSP00000482977
MYSSSCETTRNTTGIEESTDGMILGPEDLSYQIYDVSGESNSAVSTEDLKECLKKQLEFCFSRENLSKDLYLISQMDSDQFIPIWTVANMEEIKKLTTDPDLILEVLRSSPMVQVDEKGEKVRPSHKRCIVILREIPETTPIEEVKGLFKSENCPKVISCEFAHNSNWYITFQSDTDAQQAFILKRRS

SEQ ID NO: 44791 - protein, 738 aa, Homo sapiens
  Payload ID: 9121
  Gene Symbol: LARP4B
  Gene Name: La ribonucleoprotein domain family, member 4B
  Uniprot ID: Q92615
  ENSP ID: ENSP00000326128
MTSDQDAKVVAEPQTQRVQEGKDSAHLMNGPISQTTSQTSSIPPLSQVPATKVSELNPNAEVWGAPVLHLEASSAADGVSAAWEEVAGHHADRGPQGSDANGDGDQGHENAALPDPQESDPADMNALALGPSEYDSLPENSETGGNESQPDSQEDPREVLKKTLEFCLSRENLASDMYLISQMDSDQYVPITTVANLDHIKKLSTDVDLIVEVLRSLPLVQVDEKGEKVRPNQNRCIVILREISESTPVEEVEALFKGDNLPKFINCEFAYNDNWFITFETEADAQQAYKYLREEVKTFQGKPIKARIKAKAIAINTFLPKNGFRPLDVSLYAQQRYATSFYFPPMYSPQQQFPLYSLITPQTWSATHSYLDPPLVTPFPNTGFINGFTSPAFKPAASPLTSLRQYPPRSRNPSKSHLRHAIPSAERGPGLLESPSIFNFTADRLINGVRSPQTRQAGQTRTRIQNPSAYAKREAGPGRVEPGSLESSPGLGRGRKNSFGYRKKREEKFTSSQTQSPTPPKPPSPSFELGLSSFPPLPGAAGNLKTEDLFENRLSSLIIGPSKERTLSADASVNTLPVVVSREPSVPASCAVSATYERSPSPAHLPDDPKVAEKQRETHSVDRLPSALTATACKSVQVNGAATELRKPSYAEICQRTSKEPPSSPLQPQKEQKPNTVGCGKEEKKLAEPAERYREPPALKSTPGAPRDQRRPAGGRPSPSAMGKRLSREQSTPPKSPQ

SEQ ID NO: 44792 - protein, 131 aa, Homo sapiens
  Payload ID: 9121
  Gene Symbol: LARP4B
  Gene Name: La ribonucleoprotein domain family, member 4B
  ENSP ID: ENSP00000385229
MTSDQDAKVVAEPQTQRVQEGKDSAHLMNGPISQTTSQTSSIPPLSQVPATKVSELNPNAEVWGAPVLHLEASSAADGVSAAWEEVAGHHADRGPQGSDANGDGDQGHENAALPDPQESDPADMNALALGP

SEQ ID NO: 44793 - protein, 57 aa, Homo sapiens
  Payload ID: 9121
  Gene Symbol: LARP4B
  Gene Name: La ribonucleoprotein domain family, member 4B
  ENSP ID: ENSP00000390556
MTSDQDAKVVAEPQTQRVQEGKDSAHLMNGPISQTTSQTSSIPPLSQVPATKVSELN

SEQ ID NO: 44794 - protein, 339 aa, Homo sapiens
  Payload ID: 9121
  Gene Symbol: LARP4B
  Gene Name: La ribonucleoprotein domain family, member 4B
  ENSP ID: ENSP00000394545
  MOD_RES (1)..(1): Any amino acid
XSIFNFTADRLINGVRSPQTRQAGQTRTRIQNPSAYAKREAGPGRVEPGSLESSPGLGRGRKNSFGYRKKREEKFTSSQTQSPTPPKPPSPSFELGLSSFPPLPGAAGNLKTEDLFENRLSSLIIGPSKERTLSADASVNTLPVVVSREPSVPASCAVSATYERSPSPAHLPDDPKVAEKQRETHSVDRLPSALTATACKSVQVNGAATVRTSCLPSCTTAARLWCEQTLRTPAPARFLITSNLELRKPSYAEICQRTSKEPPSSPLQPQKEQKPNTVGCGKEEKKLAEPAERYREPPALKSTPGAPRDQRRPAGGRPSPSAMGKRLSREQSTPPKSPQ

SEQ ID NO: 44795 - protein, 190 aa, Homo sapiens
  Payload ID: 9121
  Gene Symbol: LARP4B
  Gene Name: La ribonucleoprotein domain family, member 4B
  ENSP ID: ENSP00000403018
  MOD_RES (1)..(1): Any amino acid
XSFELGLSSFPPLPGAAGNLKTEDLFENRLSSLIIGPSKERTLSADASVNTLPVVVSREPSVPASCAVSATYERSPSPAHLPDDPKVAEKQRETHSVDRLPSALTATACKSVQVNGAATVRTSCLPSCTTAARLWCEQTLRTPAPARFLITSNLVGFYLRLSVLCFLYKIPLIFANNFPLTTLVLSQTTM

SEQ ID NO: 44796 - protein, 79 aa, Homo sapiens
  Payload ID: 9121
  Gene Symbol: LARP4B
  Gene Name: La ribonucleoprotein domain family, member 4B
  ENSP ID: ENSP00000476786
MTSDQDAKVVAEPQTQRVQEGKDSAHLMNGPISQTTSQTSSIPPLSQKTLLSYRCQRTVLFGDGMIETDSSYQQLRFQS

SEQ ID NO: 44797 - protein, 738 aa, Homo sapiens; identical to SEQ ID NO: 44791
  Payload ID: 9121
  Gene Symbol: LARP4B
  Gene Name: La ribonucleoprotein domain family, member 4B
  Uniprot ID: Q92615
  ENSP ID: ENSP00000482767

SEQ ID NO: 44798 - protein, 153 aa, Homo sapiens
  Payload ID: 9121
  Gene Symbol: LARP4B
  Gene Name: La ribonucleoprotein domain family, member 4B
  ENSP ID: ENSP00000483973
VPASCAVSATYERSPSPAHLPDDPKVAEKQRETHSVDRLPSALTATACKSVQVNGAATELRKPSYAEICQRTSKEPPSSPLQPQKEQKPNTVGCGKEEKKLAEPAERYREPPALKSTPGAPRDQRRPAGGRPSPSAMGKRLSREQSTPPKSPQ

SEQ ID NO: 44799 - protein, 491 aa, Homo sapiens
  Payload ID: 9122
  Gene Symbol: LARP6
  Gene Name: La ribonucleoprotein domain family, member 6
  Uniprot ID: Q9BRS8
  ENSP ID: ENSP00000299213
MAQSGGEARPGPKTAVQIRVAIQEAEDVDELEDEEEGAETRGAGDPARYLSPGWGSASEEEPSRGHSGTTASGGENEREDLEQEWKPPDEELIKKLVDQIEFYFSDENLEKDAFLLKHVRRNKLGYVSVKLLTSFKKVKHLTRDWRTTAHALKYSVVLELNEDHRKVRRTTPVPLFPNENLPSKMLLVYDLYLSPKLWALATPQKNGRVQEKVMEHLLKLFGTFGVISSVRILKPGRELPPDIRRISSRYSQVGTQECAIVEFEEVEAAIKAHEFMITESQGKENMKAVLIGMKPPKKKPAKDKNHDEEPTASIHLNKSLNKRVEELQYMGDESSANSSSDPESNPTSPMAGRRHAATNKLSPSGHQNLFLSPNASPCTSPWSSPLAQRKGVSRKSPLAEEGRLNCSTSPEIFRKCMDYSSDSSVTPSGSPWVRRRRQAEMGTQEKSPGTSPLLSRKMQTADGLPVGVLRLPRGPDNTRGFHGHERSRACV

SEQ ID NO: 44800 - protein, 93 aa, Homo sapiens
  Payload ID: 9122
  Gene Symbol: LARP6
  Gene Name: La ribonucleoprotein domain family, member 6
  Uniprot ID: Q9BRS8
  ENSP ID: ENSP00000343869
MAQSGGEARPGPKTAVQIRVAIQEAEDVDELEDEEEGAETRGAGDPARYLSPGWGSASEEEPSRGHRNRSSVNSRTMLASFIVSSAPSTAPST

SEQ ID NO: 44801 - protein, 78 aa, Homo sapiens
  Payload ID: 9122
  Gene Symbol: LARP6
  Gene Name: La ribonucleoprotein domain family, member 6
  ENSP ID: ENSP00000453551
  MOD_RES (1)..(1): Any amino acid
XVDELEDEEEGAETRGAGDPARYLSPGWGSASEEEPSRGHRTAQLPWLESQQVFSLKPFLLPTGIELTPENPWGSSVS

SEQ ID NO: 44802 - protein, 31 aa, Homo sapiens
  Payload ID: 9122
  Gene Symbol: LARP6
  Gene Name: La ribonucleoprotein domain family, member 6
  ENSP ID: ENSP00000467334
MLLVYDLYLSPKLWALATPQKNGRVQEKVME

SEQ ID NO: 44803 - protein, 582 aa, Homo sapiens
  Payload ID: 9123
  Gene Symbol: LARP7
  Gene Name: La ribonucleoprotein domain family, member 7
  Uniprot ID: Q4G0J3
  ENSP ID: ENSP00000314311
METESGNQEKVMEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERPKDEDERTVYVELLPKNVNHSWIERVFGKCGNVVYISIPHYKSTGDPKGFAFVEFETKEQAAKAIEFLNNPPEEAPRKPGIFPKTVKNKPIPALRVVEEKKKKKKKKGRMKKEDNIQAKEENMDTSNTSISKMKRSRPTSEGSDIESTEPQKQCSKKKKKRDRVEASSLPEVRTGKRKRSSSEDAESLAPRSKVKKIIQKDIIKEASEASKENRDIEISTEEEKDTGDLKDSSLLKTKRKHKKKHKERHKMGEEVIPLRVLSKSEWMDLKKEYLALQKASMASLKKTISQIKSESEMETDSGVPQNTGMKNEKTANREECRTQEKVNATGPQFVSGVIVKIISTEPLPGRKQVRDTLAAISEVLYVDLLEGDTECHARFKTPEDAQAVINAYTEINKKHCWKLEILSGDHEQRYWQKILVDRQAKLNQPREKKRGTEKLITKAEKIRLAKTQQASKHIRFSEYD

SEQ ID NO: 44804 - protein, 582 aa, Homo sapiens; identical to SEQ ID NO: 44803
  Payload ID: 9123
  Gene Symbol: LARP7
  Gene Name: La ribonucleoprotein domain family, member 7
  Uniprot ID: Q4G0J3
  ENSP ID: ENSP00000344950

SEQ ID NO: 44805 - protein, 299 aa, Homo sapiens
  Payload ID: 9123
  Gene Symbol: LARP7
  Gene Name: La ribonucleoprotein domain family, member 7
  ENSP ID: ENSP00000421541
METESGNQEKVMEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERPKDEDERTVYVELLPKNVNHSWIERVFGKCGNVVYISIPHYKSTGDPKGFAFVEFETKEQAAKAIEFLNNPPEEAPRKPGIFPKTVKNKPIPALRVVEEKKKKKKKKGRMKKEDNIQAKEENMDTSNTSISKMKRSRPTSEGSDIESTEPQKQCSKKKKKRDRVEASSLPEVRTGKRKRSS

SEQ ID NO: 44806 - protein, 129 aa, Homo sapiens
  Payload ID: 9123
  Gene Symbol: LARP7
  Gene Name: La ribonucleoprotein domain family, member 7
  ENSP ID: ENSP00000421963
METESGNQEKVMEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERPKDEDERTVYV

SEQ ID NO: 44807 - protein, 155 aa, Homo sapiens
  Payload ID: 9123
  Gene Symbol: LARP7
  Gene Name: La ribonucleoprotein domain family, member 7
  ENSP ID: ENSP00000422013
METESGNQEKDTGDLKDSSLLKTKRKHKKKHKERHKMGEEVIPLRVLSKSEWMDLKKEYLALQKASMASLKKTISQIKSESEMETDSGVPQNTGMKNEKTANREECRTQEKVNATGPQFVSGVIVKIISTEPLPGRKQVRDTLAAISEVLYVDLL

SEQ ID NO: 44808 - protein, 45 aa, Homo sapiens
  Payload ID: 9123
  Gene Symbol: LARP7
  Gene Name: La ribonucleoprotein domain family, member 7
  ENSP ID: ENSP00000422451
METESGNQEKVMEEESTEKKKEVEKKKRSRVKQMLIYHYLCLLTK

SEQ ID NO: 44809 - protein, 589 aa, Homo sapiens
  Payload ID: 9123
  Gene Symbol: LARP7
  Gene Name: La ribonucleoprotein domain family, member 7
  Uniprot ID: Q4G0J3
  ENSP ID: ENSP00000422626
MIPNIEGMETESGNQEKVMEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERPKDEDERTVYVELLPKNVNHSWIERVFGKCGNVVYISIPHYKSTGDPKGFAFVEFETKEQAAKAIEFLNNPPEEAPRKPGIFPKTVKNKPIPALRVVEEKKKKKKKKGRMKKEDNIQAKEENMDTSNTSISKMKRSRPTSEGSDIESTEPQKQCSKKKKKRDRVEASSLPEVRTGKRKRSSSEDAESLAPRSKVKKIIQKDIIKEASEASKENRDIEISTEEEKDTGDLKDSSLLKTKRKHKKKHKERHKMGEEVIPLRVLSKSEWMDLKKEYLALQKASMASLKKTISQIKSESEMETDSGVPQNTGMKNEKTANREECRTQEKVNATGPQFVSGVIVKIISTEPLPGRKQVRDTLAAISEVLYVDLLEGDTECHARFKTPEDAQAVINAYTEINKKHCWKLEILSGDHEQRYWQKILVDRQAKLNQPREKKRGTEKLITKAEKIRLAKTQQASKHIRFSEYD

SEQ ID NO: 44810 - protein, 45 aa, Homo sapiens; identical to SEQ ID NO: 44808
  Payload ID: 9123
  Gene Symbol: LARP7
  Gene Name: La ribonucleoprotein domain family, member 7
  ENSP ID: ENSP00000424116

SEQ ID NO: 44811 - protein, 334 aa, Homo sapiens
  Payload ID: 9123
  Gene Symbol: LARP7
  Gene Name: La ribonucleoprotein domain family, member 7
  ENSP ID: ENSP00000426376
  MOD_RES (1)..(1): Any amino acid
XKKKKKGRMKKEDNIQAKEENMDTSNTSISKMKRSRPTSEGSDIESTEPQKQCSKKKKKRDRVEASSLPEVRTGKRKRSSSEDAESLAPRSKVKKIIQKDIIKEASEASKENRAPCLNGELFYLFQDIEISTEEEKDTGDLKDSSLLKTKRKHKKKHKERHKMGEEVIPLRVLSKSEWMDLKKEYLALQKASMASLKKTISQIKSESEMETDSGVPQNTGMKNEKTANREECRTQEKVNATGPQFVSGVIVKIISTEPLPGRKQVRDTLAAISEVLYVDLLEGDTECHARFKTPEDAQAVINAYTEINKKHCWKLEILSGDHEQRYWQKILVDR

SEQ ID NO: 44812 - protein, 119 aa, Homo sapiens
  Payload ID: 9123
  Gene Symbol: LARP7
  Gene Name: La ribonucleoprotein domain family, member 7
  ENSP ID: ENSP00000426646
METESGNQEKVMEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERP

SEQ ID NO: 44813 - protein, 101 aa, Homo sapiens
  Payload ID: 9123
  Gene Symbol: LARP7
  Gene Name: La ribonucleoprotein domain family, member 7
  ENSP ID: ENSP00000426709
METESGNQEKVMEEESTEKKKEVEKKKRSRVKQVLADIAKQVDFWFGDANLHKDRFLREQIEKSRDGCRNALAPCLLTPTSAPTSTPSAPPKRSSISLPSS

SEQ ID NO: 44814 - protein, 96 aa, Homo sapiens
  Payload ID: 9124
  Gene Symbol:
  Gene Name: LA16c-306E5.2
  ENSP ID: ENSP00000477472
MQGQKVLLEKTGSQLGEQELPDFQPQTPRRDLRESSPAEPSQAGAYDRLSPHHWEKSPLLQEPTPKLAGTAYRKAVPGGRKCGASLSWEKSSRECE

SEQ ID NO: 44815 - protein, 111 aa, Homo sapiens [sequence omitted]

SEQ ID NO: 44816 - protein, 536 aa, Homo sapiens
  Payload ID: 9125
  Gene Symbol:
  Gene Name: LA16c-380H5.3
  ENSP ID: ENSP00000488558
MGAWAFPAALFLLCLTSESLQGGLPLLPPGLGKVYGPHSGLGAGYDGGVKPQKPGFVVRHGLGTQPDTEGGMKPQNLGFRTFAGAAAQPGYGNGLGAAAFPVAGAQSGPAAQNGFGPGFGGGGKPQKPGPTTQNGYRPGYVGAVKPQKPGFQYRIGLGAQPGFRGDMKAQEPGLGNGNGLSAQPVLTAQNRFGFGAGLGGNVKPLKPGYGKRLRAGAFPGAGTQPEYGHGNGPGVQPGLGAGMKPQMPGLGAPNGYGPGRGRAGVPGGPERRPWVPHLLPFSSPGYLGVMKAQKPGPLAQNGYRAGAGEGMKPQKPGLRGTLKPQKSGHGHENGPWPGPCNARVAPMLLPRLPTPGVPSDKEGGWGLKSQPPSAVQNGKLPAPMPAIQWGLKPQKAGHQPPNGYGPGAEPGFNGGLEPQKIGLGYGNGVLGARVFPEAHPQPGFHGANGFRNRDGVEALVYPKAAALAPEGNGQAGVLWNSRWPTLQAWGAGLKPGYQAGDEYAEARSQPGGPDVKRGSNGQLGNGYGGRCPLGKC

SEQ ID NO: 44817 - protein, 122 aa, Homo sapiens
  Payload ID: 9126
  Gene Symbol:
  Gene Name: LA16c-431H6.6
  ENSP ID: ENSP00000399780
  MOD_RES (1)..(1): Any amino acid
XKKKGKPASMVKNKEQVRHFYYRTWHKITKYIDFDHVFSRGLKKSSQELYGLICYGELRKKIGGCMDDKNATKLNELIQVGRSFTMLARLVLNSRPQETCQGPPLYVTKGGTCGSKRPCAGP

SEQ ID NO: 44818 - protein, 430 aa, Homo sapiens
  Payload ID: 9127
  Gene Symbol: LACC1
  Gene Name: laccase (multicopper oxidoreductase) domain containing 1
  Uniprot ID: Q8IV20
  ENSP ID: ENSP00000317619
MAEAVLIDLFGLKLNSQKNCHQTLLKTLNAVQYHHAAKAKFLCIMCCSNISYERDGEQDNCEIETSNGLSALLEEFEIVSCPSMAATLYTIKQKIDEKNLSSIKVIVPRHRKTLMKAFIDQLFTDVYNFEFEDLQVTFRGGLFKQSIEINVITAQELRGIQNEIETFLRSLPALRGKLTIITSSLIPDIFIHGFTTRTGGISYIPTLSSFNLFSSSKRRDPKVVVQENLRRLANAAGFNVEKFYRIKTHHSNDIWIMGRKEPDSYDGITTNQRGVTIAALGADCIPIVFADPVKKACGVAHAGWKGTLLGVAMATVNAMIAEYGCSLEDIVVVLGPSVGPCCFTLPRESAEAFHNLHPACVQLFDSPNPCIDIRKATRILLEQGGILPQNIQDQNQDLNLCTSCHPDKFFSHVRDGLNFGTQIGFISIKE

SEQ ID NO: 44819 - protein, 430 aa, Homo sapiens; identical to SEQ ID NO: 44818
  Payload ID: 9127
  Gene Symbol: LACC1
  Gene Name: laccase (multicopper oxidoreductase) domain containing 1
  Uniprot ID: Q8IV20
  ENSP ID: ENSP00000391747

SEQ ID NO: 44820 - protein, 164 aa, Homo sapiens
  Payload ID: 9127
  Gene Symbol: LACC1
  Gene Name: laccase (multicopper oxidoreductase) domain containing 1
  ENSP ID: ENSP00000394179
MAEAVLIDLFGLKLNSQKNCHQTLLKTLNAVQYHHAAKAKFLCIMCCSNISYERDGEQDNCEIETSNGLSALLEEFEIVSCPSMAATLYTIKQKIDEKNLSSIKVIVPRHRKTLMKAFIDQLFTDVYNFEFEDLQVTFRGGLFKQSIEINVITAQELRGIQNEI

SEQ ID NO: 44821 - protein, 138 aa, Homo sapiens
  Payload ID: 9128
  Gene Symbol: LACRT
  Gene Name: lacritin
  Uniprot ID: Q9GZZ8
  ENSP ID: ENSP00000257867
MKFTTLLFLAAVAGALVYAEDASSDSTGADPAQEAGTSKPNEEISGPAEPASPPETTTTAQETSAAAVQGTAKVTSSRQELNPLKSIVEKSILLTEQALAKAGKGMHGGVPGGKQFIENGSEFAQKLLKKFSLLKPWA

SEQ ID NO: 44822 - protein, 127 aa, Homo sapiens
  Payload ID: 9128
  Gene Symbol: LACRT
  Gene Name: lacritin
  ENSP ID: ENSP00000447536
MKFTTLLFLAAVAGALVYAEDASSDSTGADPAQEAGTSKPNEEISGPAEPASPPETTTTAQETSAAAVQGTAKVTSSRQELNPLKQALAKAGKGMHGGVPGGKQFIENGSEFAQKLLKKFSLLKPWA

SEQ ID NO: 44823 - protein, 85 aa, Homo sapiens
  Payload ID: 9128
  Gene Symbol: LACRT
  Gene Name: lacritin
  ENSP ID: ENSP00000448193
PAQEAGTSKPNEEISGPAEPASPPETTTTAQETSAAAVQGTAKVTSSRQELNPLKQALAKAGKGMHGGVPGGKQFIESECIPRWK

SEQ ID NO: 44824 - protein, 142 aa, Homo sapiens
  Payload ID: 9129
  Gene Symbol: LALBA
  Gene Name: lactalbumin, alpha-
  Uniprot ID: P00709
  ENSP ID: ENSP00000301046
MRFFVPLFLVGILFPAILAKQFTKCELSQLLKDIDGYGGIALPELICTMFHTSGYDTQAIVENNESTEYGLFQISNKLWCKSSQVPQSRNICDISCDKFLDDDITDDIMCAKKILDIKGIDYWLAHKALCTEKLEQWLCEKL

SEQ ID NO: 44825 - protein, 123 aa, Homo sapiens
  Payload ID: 9129
  Gene Symbol: LALBA
  Gene Name: lactalbumin, alpha-
  ENSP ID: ENSP00000449780
MRFFVPLFLVGILFPAILAKQFTKCELSQLLKDIDGYGGIALPELICTMFHTSGYDTQAIVENNESTEYGLFQISNKLWCKSSQVPQSRNICDISCDKFLDDDITDDIMCAKKILDIKGIDYW

SEQ ID NO: 44826 - protein, 547 aa, Homo sapiens
  Payload ID: 9130
  Gene Symbol: LACTB
  Gene Name: lactamase, beta
  Uniprot ID: P83111
  ENSP ID: ENSP00000261893
MYRLMSAVTARAAAPGGLASSCGRRGVHQRAGLPPLGHGWVGGLGLGLGLALGVKLAGGLRGAAPAQSPAAPDPEASPLAEPPQEQSLAPWSPQTPAPPCSRCFARAIESSRDLLHRIKDEVGAPGIVVGVSVDGKEVWSEGLGYADVENRVPCKPETVMRIASISKSLTMVALAKLWEAGKLDLDIPVQHYVPEFPEKEYEGEKVSVTTRLLISHLSGIRHYEKDIKKVKEEKAYKALKMMKENVAFEQEKEGKSNEKNDFTKFKTEQENEAKCRNSKPGKKKNDFEQGELYLREKFENSIESLRLFKNDPLFFKPGSQFLYSTFGYTLLAAIVERASGCKYLDYMQKIFHDLDMLTTVQEENEPVIYNRARFYVYNKKKRLVNTPYVDNSYKWAGGGFLSTVGDLLKFGNAMLYGYQVGLFKNSNENLLPGYLKPETMVMMWTPVPNTEMSWDKEGKYAMAWGVVERKQTYGSCRKQRHYASHTGGAVGASSVLLVLPEELDTETINNKVPPRGIIVSIICNMQSVGLNSTALKIALEFDKDRSD

SEQ ID NO: 44827 - protein, 373 aa, Homo sapiens
  Payload ID: 9130
  Gene Symbol: LACTB
  Gene Name: lactamase, beta
  Uniprot ID: P83111
  ENSP ID: ENSP00000392956
MYRLMSAVTARAAAPGGLASSCGRRGVHQRAGLPPLGHGWVGGLGLGLGLALGVKLAGGLRGAAPAQSPAAPDPEASPLAEPPQEQSLAPWSPQTPAPPCSRCFARAIESSRDLLHRIKDEVGAPGIVVGVSVDGKEVWSEGLGYADVENRVPCKPETVMRIASISKSLTMVALAKLWEAGKLDLDIPVQHYVPEFPEKEYEGEKVSVTTRLLISHLSGIRHYEKDIKKVKEEKAYKALKMMKENVAFEQEKEGKSNEKNDFTKFKTEQENEAKCRNSKPGKKKNDFEQGELYLREKFENSIESLRLFKNDPLFFKPGSQFLYSTFGYTLLAAIVERASGCKYLDYMQKIFHDLDMLTTVQEENEPVIYNRAR

SEQ ID NO: 44828 - protein, 126 aa, Homo sapiens
  Payload ID: 9130
  Gene Symbol: LACTB
  Gene Name: lactamase, beta
  ENSP ID: ENSP00000454085
MRIASISKSLTMVALAKLWEAGKLDLDIPVQHYVPEFPEKEYEGEKVSVTTRLLISHLSGIRHYEKDIKKVKEEKAYKALKMMKENVAFEQEKEGKSNEKNDFTKFKTEQENEAKCRNSKPGKKKN

SEQ ID NO: 44829 - protein, 288 aa, Homo sapiens
  Payload ID: 9131
  Gene Symbol: LACTB2
  Gene Name: lactamase, beta 2
  Uniprot ID: Q53H82
  ENSP ID: ENSP00000276590
MAAVLQRVERLSNRVVRVLGCNPGPMTLQGTNTYLVGTGPRRILIDTGEPAIPEYISCLKQALTEFNTAIQEIVVTHWHRDHSGGIGDICKSINNDTTYCIKKLPRNPQREEIIGNGEQQYVYLKDGDVIKTEGATLRVLYTPGHTDDHMALLLEEENAIFSGDCILGEGTTVFEDLYDYMNSLKELLKIKADIIYPGHGPVIHNAEAKIQQYISHRNIREQQILTLFRENFEKSFTVMELVKIIYKNTPENLHEMAKHNLLLHLKKLEKEGKIFSNTDPDKKWKAHL

SEQ ID NO: 44830 - protein, 288 aa, Homo sapiens; identical to SEQ ID NO: 44829
  Payload ID: 9131
  Gene Symbol: LACTB2
  Gene Name: lactamase, beta 2
  Uniprot ID: Q53H82
  ENSP ID: ENSP00000428801

SEQ ID NO: 44831 - protein, 546 aa, Homo sapiens
  Payload ID: 9132
  Gene Symbol: LACTBL1
  Gene Name: lactamase, beta-like 1
  ENSP ID: ENSP00000402297
MTGCFLWQYHLPKLKTGSLGPEETSAPVRMCPRHPEPVPLAHPLPVLKEALEKVDQILRQAMSAPGVAAMSAVVIHNDTVLWTGNFGKKNGSDPASGAPNEYTMYRISSISKIFPVLMLYRLWEEGIVASLDDPLERYASTFTINNPLGLASAEQQGLMDGLEQVGPAPRPSPVTLRRMASQLSGLPRRLRSTSLLWKGSTQEALNLLKDDVLVVDPGTRCHYSTLAFSLLAHVLAAHTAQGDYQRWVSENVLEPLGMADTGFDLTPDVRARLAAGFYGSGRPAPLYDLGWYRPSGQMYSTAADLAKLAVALLGGGPRRLLRPDAAKTLLAPLLACPGAYFANETGTPWEFHAQRGYRVVRKDGDLDGYAATFSLVPPLRLGLVLLLAGPRPPGPDLVARAYDELLPALERALREAEPGPAPPPTAHPFAGYFTFANLTFYEVRAGPAGELRLRQFGPRVEALVPPAFRTLALRHLHGRVFQLHVAHEFPCALPLGDAWLSLEAQHGQLVNFYPLDHHGLSPGFDVPGLNTYRVLRLRGKPVFKTQ

SEQ ID NO: 44832 - protein, 500 aa, Homo sapiens
  Payload ID: 9132
  Gene Symbol: LACTBL1
  Gene Name: lactamase, beta-like 1
  Uniprot ID: A8MY62
  ENSP ID: ENSP00000483725
MCPRHPEPVPLAHPLPVLKEALEKVDQILRQAMSAPGVAAMSAVVIHNDTVLWTGNFGKKNGSDPASGAPNEYTMYRISSISKIFPVLMLYRLWEEGIVASLDDPLERYASTFTINNPLGLASAEQQGLILRRMASQLSGLPRRLRSTSLLWKGSTQEALNLLKDDVLVVDPGTRCHYSTLAFSLLAHVLAAHTAQGDYQRWVSENVLEPLGMADTGFDLTPDVRARLAAGFYGSGRPAPLYDLGWYRPSGQMYSTAADLAKLAVALLGGGPRRLLRPDAAKTLLAPLLACPGAYFANETGTPWEFHAQRGYRVVRKDGDLDGYAATFSLVPPLRLGLVLLLAGPRPPGPDLVARAYDELLPALERALREAEPGPAPPPTAHPFAGYFTFANLTFYEVRAGPAGELRLRQFGPRVEALVPPAFRTLALRHLHGRVFQLHVAHEFPCALPLGDAWLSLEAQHGQLVNFYPLDHHGLSPGFDVPGLNTYRVLRLRGKPVFKT

SEQ ID NO: 44833 - protein, 1927 aa, Homo sapiens
  Payload ID: 9133
  Gene Symbol: LCT
  Gene Name: lactase
  Uniprot ID: P09848
  ENSP ID: ENSP00000264162
MELSWHVVFIALLSFSCWGSDWESDRNFISTAGPLTNDLLHNLSGLLGDQSSNFVAGDKDMYVCHQPLPTFLPEYFSSLHASQITHYKVFLSWAQLLPAGSTQNPDEKTVQCYRRLLKALKTARLQPMVILHHQTLPASTLRRTEAFADLFADYATFAFHSFGDLVGIWFTFSDLEEVIKELPHQESRASQLQTLSDAHRKAYEIYHESYAFQGGKLSVVLRAEDIPELLLEPPISALAQDTVDFLSLDLSYECQNEASLRQKLSKLQTIEPKVKVFIFNLKLPDCPSTMKNPASLLFSLFEAINKDQVLTIGFDINEFLSCSSSSKKSMSCSLTGSLALQPDQQQDHETTDSSPASAYQRIWEAFANQSRAERDAFLQDTFPEGFLWGASTGAFNVEGGWAEGGRGVSIWDPRRPLNTTEGQATLEVASDSYHKVASDVALLCGLRAQVYKFSISWSRIFPMGHGSSPSLPGVAYYNKLIDRLQDAGIEPMATLFHWDLPQALQDHGGWQNESVVDAFLDYAAFCFSTFGDRVKLWVTFHEPWVMSYAGYGTGQHPPGISDPGVASFKVAHLVLKAHARTWHHYNSHHRPQQQGHVGIVLNSDWAEPLSPERPEDLRASERFLHFMLGWFAHPVFVDGDYPATLRTQIQQMNRQCSHPVAQLPEFTEAEKQLLKGSADFLGLSHYTSRLISNAPQNTCIPSYDTIGGFSQHVNHVWPQTSSSWIRVVPWGIRRLLQFVSLEYTRGKVPIYLAGNGMPIGESENLFDDSLRVDYFNQYINEVLKAIKEDSVDVRSYIARSLIDGFEGPSGYSQRFGLHHVNFSDSSKSRTPRKSAYFFTSIIEKNGFLTKGAKRLLPPNTVNLPSKVRAFTFPSEVPSKAKVVWEKFSSQPKFERDLFYHGTFRDDFLWGVSSSAYQIEGAWDADGKGPSIWDNFTHTPGSNVKDNATGDIACDSYHQLDADLNMLRALKVKAYRFSISWSRIFPTGRNSSINSHGVDYYNRLINGLVASNIFPMVTLFHWDLPQALQDIGGWENPALIDLFDSYADFCFQTFGDRVKFWMTFNEPMYLAWLGYGSGEFPPGVKDPGWAPYRIAHAVIKAHARVYHTYDEKYRQEQKGVISLSLSTHWAEPKSPGVPRDVEAADRMLQFSLGWFAHPIFRNGDYPDTMKWKVGNRSELQHLATSRLPSFTEEEKRFIRATADVFCLNTYYSRIVQHKTPRLNPPSYEDDQEMAEEEDPSWPSTAMNRAAPWGTRRLLNWIKEEYGDIPIYITENGVGLTNPNTEDTDRIFYHKTYINEALKAYRLDGIDLRGYVAWSLMDNFEWLNGYTVKFGLYHVDFNNTNRPRTARASARYYTEVITNNGMPLAREDEFLYGRFPEGFIWSAASAAYQIEGAWRADGKGLSIWDTFSHTPLRVENDAIGDVACDSYHKIAEDLVTLQNLGVSHYRFSISWSRILPDGTTRYINEAGLNYYVRLIDTLLAASIQPQVTIYHWDLPQTLQDVGGWENETIVQRFKEYADVLFQRLGDKVKFWITLNEPFVIAYQGYGYGTAAPGVSNRPGTAPYIVGHNLIKAHAEAWHLYNDVYRASQGGVISITISSDWAEPRDPSNQEDVEAARRYVQFMGGWFAHPIFKNGDYNEVMKTRIRDRSLAAGLNKSRLPEFTESEKRRINGTYDFFGFNHYTTVLAYNLNYATAISSFDADRGVASIADRSWPDSGSFWLKMTPFGFRRILNWLKEEYNDPPIYVTENGVSQREETDLNDTARIYYLRTYINEALKAVQDKVDLRGYTVWSAMDNFEWATGFSERFGLHFVNYSDPSLPRIPKASAKFYASVVRCNGFPDPATGPHACLHQPDAGPTISPVRQEEVQFLGLMLGTTEAQTALYVLFSLVLLGVCGLAFLSYKYCKRSKQGKTQRSQQELSPVSSF

SEQ ID NO: 44834 - protein, 1003 aa, Homo sapiens
  Payload ID: 9133
  Gene Symbol: LCT
  Gene Name: lactase
  ENSP ID: ENSP00000391231
KVAHLVLKAHARTWHHYNSHHRPQQQGHVGIVLNSDWAEPLSPERPEDLRASERFLHFMLGWFAHPVFVDGDYPATLRTQIQQMNRQCSHPVAQLPEFTEAEKQLLKGSADFLGLSHYTSRLISNAPQNTCIPSYDTIGGFSQHVNHVWPQTSSSWIRVVPWGIRRLLQFVSLEYTRGKVPIYLAGNGMPIGESENLFDDSLRVDYFNQYINEVLKAIKEDSVDVRSYIARSLIDGFEGPSGYSQRFGLHHVNFSDSSKSRTPRKSAYFFTSIIEKNGFLTKGAKRLLPPNTVNLPSKVRAFTFPSEVPSKAKVVWEKFSSQPKFERDLFYHGTFRDDFLWGVSSSAYQIEGAWDADGKGPSIWDNFTHTPGSNVKDNATGDIACDSYHQLDADLNMLRALKVKAYRFSISWSRIFPTGRNSSINSHGVDYYNRLINGLVASNIFPMVTLFHWDLPQALQDIGGWENPALIDLFDSYADFCFQTFGDRVKFWMTFNEPMYLAWLGYGSGEFPPGVKDPGWAPYRIAHAVIKAHARVYHTYDEKYRQEQKGVISLSLSTHWAEPKSPGVPRDVEAADRMLQFSLGWFAHPIFRNGDYPDTMKWKVGNRSELQHLATSRLPSFTEEEKRFIRATADVFCLNTYYSRIVQHKTPRLNPPSYEDDQEMAEEEDPSWPSTAMNRAAPWGTRRLLNWIKEEYGDIPIYITENGVGLTNPNTEDTDRIFYHKTYINEALKAYRLDGIDLRGYVAWSLMDNFEWLNGYTVKFGLYHVDFNNTNRPRTARASARYYTEVITNNGMPLAREDEFLYGRFPEGFIWSAASAAYQIEGAWRADGKGLSIWDTFSHTPLRVENDAIGDVACDSYHKIAEDLVTLQNLGVSHYRFSISWSRILPDGTTRYINEAGLNYYVRLIDTLLAASIQPQVTIYHWDLPQTLQDVGGWENETIVQRFKEYADVLFQRLGDKVKFWITLNEPFVIAYQGYGYGTAAPVHGRLVCTSYFQEWRLQ

SEQ ID NO: 44835 - protein, 567 aa, Homo sapiens
  Payload ID: 9134
  Gene Symbol: LCTL
  Gene Name: lactase-like
  Uniprot ID: Q6UWM7
  ENSP ID: ENSP00000343490
MKPVWVATLLWMLLLVPRLGAARKGSPEEASFYYGTFPLGFSWGVGSSAYQTEGAWDQDGKGPSIWDVFTHSGKGKVLGNETADVACDGYYKVQEDIILLRELHVNHYRFSLSWPRLLPTGIRAEQVNKKGIEFYSDLIDALLSSNITPIVTLHHWDLPQLLQVKYGGWQNVSMANYFRDYANLCFEAFGDRVKHWITFSDPRAMAEKGYETGHHAPGLKLRGTGLYKAAHHIIKAHAKAWHSYNTTWRSKQQGLVGISLNCDWGEPVDISNPKDLEAAERYLQFCLGWFANPIYAGDYPQVMKDYIGRKSAEQGLEMSRLPVFSLQEKSYIKGTSDFLGLGHFTTRYITERNYPSRQGPSYQNDRDLIELVDPNWPDLGSKWLYSVPWGFRRLLNFAQTQYGDPPIYVMENGASQKFHCTQLCDEWRIQYLKGYINEMLKAIKDGANIKGYTSWSLLDKFEWEKGYSDRYGFYYVEFNDRNKPRYPKASVQYYKKIIIANGFPNPREVESWYLKALETCSINNQMLAAEPLLSHMQMVTEIVVPTVCSLCVLITAVLLMLLLRRQS

SEQ ID NO: 44836 - protein, 394 aa, Homo sapiens
  Payload ID: 9134
  Gene Symbol: LCTL
  Gene Name: lactase-like
  Uniprot ID: Q6UWM7
  ENSP ID: ENSP00000445419
MANYFRDYANLCFEAFGDRVKHWITFSDPRAMAEKGYETGHHAPGLKLRGTGLYKAAHHIIKAHAKAWHSYNTTWRSKQQGLVGISLNCDWGEPVDISNPKDLEAAERYLQFCLGWFANPIYAGDYPQVMKDYIGRKSAEQGLEMSRLPVFSLQEKSYIKGTSDFLGLGHFTTRYITERNYPSRQGPSYQNDRDLIELVDPNWPDLGSKWLYSVPWGFRRLLNFAQTQYGDPPIYVMENGASQKFHCTQLCDEWRIQYLKGYINEMLKAIKDGANIKGYTSWSLLDKFEWEKGYSDRYGFYYVEFNDRNKPRYPKASVQYYKKIIIANGFPNPREVESWYLKALETCSINNQMLAAEPLLSHMQMVTEIVVPTVCSLCVLITAVLLMLLLRRQS

SEQ ID NO: 44837 - protein, 36 aa, Homo sapiens
  Payload ID: 9134
  Gene Symbol: LCTL
  Gene Name: lactase-like
  ENSP ID: ENSP00000455793
MANYFRDYANLCFEAFGDRVKHWITFSDPRVWWEFH

SEQ ID NO: 44838 - protein, 241 aa, Homo sapiens
  Payload ID: 9135
  Gene Symbol: LDHA
  Gene Name: lactate dehydrogenase A
  Uniprot ID: P00338
  ENSP ID: ENSP00000227157
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKEQWKEVHKQVVERVFTE

SEQ ID NO: 44839 - protein, 332 aa, Homo sapiens
  Payload ID: 9135
  Gene Symbol: LDHA
  Gene Name: lactate dehydrogenase A
  Uniprot ID: P00338
  ENSP ID: ENSP00000368722
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKEQWKEVHKQVVESAYEVIKLKGYTSWAIGLSVADLAESIMKNLRRVHPVSTMIKGLYGIKDDVFLSVPCILGQNGISDLVKVTLTSEEEARLKKSADTLWGIQKELQF

SEQ ID NO: 44840 - protein, 274 aa, Homo sapiens
  Payload ID: 9135
  Gene Symbol: LDHA
  Gene Name: lactate dehydrogenase A
  Uniprot ID: P00338
  ENSP ID: ENSP00000379524
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKEQWKECRYTLGDPKGAAILKSSDVISFHCLGYNRILGGGCACCPFYLICD

SEQ ID NO: 44841 - protein, 332 aa, Homo sapiens; identical to SEQ ID NO: 44839
  Payload ID: 9135
  Gene Symbol: LDHA
  Gene Name: lactate dehydrogenase A
  Uniprot ID: P00338
  ENSP ID: ENSP00000395337

SEQ ID NO: 44842 - protein, 274 aa, Homo sapiens
  Payload ID: 9135
  Gene Symbol: LDHA
  Gene Name: lactate dehydrogenase A
  Uniprot ID: P00338
  ENSP ID: ENSP00000406172
MATLKDQLIYNLLKEEQTPQNKITVVGVGAVGMACAISILMKDLADELALVDVIEDKLKGEMMDLQHGSLFLRTPKIVSGKVDILTYVAWKISGFPKNRVIGSGCNLDSARFRYLMGERLGVHPLSCHGWVLGEHGDSSVPVWSGMNVAGVSLKTLHPDLGTDKDKEQWKEVHKQVVESAYEVIKLKGYTSWAIGLSVADLAESIMKNLRRVHPVSTMIKGLYGIKDDVFLSVPCILGQNGISDLVKVTLTSEEEARLKKSADTLWGIQKELQF

SEQ ID NO: 44843 - protein, 156 aa, Homo sapiens
  Payload ID: 9135
  Gene Symbol: LDHA
  Gene Name: lactate dehydrogenase A
  ENSP ID: ENSP00000440161
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKN

SEQ ID NO: 44844 - protein, 46 aa, Homo sapiens
  Payload ID: 9135
  Gene Symbol: LDHA
  Gene Name: lactate dehydrogenase A
  ENSP ID: ENSP00000440368
MATLKDQLIYNLLKEEQTPQNKITVVGVGAVGMACAITVLIWSSVT

SEQ ID NO: 44845 - protein, 45 aa, Homo sapiens
  Payload ID: 9135
  Gene Symbol: LDHA
  Gene Name: lactate dehydrogenase A
  ENSP ID: ENSP00000441058
MATLKDQLIYNLLKEEQTPQNKITVVGVGAVGMACAISILMKWIS

SEQ ID NO: 44846 - protein, 144 aa, Homo sapiens
  Payload ID: 9135
  Gene Symbol: LDHA
  Gene Name: lactate dehydrogenase A
  ENSP ID: ENSP00000441241
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPGEAFD

SEQ ID NO: 44847 - protein, 45 aa, Homo sapiens
  Payload ID: 9135
  Gene Symbol: LDHA
  Gene Name: lactate dehydrogenase A
  ENSP ID: ENSP00000441699
MATLKDQLIYNLLKEEQTPQNKITVVGVGAVGMACAISILMKTIM

SEQ ID NO: 44848 - protein, 45 aa, Homo sapiens; identical to SEQ ID NO: 44847
  Payload ID: 9135
  Gene Symbol: LDHA
  Gene Name: lactate dehydrogenase A
  ENSP ID: ENSP00000442637

SEQ ID NO: 44849 - protein, 94 aa, Homo sapiens
  Payload ID: 9135
  Gene Symbol: LDHA
  Gene Name: lactate dehydrogenase A
  ENSP ID: ENSP00000442979
MATLKDQLIYNLLKEEQTPQNKITVVGVGAVGMACAISILMKDLADELALVDVIEDKLKGEMMDLQHGSLFLRTPKIVSGKALPNCSYIKLQLD

SEQ ID NO: 44850 - protein, 89 aa, Homo sapiens
  Payload ID: 9135
  Gene Symbol: LDHA
  Gene Name: lactate dehydrogenase A
  ENSP ID: ENSP00000443362
MATLKDQLIYNLLKEEQTPQNKITVVGVGAVGMACAISILMKDLADELALVDVIEDKLKGEMMDLQHGSLFLRTPKIVSGKDSAPRFRD

SEQ ID NO: 44851 - protein, 42 aa, Homo sapiens
  Payload ID: 9135
  Gene Symbol: LDHA
  Gene Name: lactate dehydrogenase A
  ENSP ID: ENSP00000443545
MATLKDQLIYNLLKEEQTPQNKITVVGVGAVGMACAISILMK

SEQ ID NO: 44852 - protein, 72 aa, Homo sapiens
  Payload ID: 9135
  Gene Symbol: LDHA
  Gene Name: lactate dehydrogenase A
  ENSP ID: ENSP00000444292
MATLKDQLIYNLLKEEQTPQNKITVVGVGAVGMACAISILMKDLADELALVDVIEDKLKGEMMDLQHGSLFL

SEQ ID NO: 44853 - protein, 361 aa, Homo sapiens
  Payload ID: 9135
  Gene Symbol: LDHA
  Gene Name: lactate dehydrogenase A
  Uniprot ID: P00338
  ENSP ID: ENSP00000445175
MGEPSGGYTYTQTSIFLFHAKIPFGSKSNMATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKEQWKEVHKQVVESAYEVIKLKGYTSWAIGLSVADLAESIMKNLRRVHPVSTMIKGLYGIKDDVFLSVPCILGQNGISDLVKVTLTSEEEARLKKSADTLWGIQKELQF

SEQ ID NO: 44854 - protein, 332 aa, Homo sapiens; identical to SEQ ID NO: 44839
  Payload ID: 9135
  Gene Symbol: LDHA
  Gene Name: lactate dehydrogenase A
  Uniprot ID: P00338
  ENSP ID: ENSP00000445331

SEQ ID NO: 44855 - protein, 114 aa, Homo sapiens
  Payload ID: 9135
  Gene Symbol: LDHA
  Gene Name: lactate dehydrogenase A
  ENSP ID: ENSP00000446415
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNV

SEQ ID NO: 44856 - protein, 46 aa, Homo sapiens; identical to SEQ ID NO: 44844
  Payload ID: 9135
  Gene Symbol: LDHA
  Gene Name: lactate dehydrogenase A
  ENSP ID: ENSP00000486249

SEQ ID NO: 44857 - protein, 332 aa, Homo sapiens
  Payload ID: 9136
  Gene Symbol: LDHAL6A
  Gene Name: lactate dehydrogenase A-like 6A
  Uniprot ID: Q6ZMR3
  ENSP ID: ENSP00000280706
MATIKSELIKNFAEEEAIHHNKISIVGTGSVGVACAISILLKGLSDELVLVDVDEGKLKGETMDLQHGSPFMKMPNIVSSKDYLVTANSNLVIITAGARQKKGETRLDLVQRNVSIFKLMIPNITQYSPHCKLLIVTNPVDILTYVAWKLSGFPKNRVIGSGCNLDSARFRYFIGQRLGIHSESCHGLILGEHGDSSVPVWSGVNIAGVPLKDLNPDIGTDKDPEQWENVHKKVISSGYEMVKMKGYTSWGISLSVADLTESILKNLRRVHPVSTLSKGLYGINEDIFLSVPCILGENGITDLIKVKLTLEEEACLQKSAETLWEIQKELKL

SEQ ID NO: 44858 - protein, 332 aa, Homo sapiens; identical to SEQ ID NO: 44857
  Payload ID: 9136
  Gene Symbol: LDHAL6A
  Gene Name: lactate dehydrogenase A-like 6A
  Uniprot ID: Q6ZMR3
  ENSP ID: ENSP00000379516

SEQ ID NO: 44859 - protein, 233 aa, Homo sapiens
  Payload ID: 9136
  Gene Symbol: LDHAL6A
  Gene Name: lactate dehydrogenase A-like 6A
  ENSP ID: ENSP00000478764
MATIKSELIKNFAEEEAIHHNKISIVGTGSVGVACAISILLKGLSDELVLVDVDEGKLKGETMDLQHGSPFMKMPNIVSSKDYLVTANSNLVIITAGARQKKGETRLDLVQRNVSIFKLMIPNITQYSPHCKLLIVTNPVDILTYVAWKLSGFPKNRVIGSGCNLDSARFRYFIGQRLGIHSESCHGLILGEHGDSSVPVWSGVNIAGVPLKDLNPDIGTDKDPEQWENVHKK

SEQ ID NO: 44860 - protein, 381 aa, Homo sapiens
  Payload ID: 9137
  Gene Symbol: LDHAL6B
  Gene Name: lactate dehydrogenase A-like 6B
  Uniprot ID: Q9BYZ2
  ENSP ID: ENSP00000302393
MSWTVPVVRASQRVSSVGANFLCLGMALCPRQATRIPLNGTWLFTPVSKMATVKSELIERFTSEKPVHHSKVSIIGTGSVGMACAISILLKGLSDELALVDLDEDKLKGETMDLQHGSPFTKMPNIVCSKDYFVTANSNLVIITAGARQEKGETRLNLVQRNVAIFKLMISSIVQYSPHCKLIIVSNPVDILTYVAWKLSAFPKNRIIGSGCNLDTARFRFLIGQKLGIHSESCHGWILGEHGDSSVPVWSGVNIAGVPLKDLNSDIGTDKDPEQWKNVHKEVTATAYEIIKMKGYTSWAIGLSVADLTESILKNLRRIHPVSTIIKGLYGIDEEVFLSIPCILGENGITNLIKIKLTPEEEAHLKKSAKTLWEIQNKLKL

SEQ ID NO: 44861 - protein, 334 aa, Homo sapiens
  Payload ID: 9138
  Gene Symbol: LDHB
  Gene Name: lactate dehydrogenase B
  Uniprot ID: P07195
  ENSP ID: ENSP00000229319
MATLKEKLIAPVAEEEATVPNNKITVVGVGQVGMACAISILGKSLADELALVDVLEDKLKGEMMDLQHGSLFLQTPKIVADKDYSVTANSKIVVVTAGVRQQEGESRLNLVQRNVNVFKFIIPQIVKYSPDCIIIVVSNPVDILTYVTWKLSGLPKHRVIGSGCNLDSARFRYLMAEKLGIHPSSCHGWILGEHGDSSVAVWSGVNVAGVSLQELNPEMGTDNDSENWKEVHKMVVESAYEVIKLKGYTNWAIGLSVADLIESMLKNLSRIHPVSTMVKGMYGIENEVFLSLPCILNARGLTSVINQKLKDDEVAQLKKSADTLWDIQKDLKDL

SEQ ID NO: 44862 - protein, 232 aa, Homo sapiens
  Payload ID: 9138
  Gene Symbol: LDHB
  Gene Name: lactate dehydrogenase B
  ENSP ID: ENSP00000379385
MATLKEKLIAPVAEEEATVPNNKITVVGVGQVGMACAISILGKSLADELALVDVLEDKLKGEMMDLQHGSLFLQTPKIVADKDYSVTANSKIVVVTAGVRQQEGESRLNLVQRNVNVFKFIIPQIVKYSPDCIIIVVSNPVDILTYVTWKLSGLPKHRVIGSGCNLDSARFRYLMAEKLGIHPSSCHGWILGEHGDSSVAVWSGVNVAGVSLQELNPEMGTDNDSENWKEVH

SEQ ID NO: 44863 - protein, 334 aa, Homo sapiens; identical to SEQ ID NO: 44861
  Payload ID: 9138
  Gene Symbol: LDHB
  Gene Name: lactate dehydrogenase B
  Uniprot ID: P07195
  ENSP ID: ENSP00000379386

SEQ ID NO: 44864 - protein, 136 aa, Homo sapiens
  Payload ID: 9138
  Gene Symbol: LDHB
  Gene Name: lactate dehydrogenase B
  ENSP ID: ENSP00000398015
MATLKEKLIAPVAEEEATVPNNKITVVGVGQVGMACAISILGKSLADELALVDVLEDKLKGEMMDLQHGSLFLQTPKIVADKDYSVTANSKIVVVTAGVRQQEGESRLNLVQRNVNVFKFIIPQIVKYSPDCIIIV

SEQ ID NO: 44865 - protein, 102 aa, Homo sapiens
  Payload ID: 9138
  Gene Symbol: LDHB
  Gene Name: lactate dehydrogenase B
  ENSP ID: ENSP00000442680
MATLKEKLIAPVAEEEATVPNNKITVVGVGQVGMACAISILGKSLADELALVDVLEDKLKGEMMDLQHGSLFLQTPKIVADKDYSVTANSKIVVVTAGVRQQ

SEQ ID NO: 44866 - protein, 332 aa, Homo sapiens
  Payload ID: 9139
  Gene Symbol: LDHC
  Gene Name: lactate dehydrogenase C
  Uniprot ID: P07864
  ENSP ID: ENSP00000280704
MSTVKEQLIEKLIEDDENSQCKITIVGTGAVGMACAISILLKDLADELALVDVALDKLKGEMMDLQHGSLFFSTSKITSGKDYSVSANSRIVIVTAGARQQEGETRLALVQRNVAIMKSIIPAIVHYSPDCKILVVSNPVDILTYIVWKISGLPVTRVIGSGCNLDSARFRYLIGEKLGVHPTSCHGWIIGEHGDSSVPLWSGVNVAGVALKTLDPKLGTDSDKEHWKNIHKQVIQSAYEIIKLKGYTSWAIGLSVMDLVGSILKNLRRVHPVSTMVKGLYGIKEELFLSIPCVLGRNGVSDVVKINLNSEEEALFKKSAETLWNIQKDLIF

SEQ ID NO: 44867 - protein, 51 aa, Homo sapiens
  Payload ID: 9139
  Gene Symbol: LDHC
  Gene Name: lactate dehydrogenase C
  ENSP ID: ENSP00000379518
MSTVKEQLIEKLIEDDENSQCKITIVGTGAVGMACAISILLKITVYLQTPE

SEQ ID NO: 44868 - protein, 332 aa, Homo sapiens; identical to SEQ ID NO: 44866
  Payload ID: 9139
  Gene Symbol: LDHC
  Gene Name: lactate dehydrogenase C
  Uniprot ID: P07864
  ENSP ID: ENSP00000437783

SEQ ID NO: 44869 - protein, 51 aa, Homo sapiens; identical to SEQ ID NO: 44867
  Payload ID: 9139
  Gene Symbol: LDHC
  Gene Name: lactate dehydrogenase C
  ENSP ID: ENSP00000438196

SEQ ID NO: 44870 - protein, 241 aa, Homo sapiens
  Payload ID: 9139
  Gene Symbol: LDHC
  Gene Name: lactate dehydrogenase C
  ENSP ID: ENSP00000439060
MSTVKEQLIEKLIEDDENSQCKITIVGTGAVGMACAISILLKDLADELALVDVALDKLKGEMMDLQHGSLFFSTSKITSGKDYSVSANSRIVIVTAGARQQEGETRLALVQRNVAIMKSIIPAIVHYSPDCKILVVSNPVDILTYIVWKISGLPVTRVIGSGCNLDSARFRYLIGEKLGVHPTSCHGWIIGEHGDSSVPLWSGVNVAGVALKTLDPKLGTDSDKEHWKNIHKQVIQRDYME

SEQ ID NO: 44871 - protein, 318 aa, Homo sapiens
  Payload ID: 9139
  Gene Symbol: LDHC
  Gene Name: lactate dehydrogenase C
  ENSP ID: ENSP00000439555
MSTVKEQLIEKLIEDDENSQCKITIVGTGAVGMACAISILLKDLADELALVDVALDKLKGEMMDLQHGSLFFSTSKITSGKAGARQQEGETRLALVQRNVAIMKSIIPAIVHYSPDCKILVVSNPVDILTYIVWKISGLPVTRVIGSGCNLDSARFRYLIGEKLGVHPTSCHGWIIGEHGDSSVPLWSGVNVAGVALKTLDPKLGTDSDKEHWKNIHKQVIQSAYEIIKLKGYTSWAIGLSVMDLVGSILKNLRRVHPVSTMVKGLYGIKEELFLSIPCVLGRNGVSDVVKINLNSEEEALFKKSAETLWNIQKDLIF

SEQ ID NO: 44872 - protein, 167 aa, Homo sapiens
  Payload ID: 9139
  Gene Symbol: LDHC
  Gene Name: lactate dehydrogenase C
  ENSP ID: ENSP00000441478
MSTVKEQLIEKLIEDDENSQCKITIVGTGAVGMACAISILLKDLADELALVDVALDKLKGEMMDLQHGSLFFSTSKITSGKDYSVSANSRIVIVTAGARQQEGETRLALVQRNVAIMKSIIPAIVHYSPDCKILVVSNPGIIWNKRRTLSQYPLCLGAEWCLRCCEN

SEQ ID NO: 44873 - protein, 45 aa, Homo sapiens
  Payload ID: 9139
  Gene Symbol: LDHC
  Gene Name: lactate dehydrogenase C
  ENSP ID: ENSP00000441991
MSTVKEQLIEKLIEDDENSQCKITIVGTGAVGMACAISILLKWIF

SEQ ID NO: 44874 - protein, 183 aa, Homo sapiens
  Payload ID: 9139
  Gene Symbol: LDHC
  Gene Name: lactate dehydrogenase C
  ENSP ID: ENSP00000443414
MSTVKEQLIEKLIEDDENSQCKITIVGTGAVGMACAISILLKDLADELALVDVALDKLKGEMMDLQHGSLFFSTSKITSGKVDILTYIVWKISGLPVTRVIGSGCNLDSARFRYLIGEKLGVHPTSCHGWIIGEHGDSSVPLWSGVNVAGVALKTLDPKLGTDSDKEHWKNIHKQVIQRDYME

SEQ ID NO: 44875 - protein, 225 aa, Homo sapiens
  Payload ID: 9139
  Gene Symbol: LDHC
  Gene Name: lactate dehydrogenase C
  ENSP ID: ENSP00000443997
MSTVKEQLIEKLIEDDENSQCKITIVGTGAVGMACAISILLKDLADELALVDVALDKLKGEMMDLQHGSLFFSTSKITSGKDYSVSANSRIVIVTAGARQQEGETRLALVQRNVAIMKSIIPAIVHYSPDCKILVVSNPVDILTYIVWKISGLPVTRVIGSGCNLDSARFRYLIGEKLGVHPTSCHGWIIGEHGDSSGIIWNKRRTLSQYPLCLGAEWCLRCCEN

SEQ ID NO: 44876 - protein, 507 aa, Homo sapiens
  Payload ID: 9140
  Gene Symbol: LDHD
  Gene Name: lactate dehydrogenase D
  Uniprot ID: Q86WU2
  ENSP ID: ENSP00000300051
MARLLRSATWELFPWRGYCSQKAKGELCRDFVEALKAVVGGSHVSTAAVVREQHGRDESVHRCEPPDAVVWPQNVEQVSRLAALCYRQGVPIIPFGTGTGLEGGVCAVQGGVCVNLTHMDRILELNQEDFSVVVEPGVTRKALNAHLRDSGLWFPVDPGADASLCGMAATGASGTNAVRYGTMRDNVLNLEVVLPDGRLLHTAGRGRHFRFGFWPEIPHHTAWYSPCVSLGRRKSAAGYNLTGLFVGSEGTLGLITATTLRLHPAPEATVAATCAFPSVQAAVDSTVHILQAAVPVARIEFLDEVMMDACNRYSKLNCLVAPTLFLEFHGSQQALEEQLQRTEEIVQQNGASDFSWAKEAEERSRLWTARHNAWYAALATRPGCKGYSTDVCVPISRLPEIVVQTKEDLNASGLTGSIVGHVGDGNFHCILLVNPDDAEELGRVKAFAEQLGRRALALHGTCTGEHGIGMGKRQLLQEEVGAVGVETMRQLKAVLDPQGLMNPGKVL

SEQ ID NO: 44877 - protein, 484 aa, Homo sapiens
  Payload ID: 9140
  Gene Symbol: LDHD
  Gene Name: lactate dehydrogenase D
  Uniprot ID: Q86WU2
  ENSP ID: ENSP00000417011
MARLLRSATWELFPWRGYCSQKAKGELCRDFVEALKAVVGGSHVSTAAVVREQHGRDESVHRCEPPDAVVWPQNVEQVSRLAALCYRQGVPIIPFGTGTGLEGGVCAVQGGVCVNLTHMDRILELNQEDFSVVVEPGVTRKALNAHLRDSGLWFPVDPGADASLCGMAATGASGTNAVRYGTMRDNVLNLEVVLPDGRLLHTAGRGRHFRKSAAGYNLTGLFVGSEGTLGLITATTLRLHPAPEATVAATCAFPSVQAAVDSTVHILQAAVPVARIEFLDEVMMDACNRYSKLNCLVAPTLFLEFHGSQQALEEQLQRTEEIVQQNGASDFSWAKEAEERSRLWTARHNAWYAALATRPGCKGYSTDVCVPISRLPEIVVQTKEDLNASGLTGSIVGHVGDGNFHCILLVNPDDAEELGRVKAFAEQLGRRALALHGTCTGEHGIGMGKRQLLQEEVGAVGVETMRQLKAVLDPQGLMNPGKVL

SEQ ID NO: 44878 - protein, 35 aa, Homo sapiens
  Payload ID: 9140
  Gene Symbol: LDHD
  Gene Name: lactate dehydrogenase D
  ENSP ID: ENSP00000454260
MARLLRSATWELFPWRGYCSQKAKVPGEKRSPLEG

SEQ ID NO: 44879 - protein, 481 aa, Homo sapiens
  Payload ID: 9141
  Gene Symbol: LACE1
  Gene Name: lactation elevated 1
  Uniprot ID: Q8WV93
  ENSP ID: ENSP00000357973
MAASWSLLVTLRPLAQSPLRGRCVGCGAWAAALAPLATAPGKPFWKAYTVQTSESMTPTATSETYLKALAVCHGPLDHYDFLIKAHELKDDEHQRRVIQCLQKLHEDLKGYNIEAEGLFSKLFSRSKPPRGLYVYGDVGTGKTMVMDMFYAYVEMKRKKRVHFHGFMLDVHKRIHRLKQSLPKRKPGFMAKSYDPIAPIAEEISEEACLLCFDEFQVTDIADAMILKQLFENLFKNGVVVVATSNRPPEDLYKNGLQRANFVPFIAVLKEYCNTVQLDSGIDYRKRELPAAGKLYYLTSEADVEAVMDKLFDELAQKQNDLTRPRILKVQGRELRLNKACGTVADCTFEELCERPLGASDYLELSKNFDTIFLRNIPQFTLANRTQGRRFITLIDNFYDLKVRIICSASTPISSLFLHQHHDSELEQSRILMDDLGLSQDSAEGLSMFTGEEEIFAFQRTISRLTEMQTEQYWNEGDRTKK

SEQ ID NO: 44880 - protein, 160 aa, Homo sapiens
  Payload ID: 9141
  Gene Symbol: LACE1
  Gene Name: lactation elevated 1
  ENSP ID: ENSP00000392085
MCATPPSLNFKKLAYTVQTSESMTPTATSETYLKALAVCHGPLDHYDFLIKAHELKDDEHQRRVIQCLQKLHEDLKGYNIEAEGLFSKLFSRSKPPRGLYVYGDVGTGKTMVMDMFYAYVEMKRKKRVHFHGFMLDVHKRIHRLKQSLPKRKPGFMAKSY

SEQ ID NO: 44881 - protein, 349 aa, Homo sapiens
  Payload ID: 9141
  Gene Symbol: LACE1
  Gene Name: lactation elevated 1
  ENSP ID: ENSP00000398225
  MOD_RES (1)..(1): Any amino acid
XKPFWKGTGKTMVMDMFYAYVEMKRKKRVHFHGFMLDVHKRIHRLKQSLPKRKPGFMAKSYDPIAPIAEEISEEACLLCFDEFQVTDIADAMILKQLFENLFKNGVVVVATSNRPPEDLYKNGLQRANFVPFIAVLKEYCNTVQLDSGIDYRKRELPAAGKLYYLTSEADVEAVMDKLFDELAQKQNDLTRPRILKVQGRELRLNKACGTVADCTFEELCERPLGASDYLELSKNFDTIFLRNIPQFTLANRTQGRRFITLIDNFYDLKVRIICSASTPISSLFLHQHHDSELEQSRILMDDLGLSQDSAEGLSMFTGEEEIFAFQRTISRLTEMQTEQYWNEGDRTKK

SEQ ID NO: 44882 - protein, 80 aa, Homo sapiens
  Payload ID: 9141
  Gene Symbol: LACE1
  Gene Name: lactation elevated 1
  ENSP ID: ENSP00000415484
  MOD_RES (1)..(1): Any amino acid
XIHRLKQSLPKRKPGFMAKSYDPIAPIAEEISEEACLLCFDEFQVTDIADAMILKQLFENLFKNGVVVVATSNRPPEGIL

SEQ ID NO: 44883 - protein, 712 aa, Homo sapiens
  Payload ID: 9142
  Gene Symbol: LPO
  Gene Name: lactoperoxidase
  Uniprot ID: P22079
  ENSP ID: ENSP00000262290
MRVLLHLPALLASLILLQAAASTTRAQTTRTSAISDTVSQAKVQVNKAFLDSRTRLKTAMSSETPTSRQLSEYLKHAKGRTRTAIRNGQVWEESLKRLRQKASLTNVTDPSLDLTSLSLEVGCGAPAPVVRCDPCSPYRTITGDCNNRRKPALGAANRALARWLPAEYEDGLSLPFGWTPGKTRNGFPLPLAREVSNKIVGYLNEEGVLDQNRSLLFMQWGQIVDHDLDFAPDTELGSSEYSKAQCDEYCIQGDNCFPIMFPPNDPKAGTQGKCMPFFRAGFVCPTPPYKSLAREQINALTSFLDASFVYSSEPSLASRLRNLSSPLGLMAVNQEVSDHGLPYLPYDSKKPSPCEFINTTARVPCFLAGDSRASEHILLATSHTLFLREHNRLARELKRLNPQWDGEKLYQEARKILGAFVQIITFRDYLPILLGDHMQKWIPPYQGYSESVDPRISNVFTFAFRFGHLEVPSSMFRLDENYQPWGPEPELPLHTLFFNTWRMVKDGGIDPLVRGLLAKKSKLMKQNKMMTGELRNKLFQPTHRIHGFDLAAINTQRCRDHGQPGYNSWRAFCDLSQPQTLEELNTVLKSKMLAKKLLGLYGTPDNIDIWIGAIAEPLVERGRVGPLLACLLGKQFQQIRDGDRFWWENPGVFTNEQKDSLQKMSFSRLVCDNTRITKVPRDPFWANSYPYDFVDCSAIDKLDLSPWASVKN

SEQ ID NO: 44884 - protein, 117 aa, Homo sapiens
  Payload ID: 9142
  Gene Symbol: LPO
  Gene Name: lactoperoxidase
  ENSP ID: ENSP00000374227
FPPNDPKAGTQGKCMPFFRAGFVCPTPPYKSLAREQINALTSFLDASFVYSSEPSLASRLRNLSSPLGLMAVNQEVSDHGLPYLPYDSKKPSPCEFINTTARVPCFLAGKETEAQKC

SEQ ID NO: 44885 - protein, 629 aa, Homo sapiens
  Payload ID: 9142
  Gene Symbol: LPO
  Gene Name: lactoperoxidase
  Uniprot ID: P22079
  ENSP ID: ENSP00000400245
MRVLLHLPALLASLILLQAAASTTRDPSLDLTSLSLEVGCGAPAPVVRCDPCSPYRTITGDCNNRRKPALGAANRALARWLPAEYEDGLSLPFGWTPGKTRNGFPLPLAREVSNKIVGYLNEEGVLDQNRSLLFMQWGQIVDHDLDFAPDTELGSSEYSKAQCDEYCIQGDNCFPIMFPPNDPKAGTQGKCMPFFRAGFVCPTPPYKSLAREQINALTSFLDASFVYSSEPSLASRLRNLSSPLGLMAVNQEVSDHGLPYLPYDSKKPSPCEFINTTARVPCFLAGDSRASEHILLATSHTLFLREHNRLARELKRLNPQWDGEKLYQEARKILGAFVQIITFRDYLPILLGDHMQKWIPPYQGYSESVDPRISNVFTFAFRFGHLEVPSSMFRLDENYQPWGPEPELPLHTLFFNTWRMVKDGGIDPLVRGLLAKKSKLMKQNKMMTGELRNKLFQPTHRIHGFDLAAINTQRCRDHGQPGYNSWRAFCDLSQPQTLEELNTVLKSKMLAKKLLGLYGTPDNIDIWIGAIAEPLVERGRVGPLLACLLGKQFQQIRDGDRFWWENPGVFTNEQKDSLQKMSFSRLVCDNTRITKVPRDPFWANSYPYDFVDCSAIDKLDLSPWASVKN

SEQ ID NO: 44886 - protein, 653 aa, Homo sapiens
  Payload ID: 9142
  Gene Symbol: LPO
  Gene Name: lactoperoxidase
  ENSP ID: ENSP00000445344
MSSETPTSRQLSEYLKHAKGRTRTAIRNGQVWEESLKRLRQKASLTNVTDPSLDLTSLSLEVGCGAPAPVVRCDPCSPYRTITGDCNNRRKPALGAANRALARWLPAEYEDGLSLPFGWTPGKTRNGFPLPLAREVSNKIVGYLNEEGVLDQNRSLLFMQWGQIVDHDLDFAPDTELGSSEYSKAQCDEYCIQGDNCFPIMFPPNDPKAGTQGKCMPFFRAGFVCPTPPYKSLAREQINALTSFLDASFVYSSEPSLASRLRNLSSPLGLMAVNQEVSDHGLPYLPYDSKKPSPCEFINTTARVPCFLAGDSRASEHILLATSHTLFLREHNRLARELKRLNPQWDGEKLYQEARKILGAFVQIITFRDYLPILLGDHMQKWIPPYQGYSESVDPRISNVFTFAFRFGHLEVPSSMFRLDENYQPWGPEPELPLHTLFFNTWRMVKDGGIDPLVRGLLAKKSKLMKQNKMMTGELRNKLFQPTHRIHGFDLAAINTQRCRDHGQPGYNSWRAFCDLSQPQTLEELNTVLKSKMLAKKLLGLYGTPDNIDIWIGAIAEPLVERGRVGPLLACLLGKQFQQIRDGDRFWWENPGVFTNEQKDSLQKMSFSRLVCDNTRITKVPRDPFWANSYPYDFVDCSAIDKLDLSPWASVKN

SEQ ID NO: 44887 - protein, 95 aa, Homo sapiens
  Payload ID: 9142
  Gene Symbol: LPO
  Gene Name: lactoperoxidase
  ENSP ID: ENSP00000462752
GCGAPAPVVRCDPCSPYRTITGDCNNRRKPALGAANRALARWLPAEYEDGLSLPFGWTPGKTRNGFPLPLAREVSNKIVGYLNEEGVLDQNRSTL

SEQ ID NO: 44888 - protein, 629 aa, Homo sapiens; identical to SEQ ID NO: 44885
  Payload ID: 9142
  Gene Symbol: LPO
  Gene Name: lactoperoxidase
  Uniprot ID: P22079
  ENSP ID: ENSP00000464636

SEQ ID NO: 44889 - protein, 123 aa, Homo sapiens
  Payload ID: 9142
  Gene Symbol: LPO
  Gene Name: lactoperoxidase
  ENSP ID: ENSP00000464643
MSSETPTSRQLSEYLKHAKGRTRTAIRNGQVWEESLKRLRQKASLTNVTDPSLDLTSLSLEVGCGAPAPVVRCDPCSPYRTITGDCNNRRKPALGAANRALARWLPAEYEDGLSLPFGWTPGK

SEQ ID NO: 44890 - protein, 710 aa, Homo sapiens
  Payload ID: 9143
  Gene Symbol: LTF
  Gene Name: lactotransferrin
  Uniprot ID: P02788
  ENSP ID: ENSP00000231751
MKLVFLVLLFLGALGLCLAGRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 44891 - protein, 182 aa, Homo sapiens
  Payload ID: 9143
  Gene Symbol: LTF
  Gene Name: lactotransferrin
  ENSP ID: ENSP00000395234
MKLVFLVLLFLGALGFLWMPFIRQPGLCLAGRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARF

SEQ ID NO: 44892 - protein, 696 aa, Homo sapiens
  Payload ID: 9143
  Gene Symbol: LTF
  Gene Name: lactotransferrin
  ENSP ID: ENSP00000397427
MGLCLAGRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLR

SEQ ID NO: 44893 - protein, 708 aa, Homo sapiens
  Payload ID: 9143
  Gene Symbol: LTF
  Gene Name: lactotransferrin
  ENSP ID: ENSP00000405546
MKLVFLVLLFLGALGLCLAGRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 44894 - protein, 666 aa, Homo sapiens
  Payload ID: 9143
  Gene Symbol: LTF
  Gene Name: lactotransferrin
  Uniprot ID: P02788
  ENSP ID: ENSP00000405719
MRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 44895 - protein, 531 aa, Homo sapiens
  Payload ID: 9144
  Gene Symbol: LAD1
  Gene Name: ladinin 1
  ENSP ID: ENSP00000356282
MRLCLGRPHPRGHSRVGKSERGRGARGLARQRTLEDEEEQERERRRRHRNLSSTTDDEAPRLSQNGDRQASASERLPSVEEAEVPKPLPPASKDEDEDIQSILRTRQERRQRRQVVEAAQAPIQERLEAEEGRNSLSPVQATQKPLVSKKELEIPPRRRLSREQRGPWALEEESLVGREPEERKKGVPEKSPVLEKSSMPKKTAPEKSLVSDKTSISEKVLASEKTSLSEKIAVSEKRNSSEKKSVLEKTSVSEKSLAPGMALGSGRRLVSEKASIFEKALASEKSPTADAKPAPKRATASEQPLAQEPPASGGSPATTKEQRGRALPGKNLPSLAKQGASDPPTVASRLPPVTLQVKIPSKEEEADMSSPTQRTYSSSLKRSSPRTISFRMKPKKENSETTLTRSASMKLPDNTVKLGEKLERYHTAIRRSESVKSRGLPCTELFVAPVGVASKRHLFEKELAGQSRAEPASSRKENLRLSGVVTSRLNLWISRTQESGDQDPQEAQKASSATERTQWGQKSDSSLDAEV

SEQ ID NO: 44896 - protein, 517 aa, Homo sapiens
  Payload ID: 9144
  Gene Symbol: LAD1
  Gene Name: ladinin 1
  Uniprot ID: O00515
  ENSP ID: ENSP00000375829
MAVSRKDWSALSSLARQRTLEDEEEQERERRRRHRNLSSTTDDEAPRLSQNGDRQASASERLPSVEEAEVPKPLPPASKDEDEDIQSILRTRQERRQRRQVVEAAQAPIQERLEAEEGRNSLSPVQATQKPLVSKKELEIPPRRRLSREQRGPWALEEESLVGREPEERKKGVPEKSPVLEKSSMPKKTAPEKSLVSDKTSISEKVLASEKTSLSEKIAVSEKRNSSEKKSVLEKTSVSEKSLAPGMALGSGRRLVSEKASIFEKALASEKSPTADAKPAPKRATASEQPLAQEPPASGGSPATTKEQRGRALPGKNLPSLAKQGASDPPTVASRLPPVTLQVKIPSKEEEADMSSPTQRTYSSSLKRSSPRTISFRMKPKKENSETTLTRSASMKLPDNTVKLGEKLERYHTAIRRSESVKSRGLPCTELFVAPVGVASKRHLFEKELAGQSRAEPASSRKENLRLSGVVTSRLNLWISRTQESGDQDPQEAQKASSATERTQWGQKSDSSLDAEV

SEQ ID NO: 44897 - protein, 192 aa, Homo sapiens
  Payload ID: 9144
  Gene Symbol: LAD1
  Gene Name: ladinin 1
  ENSP ID: ENSP00000422687
EEADMSSPTQRTYSSSLKRSSPRTISFRMKPKKENSETTLTRSASMKLPDNTVKLGEKLERYHTAIRRSESVKSRGLPCTELFVAPVGVASKRHLFEKELAGQSRAEPASSRKENLRLSGVVTSRLNLWISRTQESGDQDPQEAQKASSATERTQWGQKSDSSLDAESPLRLSRRLQDLSAAAVLRESRDHV

SEQ ID NO: 44898 - protein, 178 aa, Homo sapiens
  Payload ID: 9144
  Gene Symbol: LAD1
  Gene Name: ladinin 1
  ENSP ID: ENSP00000487726
MAQLFPRSSFHLKGEGGSKSPWEVKGRRYWSFFHGLARQRTLEDEEEQERERRRRHRNLSSTTDDEAPRLSQNGDRQASASERLPSVEEAEVPKPLPPASKDEDEDIQSILRTRQERRQRRQVVEAAQAPIQERLEAEEGRNSLSPVQATQKPLVSKKELEIPPRRRLSREQRGPWAL

SEQ ID NO: 44899 - protein, 188 aa, Homo sapiens
  Payload ID: 9144
  Gene Symbol: LAD1
  Gene Name: ladinin 1
  ENSP ID: ENSP00000487828
SHPDEAPGTEDRSRSAPWVNKPQRAGRKGLLARQRTLEDEEEQERERRRRHRNLSSTTDDEAPRLSQNGDRQASASERLPSVEEAEVPKPLPPASKDEDEDIQSILRTRQERRQRRQVVEAAQAPIQERLEAEEGRNSLSPVQATQKPLVSKKELEIPPRRRLSREQRGPWALEEESLVGREPEERKK

SEQ ID NO: 44900 - protein, 183 aa, Homo sapiens
  Payload ID: 9144
  Gene Symbol: LAD1
  Gene Name: ladinin 1
  ENSP ID: ENSP00000488829
IHLSEAYWDGGPGLARQRTLEDEEEQERERRRRHRNLSSTTDDEAPRLSQNGDRQASASERLPSVEEAEVPKPLPPASKDEDEDIQSILRTRQERRQRRQVVEAAQAPIQERLEAEEGRNSLSPVQATQKPLVSKKELEIPPRRRLSREQRGPWALEEESLVGREPEERKKGVPEKSPVLEKS

SEQ ID NO: 44901 - protein, 281 aa, Homo sapiens
  Payload ID: 9145
  Gene Symbol: LBX1
  Gene Name: ladybird homeobox 1
  Uniprot ID: P52954
  ENSP ID: ENSP00000359212
MTSKEDGKAAPGEERRRSPLDHLPPPANSNKPLTPFSIEDILNKPSVRRSYSLCGAAHLLAAADKHAQGGLPLAGRALLSQTSPLCALEELASKTFKGLEVSVLQAAEGRDGMTIFGQRQTPKKRRKSRTAFTNHQIYELEKRFLYQKYLSPADRDQIAQQLGLTNAQVITWFQNRRAKLKRDLEEMKADVESAKKLGPSGQMDIVALAELEQNSEATAGGGGGCGRAKSRPGSPVLPPGAPKAPGAGALQLSPASPLTDQPASSQDCSEDEEDEEIDVDD

SEQ ID NO: 44902 - protein, 198 aa, Homo sapiens
  Payload ID: 9146
  Gene Symbol: LBX2
  Gene Name: ladybird homeobox 2
  Uniprot ID: Q6XYB7
  ENSP ID: ENSP00000366789
MNSGREPRTPRTLLSIADILAPRMVPRAPSAPQLPESGPGPTSPLCALEELTSKTFRGLDARALQPSEGRAGPDALGPGPFGRKRRKSRTAFTAQQVLELERRFVFQKYLAPSERDGLATRLGLANAQVVTWFQNRRAKLKRDVEEMRADVASLRALSPEVLCSLALPEGAPDPGLCLGPAGPDSRPHLSDEEIQVDD

SEQ ID NO: 44903 - protein, 194 aa, Homo sapiens
  Payload ID: 9146
  Gene Symbol: LBX2
  Gene Name: ladybird homeobox 2
  Uniprot ID: Q6XYB7
  ENSP ID: ENSP00000417116
MGKRTSLEVSLGELGGEKCRGGRRSFPPLAASRPARPGGWRWARRDLCKTASRAENNSQACRPQRRAGPDALGPGPFGRKRRKSRTAFTAQQVLELERRFVFQKYLAPSERDGLATRLGLANAQVVTWFQNRRAKLKRDVEEMRADVASLRALSPEVLCSLALPEGAPDPGLCLGPAGPDSRPHLSDEEIQVDD

SEQ ID NO: 44904 - protein, 57 aa, Homo sapiens
  Payload ID: 9146
  Gene Symbol: LBX2
  Gene Name: ladybird homeobox 2
  ENSP ID: ENSP00000450229
MGKRTSLEGGQVRTRWALVPSAANGASHALRSPRNRCWSWSGASSSRSTWRRPSETG

SEQ ID NO: 44905 - protein, 990 aa, Homo sapiens
  Payload ID: 9147
  Gene Symbol: LVRN
  Gene Name: laeverin
  Uniprot ID: Q6Q4G3
  ENSP ID: ENSP00000350541
MGPPSSSGFYVSRAVALLLAGLVAALLLALAVLAALYGHCERVPPSELPGLRDLEAESSPPLRQKPTPTPKPSSARELAVTTTPSNWRPPGPWDQLRLPPWLVPLHYDLELWPQLRPDELPAGSLPFTGRVNITVRCTVATSRLLLHSLFQDCERAEVRGPLSPGTGNATVGRVPVDDVWFALDTEYMVLELSEPLKPGSSYELQLSFSGLVKEDLREGLFLNVYTDQGERRALLASQLEPTFARYVFPCFDEPALKATFNITMIHHPSYVALSNMPKLGQSEKEDVNGSKWTVTTFSTTPHMPTYLVAFVICDYDHVNRTERGKEIRIWARKDAIANGSADFALNITGPIFSFLEDLFNISYSLPKTDIIALPSFDNHAMENWGLMIFDESGLLLEPKDQLTEKKTLISYVVSHEIGHQWFGNLVTMNWWNNIWLNEGFASYFEFEVINYFNPKLPRNEIFFSNILHNILREDHALVTRAVAMKVENFKTSEIQELFDIFTYSKGASMARMLSCFLNEHLFVSALKSYLKTFSYSNAEQDDLWRHFQMAIDDQSTVILPATIKNIMDSWTHQSGFPVITLNVSTGVMKQEPFYLENIKNRTLLTSNDTWIVPILWIKNGTTQPLVWLDQSSKVFPEMQVSDSDHDWVILNLNMTGYYRVNYDKLGWKKLNQQLEKDPKAIPVIHRLQLIDDAFSLSKNNYIEIETALELTKYLAEEDEIIVWHTVLVNLVTRDLVSEVNIYDIYSLLKRYLLKRLNLIWNIYSTIIRENVLALQDDYLALISLEKLFVTACWLGLEDCLQLSKELFAKWVDHPENEIPYPIKDVVLCYGIALGSDKEWDILLNTYTNTTNKEEKIQLAYAMSCSKDPWILNRYMEYAISTSPFTSNETNIIEVVASSEVGRYVAKDFLVNNWQAVSKRYGTQSLINLIYTIGRTVTTDLQIVELQQFFSNMLEEHQRIRVHANLQTIKNENLKNKKLSARIAAWLRRNT

SEQ ID NO: 44906 - protein, 978 aa, Homo sapiens
  Payload ID: 9147
  Gene Symbol: LVRN
  Gene Name: laeverin
  ENSP ID: ENSP00000378899
MGPPSSSGFYVSRAVALLLAGLVAALLLALAVLAALYGHCERVPPSELPGLRDLEAESSPPLRQKPTPTPKPSSARELAVTTTPSNWRPPGPWDQLRLPPWLVPLHYDLELWPQLRPDELPAGSLPFTGRVNITVRCTVATSRLLLHSLFQDCERAEVRGPLSPDDVWFALDTEYMVLELSEPLKPGSSYELQLSFSGLVKEDLREGLFLNVYTDQGERRALLASQLEPTFARYVFPCFDEPALKATFNITMIHHPSYVALSNMPKLGQSEKEDVNGSKWTVTTFSTTPHMPTYLVAFVICDYDHVNRTERGKEIRIWARKDAIANGSADFALNITGPIFSFLEDLFNISYSLPKTDIIALPSFDNHAMENWGLMIFDESGLLLEPKDQLTEKKTLISYVVSHEIGHQWFGNLVTMNWWNNIWLNEGFASYFEFEVINYFNPKLPRNEIFFSNILHNILREDHALVTRAVAMKVENFKTSEIQELFDIFTYSKGASMARMLSCFLNEHLFVSALKSYLKTFSYSNAEQDDLWRHFQMAIDDQSTVILPATIKNIMDSWTHQSGFPVITLNVSTGVMKQEPFYLENIKNRTLLTSNDTWIVPILWIKNGTTQPLVWLDQSSKVFPEMQVSDSDHDWVILNLNMTGYYRVNYDKLGWKKLNQQLEKDPKAIPVIHRLQLIDDAFSLSKNNYIEIETALELTKYLAEEDEIIVWHTVLVNLVTRDLVSEVNIYDIYSLLKRYLLKRLNLIWNIYSTIIRENVLALQDDYLALISLEKLFVTACWLGLEDCLQLSKELFAKWVDHPENEIPYPIKDVVLCYGIALGSDKEWDILLNTYTNTTNKEEKIQLAYAMSCSKDPWILNRYMEYAISTSPFTSNETNIIEVVASSEVGRYVAKDFLVNNWQAVSKRYGTQSLINLIYTIGRTVTTDLQIVELQQFFSNMLEEHQRIRVHANLQTIKNENLKNKKLSARIAAWLRRNT

SEQ ID NO: 44907 - protein, 701 aa, Homo sapiens
  Payload ID: 9147
  Gene Symbol: LVRN
  Gene Name: laeverin
  Uniprot ID: Q6Q4G3
  ENSP ID: ENSP00000423604
MGPPSSSGFYVSRAVALLLAGLVAALLLALAVLAALYGHCERVPPSELPGLRDLEAESSPPLRQKPTPTPKPSSARELAVTTTPSNWRPPGPWDQLRLPPWLVPLHYDLELWPQLRPDELPAGSLPFTGRVNITVRCTVATSRLLLHSLFQDCERAEVRGPLSPGTGNATVGRVPVDDVWFALDTEYMVLELSEPLKPGSSYELQLSFSGLVKEDLREGLFLNVYTDQGERRALLASQLEPTFARYVFPCFDEPALKATFNITMIHHPSYVALSNMPKLGQSEKEDVNGSKWTVTTFSTTPHMPTYLVAFVICDYDHVNRTERGKEIRIWARKDAIANGSADFALNITGPIFSFLEDLFNISYSLPKTDIIALPSFDNHAMENWGLMIFDESGLLLEPKDQLTEKKTLISYVVSHEIGHQWFGNLVTMNWWNNIWLNEGFASYFEFEVINYFNPKLPRNEIFFSNILHNILREDHALVTRAVAMKVENFKTSEIQELFDIFTYSKGASMARMLSCFLNEHLFVSALKSYLKTFSYSNAEQDDLWRHFQMAIDDQSTVILPATIKNIMDSWTHQSGFPVITLNVSTGVMKQEPFYLENIKNRTLLTSNDTWIVPILWIKNGTTQPLVWLDQSSKVFPEMQVSDSDHDWVILNLNMTGYYRVNYDKLGWKKLNQQLEKDPKAIPVIHRLQLIDDAFSLSKGTY

SEQ ID NO: 44908 - protein, 198 aa, Homo sapiens
  Payload ID: 9147
  Gene Symbol: LVRN
  Gene Name: laeverin
  Uniprot ID: Q6Q4G3
  ENSP ID: ENSP00000427418
MKVENFKTSEIQELFDIFTYSKGASMARMLSCFLNEHLFVSALKSYLKTFSYSNAEQDDLWRHFQMAIDDQSTVILPATIKNIMDSWTHQSGFPVITLNVSTGVMKQEPFYLENIKNRTLLTSNDTWIVPILWIKNGTTQPLVWLDQSSKVFPEMQVSDSDHDWVILNLNMTGYYRVNYDKLGWKKLNQQLEKDPKMR

SEQ ID NO: 44909 - protein, 198 aa, Homo sapiens; identical to SEQ ID NO: 44908
  Payload ID: 9147
  Gene Symbol: LVRN
  Gene Name: laeverin
  Uniprot ID: Q6Q4G3
  ENSP ID: ENSP00000427500

SEQ ID NO: 44910 - protein, 226 aa, Homo sapiens
  Payload ID: 9147
  Gene Symbol: LVRN
  Gene Name: laeverin
  Uniprot ID: Q6Q4G3
  ENSP ID: ENSP00000427574
MKVENFKTSEIQELFDIFTYSKGASMARMLSCFLNEHLFVSALKSYLKTFSYSNAEQDDLWRHFQMAIDDQSTVILPATIKNIMDSWTHQSGFPVITLNVSTGVMKQEPFYLENIKNRTLLTSNDTWIVPILWIKNGTTQPLVWLDQSSKVFPEMQVSDSDHDWVILNLNMTGYYRVNYDKLGWKKLNQQLEKDPKAIPVIHRLQLIDDAFSLSNLQDFGHLKVPN

SEQ ID NO: 44911 - protein, 634 aa, Homo sapiens
  Payload ID: 9148
  Gene Symbol: LMNA
  Gene Name: lamin A/C
  Uniprot ID: P02545
  ENSP ID: ENSP00000292304
METPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEGSHCSSSGDPAEYNLRSRTVLCGTCGQPADKASASGSGAQVGGPISSGSSASSVTVTRSYRSVGGSGGGSFGDNLVTRSYLLGNSSPRTQSPQNCSIM

SEQ ID NO: 44912 - protein, 487 aa, Homo sapiens
  Payload ID: 9148
  Gene Symbol: LMNA
  Gene Name: lamin A/C
  ENSP ID: ENSP00000355292
METPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGNSLRTALINSTGEEVAMRKLVRSVTVVEDDEDEDGDDLLHHHHVSGSRR

SEQ ID NO: 44913 - protein, 491 aa, Homo sapiens
  Payload ID: 9148
  Gene Symbol: LMNA
  Gene Name: lamin A/C
  ENSP ID: ENSP00000357280
MQPLLCLGNLEDARERTGTLLAQHPAWGRTRAKPGSPLNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHVSGSRR

SEQ ID NO: 44914 - protein, 614 aa, Homo sapiens
  Payload ID: 9148
  Gene Symbol: LMNA
  Gene Name: lamin A/C
  Uniprot ID: P02545
  ENSP ID: ENSP00000357282
METPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHGSHCSSSGDPAEYNLRSRTVLCGTCGQPADKASASGSGAQSPQNCSIM

SEQ ID NO: 44915 - protein, 664 aa, Homo sapiens
  Payload ID: 9148
  Gene Symbol: LMNA
  Gene Name: lamin A/C
  Uniprot ID: P02545
  ENSP ID: ENSP00000357283
METPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHGSHCSSSGDPAEYNLRSRTVLCGTCGQPADKASASGSGAQVGGPISSGSSASSVTVTRSYRSVGGSGGGSFGDNLVTRSYLLGNSSPRTQSPQNCSIM

SEQ ID NO: 44916 - protein, 572 aa, Homo sapiens
  Payload ID: 9148
  Gene Symbol: LMNA
  Gene Name: lamin A/C
  Uniprot ID: P02545
  ENSP ID: ENSP00000357284
METPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHVSGSRR

SEQ ID NO: 44917 - protein, 574 aa, Homo sapiens
  Payload ID: 9148
  Gene Symbol: LMNA
  Gene Name: lamin A/C
  Uniprot ID: P02545
  ENSP ID: ENSP00000395597
MGNSEGCNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHGSHCSSSGDPAEYNLRSRTVLCGTCGQPADKASASGSGAQVGGPISSGSSASSVTVTRSYRSVGGSGGGSFGDNLVTRSYLLGNSSPRTQSPQNCSIIQEMGMRWEVEEGRRKVSLSCLP

SEQ ID NO: 44918 - protein, 565 aa, Homo sapiens
  Payload ID: 9148
  Gene Symbol: LMNA
  Gene Name: lamin A/C
  Uniprot ID: P02545
  ENSP ID: ENSP00000421821
MDLEAWDPHLEPDAEAMVDGNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHGSHCSSSGDPAEYNLRSRTVLCGTCGQPADKASASGSGAQVGGPISSGSSASSVTVTRSYRSVGGSGGGSFGDNLVTRSYLLGNSSPRTQSPQNCSIM

SEQ ID NO: 44919 - protein, 38 aa, Homo sapiens
  Payload ID: 9148
  Gene Symbol: LMNA
  Gene Name: lamin A/C
  ENSP ID: ENSP00000424518
MQPLLCLGNLEDARERTGTLLAQHPAWGRTRAKPGSPL

SEQ ID NO: 44920 - protein, 260 aa, Homo sapiens
  Payload ID: 9148
  Gene Symbol: LMNA
  Gene Name: lamin A/C
  ENSP ID: ENSP00000424977
AYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEGSHCSSSGDPAEYNLRSRTVLCGTCGQPADKASASGSGAQVGGPISSGSSASSVTVTRSYRSVGGSGGGSFGDNLVTRSYLLGNSSPRTQSPQNCSIM

SEQ ID NO: 44921 - protein, 182 aa, Homo sapiens
  Payload ID: 9148
  Gene Symbol: LMNA
  Gene Name: lamin A/C
  ENSP ID: ENSP00000426535
FLPQTAPRARACCSWGAGLPCPTRHSSSDPCLGSHFNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEK

SEQ ID NO: 44922 - protein, 615 aa, Homo sapiens
  Payload ID: 9149
  Gene Symbol: LBR
  Gene Name: lamin B receptor
  Uniprot ID: Q14739
  ENSP ID: ENSP00000272163
MPSRKFADGEVVRGRWPGSSLYYEVEILSHDSTSQLYTVKYKDGTELELKENDIKPLTSFRQRKGGSTSSSPSRRRGSRSRSRSRSPGRPPKSARRSASASHQADIKEARREVEVKLTPLILKPFGNSISRYNGEPEHIERNDAPHKNTQEKFSLSQESSYIATQYSLRPRREEVKLKEIDSKEEKYVAKELAVRTFEVTPIRAKDLEFGGVPGVFLIMFGLPVFLFLLLLMCKQKDPSLLNFPPPLPALYELWETRVFGVYLLWFLIQVLFYLLPIGKVVEGTPLIDGRRLKYRLNGFYAFILTSAVIGTSLFQGVEFHYVYSHFLQFALAATVFCVVLSVYLYMRSLKAPRNDLSPASSGNAVYDFFIGRELNPRIGTFDLKYFCELRPGLIGWVVINLVMLLAEMKIQDRAVPSLAMILVNSFQLLYVVDALWNEEALLTTMDIIHDGFGFMLAFGDLVWVPFIYSFQAFYLVSHPNEVSWPMASLIIVLKLCGYVIFRGANSQKNAFRKNPSDPKLAHLKTIHTSTGKNLLVSGWWGFVRHPNYLGDLIMALAWSLPCGFNHILPYFYIIYFTMLLVHREARDEYHCKKKYGVAWEKYCQRVPYRIFPYIY

SEQ ID NO: 44923 - protein, 615 aa, Homo sapiens; identical to SEQ ID NO: 44922
  Payload ID: 9149
  Gene Symbol: LBR
  Gene Name: lamin B receptor
  Uniprot ID: Q14739
  ENSP ID: ENSP00000339883

SEQ ID NO: 44924 - protein, 213 aa, Homo sapiens
  Payload ID: 9149
  Gene Symbol: LBR
  Gene Name: lamin B receptor
  ENSP ID: ENSP00000388059
MPSRKFADGEVVRGRWPGSSLYYEVEILSHDSTSQLYTVKYKDGTELELKENDIKPLTSFRQRKGGSTSSSPSRRRGSRSRSRSRSPGRPPKSARRSASASHQADIKEARREVEVKLTPLILKPFGNSISRYNGEPEHIERNDAPHKNTQEKFSLSQESSYIATQYSLRPRREEVKLKEIDSKEEKYVAKELAVRTFEVTPIRAKDLEFGGVP

SEQ ID NO: 44925 - protein, 51 aa, Homo sapiens
  Payload ID: 9149
  Gene Symbol: LBR
  Gene Name: lamin B receptor
  ENSP ID: ENSP00000416554
MPSRKFADGEVVRGRWPGSSLYYEVEILSHDSTSQLYTVKYKDGTELELKE

SEQ ID NO: 44926 - protein, 586 aa, Homo sapiens
  Payload ID: 9150
  Gene Symbol: LMNB1
  Gene Name: lamin B1
  Uniprot ID: P20700
  ENSP ID: ENSP00000261366
MATATPVPPRMGSRAGGPTTPLSPTRLSRLQEKEELRELNDRLAVYIDKVRSLETENSALQLQVTEREEVRGRELTGLKALYETELADARRALDDTARERAKLQIELGKCKAEHDQLLLNYAKKESDLNGAQIKLREYEAALNSKDAALATALGDKKSLEGDLEDLKDQIAQLEASLAAAKKQLADETLLKVDLENRCQSLTEDLEFRKSMYEEEINETRRKHETRLVEVDSGRQIEYEYKLAQALHEMREQHDAQVRLYKEELEQTYHAKLENARLSSEMNTSTVNSAREELMESRMRIESLSSQLSNLQKESRACLERIQELEDLLAKEKDNSRRMLTDKEREMAEIRDQMQQQLNDYEQLLDVKLALDMEISAYRKLLEGEEERLKLSPSPSSRVTVSRASSSRSVRTTRGKRKRVDVEESEASSSVSISHSASATGNVCIEEIDVDGKFIRLKNTSEQDQPMGGWEMIRKIGDTSVSYKYTSRYVLKAGQTVTIWAANAGVTASPPTDLIWKNQNSWGTGEDVKVILKNSQGEEVAQRSTVFKTTIPEEEEEEEEAAGVVVEEELFHQQGTPRASNRSCAIM

SEQ ID NO: 44927 - protein, 387 aa, Homo sapiens
  Payload ID: 9150
  Gene Symbol: LMNB1
  Gene Name: lamin B1
  ENSP ID: ENSP00000378761
MATATPVPPRMGSRAGGPTTPLSPTRLSRLQEKEELRELNDRLAVYIDKVRSLETENSALQLQVTEREEVRGRELTGLKALYETELADARRALDDTARERAKLQIELGKCKAEHDQLLLNYAKKESDLNGAQIKLREYEAALNSKDAALATALGDKKSLEGDLEDLKDQIAQLEASLAAAKKQLADETLLKVDLENRCQSLTEDLEFRKSMYEEEINETRRKHETRLVEVDSGRQIEYEYKLAQALHEMREQHDAQVRLYKEELEQTYHAKLENARLSSEMNTSTVNSAREELMESRMRIESLSSQLSNLQKESRACLERIQELEDLLAKEKDNSRRMLTDKEREMAEIRDQMQQQLNDYEQLLDVKLALDMEISAYRKLLEGEEER

SEQ ID NO: 44928 - protein, 329 aa, Homo sapiens
  Payload ID: 9150
  Gene Symbol: LMNB1
  Gene Name: lamin B1
  ENSP ID: ENSP00000486528
MATATPVPPRMGSRAGGPTTPLSPTRLSRLQEKEELRELNDRLAVYIDKVRSLETENSALQLQVTEREEVRGRELTGLKALYETELADARRALDDTARERAKLQIELGKCKAEHDQLLLNYAKKESDLNGAQIKLREYEAALNSKDAALATALGDKKSLEGDLEDLKDQIAQLEASLAAAKKQLADETLLKVDLENRCQSLTEDLEFRKSMYEEEINETRRKHETRLVEVDSGRQIEYEYKLAQALHEMREQHDAQVRLYKEELEQTYHAKLENARLSSEMNTSTVNSAREELMESRMRIESLSSQLSNLQKECLLLSHISFIMLPIRP

SEQ ID NO: 44929 - protein, 166 aa, Homo sapiens
  Payload ID: 9150
  Gene Symbol: LMNB1
  Gene Name: lamin B1
  ENSP ID: ENSP00000486992
MATATPVPPRMGSRAGGPTTPLSPTRLSRLQEKEELRELNDRLAVYIDKVRSLETENSALQLQVTEREEVRGRELTGLKALYETELADARRALDDTARERAKLQIELGKCKAEHDQLLLNYAKKESDLNGAQIKLREYEAALNSKDAALATALGDKKSLEGDLEDL

SEQ ID NO: 44930 - protein, 620 aa, Homo sapiens
  Payload ID: 9151
  Gene Symbol: LMNB2
  Gene Name: lamin B2
  ENSP ID: ENSP00000327054
MSPPSPGRRREQRRPRAAATMATPLPGRAGGPATPLSPTRLSRLQEKEELRELNDRLAHYIDRVRALELENDRLLLKISEKEEVTTREVSGIKALYESELADARRVLDETARERARLQIEIGKLRAELDEVNKSAKKREGELTVAQGRVKDLESLFHRSEVELAAALSDKRGLESDVAELRAQLAKAEDGHAVAKKQLEKETLMRVDLENRCQSLQEELDFRKSVFEEEVRETRRRHERRLVEVDSSRQQEYDFKMAQALEELRSQHDEQVRLYKLELEQTYQAKLDSAKLSSDQNDKAASAAREELKEARMRLESLSYQLSGLQKQASAAEDRIRELEEAMAGERDKFRKMLDAKEQEMTEMRDVMQQQLAEYQELLDVKLALDMEINAYRKLLEGEEERLKLSPSPSSRVTVSRATSSSSGSLSATGRLGRSKRKRLEVEEPLGSGPSVLGTGTGGSGGFHLAQQASASGSVSIEEIDLEGKFVQLKNNSDKDQSLGNWRIKRQVLEGEEIAYKFTPKYILRAGQMVTVWAAGAGVAHSPPSTLVWKGQSSWGTGESFRTVLVNADGEEVAMRTVKKSSVMRENENGEEEEEEAEFGEEDLFHQQGDPRTTSRGCYVM

SEQ ID NO: 44931 - protein, 388 aa, Homo sapiens
  Payload ID: 9152
  Gene Symbol: LMNTD1
  Gene Name: lamin tail domain containing 1
  Uniprot ID: Q8N9Z9
  ENSP ID: ENSP00000282881
MLEGSWINRREDKLGVYSLVHFSPKMLGSVATTLPLSSSNSSGMPLGYYLSSPQISRVTISTTGQLTSKATVGSCSRVENSLDASPFSVPKKQDESPMIGDGEDYFLSLFGDSKKLTAHSNYTQKTLKYFSMILEEVGQFTSSSLGDVEIAEVNVKGLFVKLINSSLDKEMAIGDHILQQNVNGQTISLYRFLPNIVMQANSTVTVWAAASEAKHQPPSDFLWKEQDKFRASPDCITILCKPNGQAIAWYTPIHWKQAWEKLDADVEFNRCSVVSPTFRKRVFQWTASTATITKEKQDQPKKDISNYQVEQAQVLLKREKEIPPTVFPNRSPWCQNPYVSAHPYCPLIEPHNTSTAGGRLDRQPRTRSTRPNRASGSKKKKTSESQKQ

SEQ ID NO: 44932 - protein, 369 aa, Homo sapiens
  Payload ID: 9152
  Gene Symbol: LMNTD1
  Gene Name: lamin tail domain containing 1
  Uniprot ID: Q8N9Z9
  ENSP ID: ENSP00000393150
MKDTQDIQEASKAMQNKVHEQEDKNEKQKQREDKLGVYSLVHFSPKMLGSVATTLPLSSSNSSGMPLGYYLSSPQISRVTISTTGQLTSKATVGSCSRVENSLDASPFSVPKKQDESPMIGDGEDYFLSLFGDSKKLTAHSNYTQKTLKYFSMILEEVGQFTSSSLGDVEIAEVNVKGLFVKLINSSLDKEMAIGDHILQQNVNGQTISLYRFLPNIVMQANSTVTAIAWYTPIHWKQAWEKLDADVEFNRCSVVSPTFRKRVFQWTASTATITKEKQDQPKKDISNYQVEQAQVLLKREKEIPPTVFPNRSPWCQNPYVSAHPYCPLIEPHNTSTAGGRLDRQPRTRSTRPNRASGSKKKKTSESQKQ

SEQ ID NO: 44933 - protein, 325 aa, Homo sapiens
  Payload ID: 9152
  Gene Symbol: LMNTD1
  Gene Name: lamin tail domain containing 1
  Uniprot ID: Q8N9Z9
  ENSP ID: ENSP00000407043
MQQPVRAGDIGVSRVQTHHNASPFSVPKKQDESPMIGDGEDYFLSLFGDSKKLTAHSNYTQKTLKYFSMILEEVGQFTSSSLGDVEIAEVNVKGLFVKLINSSLDKEMAIGDHILQQNVNGQTISLYRFLPNIVMQANSTVTVWAAASEAKHQPPSDFLWKEQDKFRASPDCITILCKPNGQAIAWYTPIHWKQAWEKLDADVEFNRCSVVSPTFRKRVFQWTASTATITKEKQDQPKKDISNYQVEQAQVLLKREKEIPPTVFPNRSPWCQNPYVSAHPYCPLIEPHNTSTAGGRLDRQPRTRSTRPNRASGSKKKKTSESQKQ

SEQ ID NO: 44934 - protein, 409 aa, Homo sapiens
  Payload ID: 9152
  Gene Symbol: LMNTD1
  Gene Name: lamin tail domain containing 1
  Uniprot ID: Q8N9Z9
  ENSP ID: ENSP00000407353
MKDTQDIQEASKAMQNKVHEQEDKNEKQKQREDKLGVYSLVHFSPKMLGSVATTLPLSSSNSSGMPLGYYLSSPQISRVTISTTGQLTSKATVGSCSRVENSLDASPFSVPKKQDESPMIGDGEDYFLSLFGDSKKLTAHSNYTQKTLKYFSMILEEVGQFTSSSLGDVEIAEVNVKGLFVKLINSSLDKEMAIGDHILQQNVNGQTISLYRFLPNIVMQANSTVTVWAAASEAKHQPPSDFLWKEQDKFRASPDCITILCKPNGQAIAWYTPIHWKQAWEKLDADVEFNRCSVVSPTFRKRVFQWTASTATITKEKQDQPKKDISNYQVEQAQVLLKREKEIPPTVFPNRSPWCQNPYVSAHPYCPLIEPHNTSTAGGRLDRQPRTRSTRPNRASGSKKKKTSESQKQ

SEQ ID NO: 44935 - protein, 105 aa, Homo sapiens
  Payload ID: 9152
  Gene Symbol: LMNTD1
  Gene Name: lamin tail domain containing 1
  ENSP ID: ENSP00000438160
QWTASTATITKEKQDQPKKDISNYQVEQAQVLLKREKEIPPTVFPNRSPWCQNPYVSAHPYCPLIEPHNTSTAGGRLDRQPRTRSTRPNRASGSKKKKTSESQKQ

SEQ ID NO: 44936 - protein, 163 aa, Homo sapiens
  Payload ID: 9152
  Gene Symbol: LMNTD1
  Gene Name: lamin tail domain containing 1
  ENSP ID: ENSP00000438645
  MOD_RES (1)..(1): Any amino acid
XDKFRASPDCITILCKPNGQAIAWYTPIHWKQAWEKLDADVEFNRCSVVSPTFRKRVFQWTASTATITKEKQDQPKKDISNYQVEQAQVLLKREKEIPPTVFPNRSPWCQNPYVSAHPYCPLIEPHNTSTAGGRLDRQPRTRSTRPNRASGSKKKKTSESQKQ

SEQ ID NO: 44937 - protein, 170 aa, Homo sapiens
  Payload ID: 9152
  Gene Symbol: LMNTD1
  Gene Name: lamin tail domain containing 1
  ENSP ID: ENSP00000442871
MLGSVATTLPLSSSNSSGMPLGYYLSSPQISRVTISTTGQLTSKATVGSCSRVENSLDASPFSVPKKQDESPMIGDGEDYFLSLFGDSKKLTAHSNYTQKTLKYFSMILEEVGQFTSSSLGDVEIAEVNVKGLFVKLINSSLDKEMAIGDHILQQNVNGQTISLYRFLPN

SEQ ID NO: 44938 - protein, 291 aa, Homo sapiens
  Payload ID: 9152
  Gene Symbol: LMNTD1
  Gene Name: lamin tail domain containing 1
  Uniprot ID: Q8N9Z9
  ENSP ID: ENSP00000443132
MIGDGEDYFLSLFGDSKKLTAHSNYTQKTLKYFSMILEEVGQFTSSSLGDVEIAEVNVKGLFVKLINSSLDKEMAIGDHILQQNVNGQTISLYRFLPNIVMQANSTVTVWAAASEAKHQPPSDFLWKEQDKFRASPDCITILCKPNGQAIAWYTPIHWKQAWEKLDADVEFNRCSVVSPTFRKRVFQWTASTATITKEKQDQPKKDISNYQVEQAQVLLKREKEIPPTVFPNRSPWCQNPYVSAHPYCPLIEPHNTSTAGGRLDRQPRTRSTRPNRASGSKKKKTSESQKQ

SEQ ID NO: 44939 - protein, 72 aa, Homo sapiens
  Payload ID: 9152
  Gene Symbol: LMNTD1
  Gene Name: lamin tail domain containing 1
  ENSP ID: ENSP00000443387
MLGSVATTLPLSSSNSSGMPLGYYLSSPQISRVTISTTGQLTSKATVGSCSRVENSLDASPFSVPKKQDESP

SEQ ID NO: 44940 - protein, 143 aa, Homo sapiens
  Payload ID: 9152
  Gene Symbol: LMNTD1
  Gene Name: lamin tail domain containing 1
  ENSP ID: ENSP00000443596
MAIGDHILQQNVNGQTISLYRFLPNIVMQANSTVTVWAAASEAKHQPPSDFLWKEQDKFRASPDCITILCKPNGQAIAWYTPIHWKQAWEKLDADVEFNRCSVVSPTFRKRVFQWTASTATITKEKQDQPKKDISNYQVEQAQ

SEQ ID NO: 44941 - protein, 165 aa, Homo sapiens
  Payload ID: 9152
  Gene Symbol: LMNTD1
  Gene Name: lamin tail domain containing 1
  ENSP ID: ENSP00000445242
MLGSVATTLPLSSSNSSGMPLGYYLSSPQISRVTISTTGQLTSKATVGSCSRVENSLDASPFSVPKKQDESPMIGDGEDYFLSLFGDSKKLTAHSNYTQKTLKYFSMILEEVGQFTSSSLGDVEIAEVNVKGLFVKLINSSLDKEMAIGDHILQQNVNGQTISLY

SEQ ID NO: 44942 - protein, 634 aa, Homo sapiens
  Payload ID: 9153
  Gene Symbol: LMNTD2
  Gene Name: lamin tail domain containing 2
  Uniprot ID: Q8IXW0
  ENSP ID: ENSP00000331167
MRWLRPAGRRREQESVSGHLGPPAGAPAAPETPTCLPDTTPHPAPVVCSADPQLALESLDPRTLRLLWRQRELEIQALRWAIQNGEDARLCHILEEVAGLPPKRSSHSQEKLLQNQVQKLIQELKEQKERAQWEKEHLEERLLQTTRTLQEMEAELQNLQKSCLLQLARSSWVGRMLRSQTGSVEVVTAETLMDPSDLSENIQAPTGEGFRLEDVDWNSVARRYPNLFTNMEPSSKQKQPRPWPQLDTGSPESSGKHSERHHKTVEWGSLPCLNTSSSGGADSDSSSCRPGLPSFVQVIGHPPRDHRASSEQALVQAGSYSRDSEDLQKTHSPRHGEPVLSPQPCTDPDHWSPELLQSPTGLKIVAVSCREKFVRIFNPSQESTADLSGMVLKQLVRGFPERLYRFPPGTLLAPRHHVTVWGEATRSAKKPLRASSSREPVPLLSIRGCATLLLSPKGEVLSEHRIPRRETPAPRVFADGTDLSIDRFPLPEAGPGADTRKPPRPPRPLRKGRVREPRVSRRRPGTRGLLPPVSSGKLFHAREGPARPENPEIPAPQHLPAIPGDPTLPSPPAEAGLGLEDCRLQKEHRVRVCRKSVDRSCPLVALSVQNTAESRFGFRFLSCLPVTADTCRGA

SEQ ID NO: 44943 - protein, 302 aa, Homo sapiens
  Payload ID: 9153
  Gene Symbol: LMNTD2
  Gene Name: lamin tail domain containing 2
  ENSP ID: ENSP00000393529
MATVYSPSLPGLLGGRASEQESVSGHLGPPAGAPAAPETPTCLPDTTPHPAPVVCSADPQLALESLDPRTLRLLWRQRELEIQALRWAIQNGEDARLCHILEEVAGLPPKRSSHSQEKLLQNQVQKLIQELKEQKERAQWEKEHLEERLLQTTRTLQEMEAELQNLQKSCLLQLARSSWVGRMLRSQTGSVEVVTAETLMDPSDLSENIQAPTGEGFRLEDVDWNSVARRYPNLFTNMEPSSKQKQPRPWPQLDTGSPESSGKHSERHHKTVEWGSLPCLNTSSSGGADSDSSSCRPGLPSF

SEQ ID NO: 44944 - protein, 247 aa, Homo sapiens
  Payload ID: 9153
  Gene Symbol: LMNTD2
  Gene Name: lamin tail domain containing 2
  ENSP ID: ENSP00000435529
MAPKSGQEVEETEEEALLSPTEQESVSGHLGPPAGAPAAPETPTCLPDTTPHPAPVVCSADPQLALESLDPRTLRLLWRQRELEIQALRWAIQNGEDARLCHILEEVAGLPPKRSSHSQEKLLQNQVQKLIQELKEQKERAQWEKEHLEERLLQTTRTLQEMEAELQNLQKSCLLQLARSSWVGRMLRSQTGSVEVVTAETLMDPSDLSENIQAPTGEGFRLEDVDWNSVARRYPNLFTNMEPSSKQ

SEQ ID NO: 44945 - protein, 634 aa, Homo sapiens
  Payload ID: 9153
  Gene Symbol: LMNTD2
  Gene Name: lamin tail domain containing 2
  Uniprot ID: Q8IXW0
  ENSP ID: ENSP00000478197
MRWLRPAGRRREQESVSGHLGPPAGAPAAPETPTCLPDTTPHPTPVVCSADPQLALESLDPRTLRLLWRQRELEIQALRWAIQNGEDARLCHILEEVAGLPPKRSSHSQEKLLQNQVQKLIQELKEQKERAQWEKEHLEERLLQTTRTLQEMEAELQNLQKSCLLQLARSSWVGRMLRSQTGSVEVVTAETLMDPSDLSENIQAPTGEGFRLEDVDWNSVARRYPNLFTNMEPSSKQKQPRPWPQLDTGSPESSGKHSERHHKTVEWGSLPCLNTSSSGGADSDSSSCRPGLPSFVQVIGHPPRDHRASSEQALVQAGSYSRDSEDLQKTHSPRHGEPVLSPQPCTDPDHWSPELLQSPTGLKIVAVSCREKFVRIFNPSQESTADLSGMVLKQLVRGFPERLYRFPPGTLLAPRHHVTVWGEATRSAKKPLRASSSREPVPLLSIRGCATLLLSPKGEVLSEHRIPRRETPAPRVFADGTDLSIDRFPLPEAGPGADTRKPPRPPRPLRKGRVREPRVSRRRPGTRGLLPPVSSGKLFHAREGPARPENPEIPAPQHLPAIPGDPTLPSPPAEAGLGLEDCRLQKEHRVRVCRKSVDRSCPLVALSVQNTAESRFGFRFLSCLPVTADTCRGA

SEQ ID NO: 44946 - protein, 302 aa, Homo sapiens
  Payload ID: 9153
  Gene Symbol: LMNTD2
  Gene Name: lamin tail domain containing 2
  ENSP ID: ENSP00000488238
MATVYSPSLPGLLGGRASEQESVSGHLGPPAGAPAAPETPTCLPDTTPHPTPVVCSADPQLALESLDPRTLRLLWRQRELEIQALRWAIQNGEDARLCHILEEVAGLPPKRSSHSQEKLLQNQVQKLIQELKEQKERAQWEKEHLEERLLQTTRTLQEMEAELQNLQKSCLLQLARSSWVGRMLRSQTGSVEVVTAETLMDPSDLSENIQAPTGEGFRLEDVDWNSVARRYPNLFTNMEPSSKQKQPRPWPQLDTGSPESSGKHSERHHKTVEWGSLPCLNTSSSGGADSDSSSCRPGLPSF

SEQ ID NO: 44947 - protein, 247 aa, Homo sapiens
  Payload ID: 9153
  Gene Symbol: LMNTD2
  Gene Name: lamin tail domain containing 2
  ENSP ID: ENSP00000488391
MAPKSGQEVKETEEEALLSPTEQESVSGHLGPPAGAPAAPETPTCLPDTTPHPTPVVCSADPQLALESLDPRTLRLLWRQRELEIQALRWAIQNGEDARLCHILEEVAGLPPKRSSHSQEKLLQNQVQKLIQELKEQKERAQWEKEHLEERLLQTTRTLQEMEAELQNLQKSCLLQLARSSWVGRMLRSQTGSVEVVTAETLMDPSDLSENIQAPTGEGFRLEDVDWNSVARRYPNLFTNMEPSSKQ

SEQ ID NO: 44948 - protein, 3075 aa, Homo sapiens
  Payload ID: 9154
  Gene Symbol: LAMA1
  Gene Name: laminin, alpha 1
  Uniprot ID: P25391
  ENSP ID: ENSP00000374309
MRGGVLLVLLLCVAAQCRQRGLFPAILNLASNAHISTNATCGEKGPEMFCKLVEHVPGRPVRNPQCRICDGNSANPRERHPISHAIDGTNNWWQSPSIQNGREYHWVTITLDLRQVFQVAYVIIKAANAPRPGNWILERSLDGTTFSPWQYYAVSDSECLSRYNITPRRGPPTYRADDEVICTSYYSRLVPLEHGEIHTSLINGRPSADDLSPKLLEFTSARYIRLRLQRIRTLNADLMTLSHREPKELDPIVTRRYYYSIKDISVGGMCICYGHASSCPWDETTKKLQCQCEHNTCGESCNRCCPGYHQQPWRPGTVSSGNTCEACNCHNKAKDCYYDESVAKQKKSLNTAGQFRGGGVCINCLQNTMGINCETCIDGYYRPHKVSPYEDEPCRPCNCDPVGSLSSVCIKDDLHSDLHNGKQPGQCPCKEGYTGEKCDRCQLGYKDYPTCVSCGCNPVGSASDEPCTGPCVCKENVEGKACDRCKPGFYNLKEKNPRGCSECFCFGVSDVCSSLSWPVGQVNSMSGWLVTDLISPRKIPSQQDALGGRHQVSINNTAVMQRLAPKYYWAAPEAYLGNKLTAFGGFLKYTVSYDIPVETVDSNLMSHADVIIKGNGLTLSTQAEGLSLQPYEEYLNVVRLVPENFQDFHSKRQIDRDQLMTVLANVTHLLIRANYNSAKMALYRLESVSLDIASSNAIDLVVAADVEHCECPQGYTGTSCESCLSGYYRVDGILFGGICQPCECHGHAAECNVHGVCIACAHNTTGVHCEQCLPGFYGEPSRGTPGDCQPCACPLTIASNNFSPTCHLNDGDEVVCDWCAPGYSGAWCERCADGYYGNPTVPGESCVPCDCSGNVDPSEAGHCDSVTGECLKCLGNTDGAHCERCADGFYGDAVTAKNCRACECHVKGSHSAVCHLETGLCDCKPNVTGQQCDQCLHGYYGLDSGHGCRPCNCSVAGSVSDGCTDEGQCHCVPGVAGKRCDRCAHGFYAYQDGSCTPCDCPHTQNTCDPETGECVCPPHTQGVKCEECEDGHWGYDAEVGCQACNCSLVGSTHHRCDVVTGHCQCKSKFGGRACDQCSLGYRDFPDCVPCDCDLRGTSGDACNLEQGLCGCVEETGACPCKENVFGPQCNECREGTFALRADNPLGCSPCFCSGLSHLCSELEDYVRTPVTLGSDQPLLRVVSQSNLRGTTEGVYYQAPDFLLDAATVRQHIRAEPFYWRLPQQFQGDQLMAYGGKLKYSVAFYSLDGVGTSNFEPQVLIKGGRIRKQVIYMDAPAPENGVRQEQEVAMRENFWKYFNSVSEKPVTREDFMSVLSDIEYILIKASYGQGLQQSRISDISMEVGRKAEKLHPEEEVASLLENCVCPPGTVGFSCQDCAPGYHRGKLPAGSDRGPRPLVAPCVPCSCNNHSDTCDPNTGKCLNCGDNTAGDHCDVCTSGYYGKVTGSASDCALCACPHSPPASFSPTCVLEGDHDFRCDACLLGYEGKHCERCSSSYYGNPQTPGGSCQKCDCNPHGSVHGDCDRTSGQCVCRLGASGLRCDECEPRHILMETDCVSCDDECVGVLLNDLDEIGDAVLSLNLTGIIPVPYGILSNLENTTKYLQESLLKENMQKDLGKIKLEGVAEETDNLQKKLTRMLASTQKVNRATERIFKESQDLAIAIERLQMSITEIMEKTTLNQTLDEDFLLPNSTLQNMQQNGTSLLEIMQIRDFTQLHQNATLELKAAEDLLSQIQENYQKPLEELEVLKEAASHVLSKHNNELKAAEALVREAEAKMQESNHLLLMVNANLREFSDKKLHVQEEQNLTSELIVQGRGLIDAAAAQTDAVQDALEHLEDHQDKLLLWSAKIRHHIDDLVMHMSQRNAVDLVYRAEDHAAEFQRLADVLYSGLENIRNVSLNATSAAYVHYNIQSLIEESEELARDAHRTVTETSLLSESLVSNGKAAVQRSSRFLKEGNNLSRKLPGIALELSELRNKTNRFQENAVEITRQTNESLLILRAIPKGIRDKGAKTKELATSASQSAVSTLRDVAGLSQELLNTSASLSRVNTTLRETHQLLQDSTMATLLAGRKVKDVEIQANLLFDRLKPLKMLEENLSRNLSEIKLLISQARKQAASIKVAVSADRDCIRAYQPQISSTNYNTLTLNVKTQEPDNLLFYLGSSTASDFLAVEMRRGRVAFLWDLGSGSTRLEFPDFPIDDNRWHSIHVARFGNIGSLSVKEMSSNQKSPTKTSKSPGTANVLDVNNSTLMFVGGLGGQIKKSPAVKVTHFKGCLGEAFLNGKSIGLWNYIEREGKCRGCFGSSQNEDPSFHFDGSGYSVVEKSLPATVTQIIMLFNTFSPNGLLLYLGSYGTKDFLSIELFRGRVKVMTDLGSGPITLLTDRRYNNGTWYKIAFQRNRKQGVLAVIDAYNTSNKETKQGETPGASSDLNRLDKDPIYVGGLPRSRVVRRGVTTKSFVGCIKNLEISRSTFDLLRNSYGVRKGCLLEPIRSVSFLKGGYIELPPKSLSPESEWLVTFATTNSSGIILAALGGDVEKRGDREEAHVPFFSVMLIGGNIEVHVNPGDGTGLRKALLHAPTGTCSDGQAHSISLVRNRRIITVQLDENNPVEMKLGTLVESRTINVSNLYVGGIPEGEGTSLLTMRRSFHGCIKNLIFNLELLDFNSAVGHEQVDLDTCWLSERPKLAPDAEDSKLLPEPRAFPEQCVVDAALEYVPGAHQFGLTQNSHFILPFNQSAVRKKLSVELSIRTFASSGLIYYMAHQNQADYAVLQLHGGRLHFMFDLGKGRTKVSHPALLSDGKWHTVKTDYVKRKGFITVDGRESPMVTVVGDGTMLDVEGLFYLGGLPSQYQARKIGNITHSIPACIGDVTVNSKQLDKDSPVSAFTVNRCYAVAQEGTYFDGSGYAALVKEGYKVQSDVNITLEFRTSSQNGVLLGISTAKVDAIGLELVDGKVLFHVNNGAGRITAAYEPKTATVLCDGKWHTLQANKSKHRITLIVDGNAVGAESPHTQSTSVDTNNPIYVGGYPAGVKQKCLRSQTSFRGCLRKLALIKSPQVQSFDFSRAFELHGVFLHSCPGTES

SEQ ID NO: 44949 - protein, 3122 aa, Homo sapiens
  Payload ID: 9155
  Gene Symbol: LAMA2
  Gene Name: laminin, alpha 2
  Uniprot ID: P24043
  ENSP ID: ENSP00000400365
MPGAAGVLLLLLLSGGLGGVQAQRPQQQRQSQAHQQRGLFPAVLNLASNALITTNATCGEKGPEMYCKLVEHVPGQPVRNPQCRICNQNSSNPNQRHPITNAIDGKNTWWQSPSIKNGIEYHYVTITLDLQQVFQIAYVIVKAANSPRPGNWILERSLDDVEYKPWQYHAVTDTECLTLYNIYPRTGPPSYAKDDEVICTSFYSKIHPLENGEIHISLINGRPSADDPSPELLEFTSARYIRLRFQRIRTLNADLMMFAHKDPREIDPIVTRRYYYSVKDISVGGMCICYGHARACPLDPATNKSRCECEHNTCGDSCDQCCPGFHQKPWRAGTFLTKTECEACNCHGKAEECYYDENVARRNLSLNIRGKYIGGGVCINCTQNTAGINCETCTDGFFRPKGVSPNYPRPCQPCHCDPIGSLNEVCVKDEKHARRGLAPGSCHCKTGFGGVSCDRCARGYTGYPDCKACNCSGLGSKNEDPCFGPCICKENVEGGDCSRCKSGFFNLQEDNWKGCDECFCSGVSNRCQSSYWTYGKIQDMSGWYLTDLPGRIRVAPQQDDLDSPQQISISNAEARQALPHSYYWSAPAPYLGNKLPAVGGQLTFTISYDLEEEEEDTERVLQLMIILEGNDLSISTAQDEVYLHPSEEHTNVLLLKEESFTIHGTHFPVRRKEFMTVLANLKRVLLQITYSFGMDAIFRLSSVNLESAVSYPTDGSIAAAVEVCQCPPGYTGSSCESCWPRHRRVNGTIFGGICEPCQCFGHAESCDDVTGECLNCKDHTGGPYCDKCLPGFYGEPTKGTSEDCQPCACPLNIPSNNFSPTCHLDRSLGLICDGCPVGYTGPRCERCAEGYFGQPSVPGGSCQPCQCNDNLDFSIPGSCDSLSGSCLICKPGTTGRYCELCADGYFGDAVDAKNCQPCRCNAGGSFSEVCHSQTGQCECRANVQGQRCDKCKAGTFGLQSARGCVPCNCNSFGSKSFDCEESGQCWCQPGVTGKKCDRCAHGYFNFQEGGCTACECSHLGNNCDPKTGRCICPPNTIGEKCSKCAPNTWGHSITTGCKACNCSTVGSLDFQCNVNTGQCNCHPKFSGAKCTECSRGHWNYPRCNLCDCFLPGTDATTCDSETKKCSCSDQTGQCTCKVNVEGIHCDRCRPGKFGLDAKNPLGCSSCYCFGTTTQCSEAKGLIRTWVTLKAEQTILPLVDEALQHTTTKGIVFQHPEIVAHMDLMREDLHLEPFYWKLPEQFEGKKLMAYGGKLKYAIYFEAREETGFSTYNPQVIIRGGTPTHARIIVRHMAAPLIGQLTRHEIEMTEKEWKYYGDDPRVHRTVTREDFLDILYDIHYILIKATYGNFMRQSRISEISMEVAEQGRGTTMTPPADLIEKCDCPLGYSGLSCEACLPGFYRLRSQPGGRTPGPTLGTCVPCQCNGHSSLCDPETSICQNCQHHTAGDFCERCALGYYGIVKGLPNDCQQCACPLISSSNNFSPSCVAEGLDDYRCTACPRGYEGQYCERCAPGYTGSPGNPGGSCQECECDPYGSLPVPCDPVTGFCTCRPGATGRKCDGCKHWHAREGWECVFCGDECTGLLLGDLARLEQMVMSINLTGPLPAPYKMLYGLENMTQELKHLLSPQRAPERLIQLAEGNLNTLVTEMNELLTRATKVTADGEQTGQDAERTNTRAKSLGEFIKELARDAEAVNEKAIKLNETLGTRDEAFERNLEGLQKEIDQMIKELRRKNLETQKEIAEDELVAAEALLKKVKKLFGESRGENEEMEKDLREKLADYKNKVDDAWDLLREATDKIREANRLFAVNQKNMTALEKKKEAVESGKRQIENTLKEGNDILDEANRLADEINSIIDYVEDIQTKLPPMSEELNDKIDDLSQEIKDRKLAEKVSQAESHAAQLNDSSAVLDGILDEAKNISFNATAAFKAYSNIKDYIDEAEKVAKEAKDLAHEATKLATGPRGLLKEDAKGCLQKSFRILNEAKKLANDVKENEDHLNGLKTRIENADARNGDLLRTLNDTLGKLSAIPNDTAAKLQAVKDKARQANDTAKDVLAQITELHQNLDGLKKNYNKLADSVAKTNAVVKDPSKNKIIADADATVKNLEQEADRLIDKLKPIKELEDNLKKNISEIKELINQARKQANSIKVSVSSGGDCIRTYKPEIKKGSYNNIVVNVKTAVADNLLFYLGSAKFIDFLAIEMRKGKVSFLWDVGSGVGRVEYPDLTIDDSYWYRIVASRTGRNGTISVRALDGPKASIVPSTHHSTSPPGYTILDVDANAMLFVGGLTGKLKKADAVRVITFTGCMGETYFDNKPIGLWNFREKEGDCKGCTVSPQVEDSEGTIQFDGEGYALVSRPIRWYPNISTVMFKFRTFSSSALLMYLATRDLRDFMSVELTDGHIKVSYDLGSGMASVVSNQNHNDGKWKSFTLSRIQKQANISIVDIDTNQEENIATSSSGNNFGLDLKADDKIYFGGLPTLRNLSMKARPEVNLKKYSGCLKDIEISRTPYNILSSPDYVGVTKGCSLENVYTVSFPKPGFVELSPVPIDVGTEINLSFSTKNESGIILLGSGGTPAPPRRKRRQTGQAYYAILLNRGRLEVHLSTGARTMRKIVIRPEPNLFHDGREHSVHVERTRGIFTVQVDENRRYMQNLTVEQPIEVKKLFVGGAPPEFQPSPLRNIPPFEGCIWNLVINSVPMDFARPVSFKNADIGRCAHQKLREDEDGAAPAEIVIQPEPVPTPAFPTPTPVLTHGPCAAESEPALLIGSKQFGLSRNSHIAIAFDDTKVKNRLTIELEVRTEAESGLLFYMARINHADFATVQLRNGLPYFSYDLGSGDTHTMIPTKINDGQWHKIKIMRSKQEGILYVDGASNRTISPKKADILDVVGMLYVGGLPINYTTRRIGPVTYSIDGCVRNLHMAEAPADLEQPTSSFHVGTCFANAQRGTYFDGTGFAKAVGGFKVGLDLLVEFEFRTTTTTGVLLGISSQKMDGMGIEMIDEKLMFHVDNGAGRFTAVYDAGVPGHLCDGQWHKVTANKIKHRIELTVDGNQVEAQSPNPASTSADTNDPVFVGGFPDDLKQFGLTTSIPFRGCIRSLKLTKGTGKPLEVNFAKALELRGVQPVSCPAN

SEQ ID NO: 44950 - protein, 3121 aa, Homo sapiens
  Payload ID: 9155
  Gene Symbol: LAMA2
  Gene Name: laminin, alpha 2
  ENSP ID: ENSP00000480802
MPGAAGVLLLLLLSGGLGGVQAQRPQQQRQSQAHQQRGLFPAVLNLASNALITTNATCGEKGPEMYCKLVEHVPGQPVRNPQCRICNQNSSNPNQRHPITNAIDGKNTWWQSPSIKNGIEYHYVTITLDLQQVFQIAYVIVKAANSPRPGNWILERSLDDVEYKPWQYHAVTDTECLTLYNIYPRTGPPSYAKDDEVICTSFYSKIHPLENGEIHISLINGRPSADDPSPELLEFTSARYIRLRFQRIRTLNADLMMFAHKDPREIDPIVTRRYYYSVKDISVGGMCICYGHARACPLDPATNKSRCECEHNTCGDSCDQCCPGFHQKPWRAGTFLTKTECEACNCHGKAEECYYDENVARRNLSLNIRGKYIGGGVCINCTQNTAGINCETCTDGFFRPKGVSPNYPRPCQPCHCDPIGSLNEVCVKDEKHARRGLAPGSCHCKTGFGGVSCDRCARGYTGYPDCKACNCSGLGSKNEDPCFGPCICKENVEGGDCSRCKSGFFNLQEDNWKGCDECFCSGVSNRCQSSYWTYGKIQDMSGWYLTDLPGRIRVAPQQDDLDSPQQISISNAEARQALPHSYYWSAPAPYLGNKLPAVGGQLTFTISYDLEEEEEDTERVLQLMIILEGNDLSISTAQDEVYLHPSEEHTNVLLLKEESFTIHGTHFPVRRKEFMTVLANLKRVLLQITYSFGMDAIFRLSSVNLESAVSYPTDGSIAAAVEVCQCPPGYTGSSCESCWPRHRRVNGTIFGGICEPCQCFGHAESCDDVTGECLNCKDHTGGPYCDKCLPGFYGEPTKGTSEDCQPCACPLNIPSNNFSPTCHLDRSLGLICDGCPVGYTGPRCERCAEGYFGQPSVPGGSCQPCQCNDNLDFSIPGSCDSLSGSCLICKPGTTGRYCELCADGYFGDAVDAKNCQPCRCNAGGSFSEVCHSQTGQCECRANVQGQRCDKCKAGTFGLQSARGCVPCNCNSFGSKSFDCEESGQCWCQPGVTGKKCDRCAHGYFNFQEGGCTACECSHLGNNCDPKTGRCICPPNTIGEKCSKCAPNTWGHSITTGCKACNCSTVGSLDFQCNVNTGQCNCHPKFSGAKCTECSRGHWNYPRCNLCDCFLPGTDATTCDSETKKCSCSDQTGQCTCKVNVEGIHCDRCRPGKFGLDAKNPLGCSSCYCFGTTTQCSEAKGLIRTWVTLKAEQTILPLVDEALQHTTTKGIVFQHPEIVAHMDLMREDLHLEPFYWKLPEQFEGKKLMAYGGKLKYAIYFEAREETGFSTYNPQVIIRGGTPTHARIIVRHMAAPLIGQLTRHEIEMTEKEWKYYGDDPRVHRTVTREDFLDILYDIHYILIKATYGNFMRQSRISEISMEVAEQGRGTTMTPPADLIEKCDCPLGYSGLSCEACLPGFYRLRSQPGGRTPGPTLGTCVPCQCNGHSSLCDPETSICQNCQHHTAGDFCERCALGYYGIVKGLPNDCQQCACPLISSSNNFSPSCVAEGLDDYRCTACPRGYEGQYCERCAPGYTGSPGNPGGSCQECECDPYGSLPVPCDPVTGFCTCRPGATGRKCDGCKHWHAREGWECVFCGDECTGLLLGDLARLEQMVMSINLTGPLPAPYKMLYGLENMTQELKHLLSPQRAPERLIQLAEGNLNTLVTEMNELLTRATKVTADGEQTGQDAERTNTRAKSLGEFIKELARDAEAVNEKAIKLNETLGTRDEAFERNLEGLQKEIDQMIKELRRKNLETQKEIAEDELVAAEALLKKVKKLFGESRGENEEMEKDLREKLADYKNKVDDAWDLLREATDKIREANRLFAVNQKNMTALEKKKEAVESGKRQIENTLKEGNDILDEANRLADEINSIIDYVEDIQTKLPPMSEELNDKIDDLSQEIKDRKLAEKVSQAESHAAQLNDSSAVLDGILDEAKNISFNATAAFKAYSNIKDYIDEAEKVAKEAKDLAHEATKLATGPRGLLKEDAKGCLQKSFRILNEAKKLANDVKENEDHLNGLKTRIENADARNGDLLRTLNDTLGKLSAIPNDTAAKLQAVKDKARQANDTAKDVLAQITELHQNLDGLKKNYNKLADSVAKTNAVVKDPSKNTVADADATVKNLEQEADRLIDKLKPIKELEDNLKKNISEIKELINQARKQANSIKVSVSSGGDCIRTYKPEIKKGSYNNIVVNVKTAVADNLLFYLGSAKFIDFLAIEMRKGKVSFLWDVGSGVGRVEYPDLTIDDSYWYRIVASRTGRNGTISVRALDGPKASIVPSTHHSTSPPGYTILDVDANAMLFVGGLTGKLKKADAVRVITFTGCMGETYFDNKPIGLWNFREKEGDCKGCTVSPQVEDSEGTIQFDGEGYALVSRPIRWYPNISTVMFKFRTFSSSALLMYLATRDLRDFMSVELTDGHIKVSYDLGSGMASVVSNQNHNDGKWKSFTLSRIQKQANISIVDIDTNQEENIATSSSGNNFGLDLKADDKIYFGGLPTLRNLSMKARPEVNLKKYSGCLKDIEISRTPYNILSSPDYVGVTKGCSLENVYTVSFPKPGFVELSPVPIDVGTEINLSFSTKNESGIILLGSGGTPAPPRRKRRQTGQAYYAILLNRGRLEVHLSTGARTMRKIVIRPEPNLFHDGREHSVHVERTRGIFTVQVDENRRYMQNLTVEQPIEVKKLFVGGAPPEFQPSPLRNIPPFEGCIWNLVINSVPMDFARPVSFKNADIGRCAHQKLREDEDGAAPAEIVIQPEPVPTPAFPTPTPVLTHGPCAAESEPALLIGSKQFGLSRNSHIAIAFDDTKVKNRLTIELEVRTEAESGLLFYMARINHADFATVQLRNGLPYFSYDLGSGDTHTMIPTKINDGQWHKIKIMRSKQEGILYVDGASNRTISPKKADILDVVGMLYVGGLPINYTTRRIGPVTYSIDGCVRNLHMAEAPADLEQPTSSFHVGTCFANAQRGTYFDGTGFAKAVGGFKVGLDLLVEFEFRTTTTTGVLLGISSQKMDGMGIEMIDEKLMFHVDNGAGRFTAVYDAGVPGHLCDGQWHKVTANKIKHRIELTVDGNQVEAQSPNPASTSADTNDPVFVGGFPDDLKQFGLTTSIPFRGCIRSLKLTKGTGKPLEVNFAKALELRGVQPVSCPAN

SEQ ID NO: 44951 - protein, 3118 aa, Homo sapiens
  Payload ID: 9155
  Gene Symbol: LAMA2
  Gene Name: laminin, alpha 2
  ENSP ID: ENSP00000481744
MPGAAGVLLLLLLSGGLGGVQAQRPQQQRQSQAHQQRGLFPAVLNLASNALITTNATCGEKGPEMYCKLVEHVPGQPVRNPQCRICNQNSSNPNQRHPITNAIDGKNTWWQSPSIKNGIEYHYVTITLDLQQVFQIAYVIVKAANSPRPGNWILERSLDDVEYKPWQYHAVTDTECLTLYNIYPRTGPPSYAKDDEVICTSFYSKIHPLENGEIHISLINGRPSADDPSPELLEFTSARYIRLRFQRIRTLNADLMMFAHKDPREIDPIVTRRYYYSVKDISVGGMCICYGHARACPLDPATNKSRCECEHNTCGDSCDQCCPGFHQKPWRAGTFLTKTECEACNCHGKAEECYYDENVARRNLSLNIRGKYIGGGVCINCTQNTAGINCETCTDGFFRPKGVSPNYPRPCQPCHCDPIGSLNEVCVKDEKHARRGLAPGSCHCKTGFGGVSCDRCARGYTGYPDCKACNCSGLGSKNEDPCFGPCICKENVEGGDCSRCKSGFFNLQEDNWKGCDECFCSGVSNRCQSSYWTYGKIQDMSGWYLTDLPGRIRVAPQQDDLDSPQQISISNAEARQALPHSYYWSAPAPYLGNKLPAVGGQLTFTISYDLEEEEEDTERVLQLMIILEGNDLSISTAQDEVYLHPSEEHTNVLLLKEESFTIHGTHFPVRRKEFMTVLANLKRVLLQITYSFGMDAIFRLSSVNLESAVSYPTDGSIAAAVEVCQCPPGYTGSSCESCWPRHRRVNGTIFGGICEPCQCFGHAESCDDVTGECLNCKDHTGGPYCDKCLPGFYGEPTKGTSEDCQPCACPLNIPSNNFSPTCHLDRSLGLICDGCPVGYTGPRCERCAEGYFGQPSVPGGSCQPCQCNDNLDFSIPGSCDSLSGSCLICKPGTTGRYCELCADGYFGDAVDAKNCQPCRCNAGGSFSEVCHSQTGQCECRANVQGQRCDKCKAGTFGLQSARGCVPCNCNSFGSKSFDCEESGQCWCQPGVTGKKCDRCAHGYFNFQEGGCTACECSHLGNNCDPKTGRCICPPNTIGEKCSKCAPNTWGHSITTGCKACNCSTVGSLDFQCNVNTGQCNCHPKFSGAKCTECSRGHWNYPRCNLCDCFLPGTDATTCDSETKKCSCSDQTGQCTCKVNVEGIHCDRCRPGKFGLDAKNPLGCSSCYCFGTTTQCSEAKGLIRTWVTLKAEQTILPLVDEALQHTTTKGIVFQHPEIVAHMDLMREDLHLEPFYWKLPEQFEGKKLMAYGGKLKYAIYFEAREETGFSTYNPQVIIRGGTPTHARIIVRHMAAPLIGQLTRHEIEMTEKEWKYYGDDPRVHRTVTREDFLDILYDIHYILIKATYGNFMRQSRISEISMEVAEQGRGTTMTPPADLIEKCDCPLGYSGLSCEACLPGFYRLRSQPGGRTPGPTLGTCVPCQCNGHSSLCDPETSICQNCQHHTAGDFCERCALGYYGIVKGLPNDCQQCACPLISSSNNFSPSCVAEGLDDYRCTACPRGYEGQYCERCAPGYTGSPGNPGGSCQECECDPYGSLPVPCDPVTGFCTCRPGATGRKCDGCKHWHAREGWECVFCGDECTGLLLGDLARLEQMVMSINLTGPLPAPYKMLYGLENMTQELKHLLSPQRAPERLIQLAEGNLNTLVTEMNELLTRATKVTADGEQTGQDAERTNTRAKSLGEFIKELARDAEAVNEKAIKLNETLGTRDEAFERNLEGLQKEIDQMIKELRRKNLETQKEIAEDELVAAEALLKKVKKLFGESRGENEEMEKDLREKLADYKNKVDDAWDLLREATDKIREANRLFAVNQKNMTALEKKKEAVESGKRQIENTLKEGNDILDEANRLADEINSIIDYVEDIQTKLPPMSEELNDKIDDLSQEIKDRKLAEKVSQAESHAAQLNDSSAVLDGILDEAKNISFNATAAFKAYSNIKDYIDEAEKVAKEAKDLAHEATKLATGPRGLLKEDAKGCLQKSFRILNEAKKLANDVKENEDHLNGLKTRIENADARNGDLLRTLNDTLGKLSAIPNDTAAKLQAVKDKARQANDTAKDVLAQITELHQNLDGLKKNYNKLADSVAKTNAVVKDPSKNNAVADADATVKNLEQEADRLIDKLKPIKELEDNLKKNISEIKELINQARKQANSIKVSVSSGGDCIRTYKPEIKKGSYNNIVVNVKTAVADNLLFYLGSAKFIDFLAIEMRKGKVSFLWDVGSGVGRVEYPDLTIDDSYWYRIVASRTGRNGTISVRALDGPKASIVPSTHHSTSPPGYTILDVDANAMLFVGGLTGKLKKADAVRVITFTGCMGETYFDNKPIGLWNFREKEGDCKGCTVSPQVEDSEGTIQFDGEGYALVSRPIRWYPNISTVMFKFRTFSSSALLMYLATRDLRDFMSVELTDGHIKVSYDLGSGMASVVSNQNHNDGKWKSFTLSRIQKQANISIVDIDTNQEENIATSSSGNNFGLDLKADDKIYFGGLPTLRNLRPEVNLKKYSGCLKDIEISRTPYNILSSPDYVGVTKGCSLENVYTVSFPKPGFVELSPVPIDVGTEINLSFSTKNESGIILLGSGGTPAPPRRKRRQTGQAYYAILLNRGRLEVHLSTGARTMRKIVIRPEPNLFHDGREHSVHVERTRGIFTVQVDENRRYMQNLTVEQPIEVKKLFVGGAPPEFQPSPLRNIPPFEGCIWNLVINSVPMDFARPVSFKNADIGRCAHQKLREDEDGAAPAEIVIQPEPVPTPAFPTPTPVLTHGPCAAESEPALLIGSKQFGLSRNSHIAIAFDDTKVKNRLTIELEVRTEAESGLLFYMARINHADFATVQLRNGLPYFSYDLGSGDTHTMIPTKINDGQWHKIKIMRSKQEGILYVDGASNRTISPKKADILDVVGMLYVGGLPINYTTRRIGPVTYSIDGCVRNLHMAEAPADLEQPTSSFHVGTCFANAQRGTYFDGTGFAKAVGGFKVGLDLLVEFEFRTTTTTGVLLGISSQKMDGMGIEMIDEKLMFHVDNGAGRFTAVYDAGVPGHLCDGQWHKVTANKIKHRIELTVDGNQVEAQSPNPASTSADTNDPVFVGGFPDDLKQFGLTTSIPFRGCIRSLKLTKGTGKPLEVNFAKALELRGVQPVSCPAN

SEQ ID NO: 44952 - protein, 1724 aa, Homo sapiens
  Payload ID: 9156
  Gene Symbol: LAMA3
  Gene Name: laminin, alpha 3
  ENSP ID: ENSP00000269217
MPPAVRRSACSMGWLWIFGAALGQCLGYSSQQQRVPFLQPPGQSQLQASYVEFRPSQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 44953 - protein, 3333 aa, Homo sapiens
  Payload ID: 9156
  Gene Symbol: LAMA3
  Gene Name: laminin, alpha 3
  Uniprot ID: Q16787
  ENSP ID: ENSP00000324532
MAAAARPRGRALGPVLPPTPLLLLVLRVLPACGATARDPGAAAGLSLHPTYFNLAEAARIWATATCGERGPGEGRPQPELYCKLVGGPTAPGSGHTIQGQFCDYCNSEDPRKAHPVTNAIDGSERWWQSPPLSSGTQYNRVNLTLDLGQLFHVAYILIKFANSPRPDLWVLERSVDFGSTYSPWQYFAHSKVDCLKEFGREANMAVTRDDDVLCVTEYSRIVPLENGEVVVSLINGRPGAKNFTFSHTLREFTKATNIRLRFLRTNTLLGHLISKAQRDPTVTRRYYYSIKDISIGGQCVCNGHAEVCNINNPEKLFRCECQHHTCGETCDRCCTGYNQRRWRPAAWEQSHECEACNCHGHASNCYYDPDVERQQASLNTQGIYAGGGVCINCQHNTAGVNCEQCAKGYYRPYGVPVDAPDGCIPCSCDPEHADGCEQGSGRCHCKPNFHGDNCEKCAIGYYNFPFCLRIPIFPVSTPSSEDPVAGDIKGCDCNLEGVLPEICDAHGRCLCRPGVEGPRCDTCRSGFYSFPICQACWCSALGSYQMPCSSVTGQCECRPGVTGQRCDRCLSGAYDFPHCQGSSSACDPAGTINSNLGYCQCKLHVEGPTCSRCKLLYWNLDKENPSGCSECKCHKAGTVSGTGECRQGDGDCHCKSHVGGDSCDTCEDGYFALEKSNYFGCQGCQCDIGGALSSMCSGPSGVCQCREHVVGKVCQRPENNYYFPDLHHMKYEIEDGSTPNGRDLRFGFDPLAFPEFSWRGYAQMTSVQNDVRITLNVGKSSGSLFRVILRYVNPGTEAVSGHITIYPSWGAAQSKEIIFLPSKEPAFVTVPGNGFADPFSITPGIWVACIKAEGVLLDYLVLLPRDYYEASVLQLPVTEPCAYAGPPQENCLLYQHLPVTRFPCTLACEARHFLLDGEPRPVAVRQPTPAHPVMVDLSGREVELHLRLRIPQVGHYVVVVEYSTEAAQLFVVDVNVKSSGSVLAGQVNIYSCNYSVLCRSAVIDHMSRIAMYELLADADIQLKGHMARFLLHQVCIIPIEEFSAEYVRPQVHCIASYGRFVNQSATCVSLAHETPPTALILDVLSGRPFPHLPQQSSPSVDVLPGVTLKAPQNQVTLRGRVPHLGRYVFVIHFYQAAHPTFPAQVSVDGGWPRAGSFHASFCPHVLGCRDQVIAEGQIEFDISEPEVAATVKVPEGKSLVLVRVLVVPAENYDYQILHKKSMDKSLEFITNCGKNSFYLDPQTASRFCKNSARSLVAFYHKGALPCECHPTGATGPHCSPEGGQCPCQPNVIGRQCTRCATGHYGFPRCKPCSCGRRLCEEMTGQCRCPPRTVRPQCEVCETHSFSFHPMAGCEGCNCSRRGTIEAAMPECDRDSGQCRCKPRITGRQCDRCASGFYRFPECVPCNCNRDGTEPGVCDPGTGACLCKENVEGTECNVCREGSFHLDPANLKGCTSCFCFGVNNQCHSSHKRRTKFVDMLGWHLETADRVDIPVSFNPGSNSMVADLQELPATIHSASWVAPTSYLGDKVSSYGGYLTYQAKSFGLPGDMVLLEKKPDVQLTGQHMSIIYEETNTPRPDRLHHGRVHVVEGNFRHASSRAPVSREELMTVLSRLADVRIQGLYFTETQRLTLSEVGLEEASDTGSGRIALAVEICACPPAYAGDSCQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 44954 - protein, 3277 aa, Homo sapiens
  Payload ID: 9156
  Gene Symbol: LAMA3
  Gene Name: laminin, alpha 3
  ENSP ID: ENSP00000382432
MAAAARPRGRALGPVLPPTPLLLLVLRVLPACGATARDPGAAAGLSLHPTYFNLAEAARIWATATCGERGPGEGRPQPELYCKLVGGPTAPGSGHTIQGQFCDYCNSEDPRKAHPVTNAIDGSERWWQSPPLSSGTQYNRVNLTLDLGQLFHVAYILIKFANSPRPDLWVLERSVDFGSTYSPWQYFAHSKVDCLKEFGREANMAVTRDDDVLCVTEYSRIVPLENGEVVVSLINGRPGAKNFTFSHTLREFTKATNIRLRFLRTNTLLGHLISKAQRDPTVTRRYYYSIKDISIGGQCVCNGHAEVCNINNPEKLFRCECQHHTCGETCDRCCTGYNQRRWRPAAWEQSHECEACNCHGHASNCYYDPDVERQQASLNTQGIYAGGGVCINCQHNTAGVNCEQCAKGYYRPYGVPVDAPDGCIPCSCDPEHADGCEQGSGRCHCKPNFHGDNCEKCAIGYYNFPFCLRIPIFPVSTPSSEDPVAGDIKGCDCNLEGVLPEICDAHGRCLCRPGVEGPRCDTCRSGFYSFPICQACWCSALGSYQMPCSSVTGQCECRPGVTGQRCDRCLSGAYDFPHCQGSSSACDPAGTINSNLGYCQCKLHVEGPTCSRCKLLYWNLDKENPSGCSECKCHKAGTVSGTGECRQGDGDCHCKSHVGGDSCDTCEDGYFALEKSNYFGCQGCQCDIGGALSSMCSGPSGVCQCREHVVGKVCQRPENNYYFPDLHHMKYEIEDGSTPNGRDLRFGFDPLAFPEFSWRGYAQMTSVQNDVRITLNVGKSSGSLFRVILRYVNPGTEAVSGHITIYPSWGAAQSKEIIFLPSKEPAFVTVPGNGFADPFSITPGIWVACIKAEGVLLDYLVLLPRDYYEASVLQLPVTEPCAYAGPPQENCLLYQHLPVTRFPCTLACEARHFLLDGEPRPVAVRQPTPAHPVMVDLSGREVELHLRLRIPQVGHYVVVVEYSTEAAQLFVVDVNVKSSGSVLAGQVNIYSCNYSVLCRSAVIDHMSRIAMYELLADADIQLKGHMARFLLHQVCIIPIEEFSAEYVRPQVHCIASYGRFVNQSATCVSLAHETPPTALILDVLSGRPFPHLPQQSSPSVDVLPGVTLKAPQNQVTLRGRVPHLGRYVFVIHFYQAAHPTFPAQVSVDGGWPRAGSFHASFCPHVLGCRDQVIAEGQIEFDISEPEVAATVKVPEGKSLVLVRVLVVPAENYDYQILHKKSMDKSLEFITNCGKNSFYLDPQTASRFCKNSARSLVAFYHKGALPCECHPTGATGPHCSPEGGQCPCQPNVIGRQCTRCATGHYGFPRCKPCSCGRRLCEEMTGQCRCPPRTVRPQCEVCETHSFSFHPMAGCEGCNCSRRGTIEAAMPECDRDSGQCRCKPRITGRQCDRCASGFYRFPECVPCNCNRDGTEPGVCDPGTGACLCKENVEGTECNVCREGSFHLDPANLKGCTSCFCFGVNNQCHSSHKRRTKFVDMLGWHLETADRVDIPVSFNPGSNSMVADLQELPATIHSASWVAPTSYLGDKVSSYGGYLTYQAKSFGLPGDMVLLEKKPDVQLTGQHMSIIYEETNTPRPDRLHHGRVHVVEGNFRHASSRAPVSREELMTVLSRLADVRIQGLYFTETQRLTLSEVGLEEASDTGSGRIALAVEICACPPAYAGDSCQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHMLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 44955 - protein, 1147 aa, Homo sapiens
  Payload ID: 9156
  Gene Symbol: LAMA3
  Gene Name: laminin, alpha 3
  ENSP ID: ENSP00000464836
  MOD_RES (1)..(1): Any amino acid
XFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRQEGCLRPRVRDQSWKHSETMSLRKLK

SEQ ID NO: 44956 - protein, 1668 aa, Homo sapiens
  Payload ID: 9156
  Gene Symbol: LAMA3
  Gene Name: laminin, alpha 3
  ENSP ID: ENSP00000466557
MPPAVRRSACSMGWLWIFGAALGQCLGYSSQQQRVPFLQPPGQSQLQASYVEFRPSQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHMLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 44957 - protein, 37 aa, Homo sapiens
  Payload ID: 9156
  Gene Symbol: LAMA3
  Gene Name: laminin, alpha 3
  ENSP ID: ENSP00000466658
  MOD_RES (1)..(1): Any amino acid
XGWTEGPGGKFAWKLHHQHQSASLPGITSIRETKGAG

SEQ ID NO: 44958 - protein, 94 aa, Homo sapiens
  Payload ID: 9156
  Gene Symbol: LAMA3
  Gene Name: laminin, alpha 3
  ENSP ID: ENSP00000467473
LVRSASFSRGGQLSFTDLGLPPTDHLQASFGFQTFQPSGILLDHQTWTRNLQVTLEDGYIELSTSDSGGPIFKSPQTYMDGLLHYVSVISDNSG

SEQ ID NO: 44959 - protein, 59 aa, Homo sapiens
  Payload ID: 9156
  Gene Symbol: LAMA3
  Gene Name: laminin, alpha 3
  ENSP ID: ENSP00000467662
  MOD_RES (1)..(1): Any amino acid
XAGQVNIYSCNYRCDAMNSLLSPQRLCQVPGCIAQGKRLILSNVRGCTPTFATHLQNWG

SEQ ID NO: 44960 - protein, 134 aa, Homo sapiens
  Payload ID: 9156
  Gene Symbol: LAMA3
  Gene Name: laminin, alpha 3
  ENSP ID: ENSP00000468315
  MOD_RES (1)..(1): Any amino acid
XFSEEGGHVVLAHSVLLGPEFKLVFSIRPRSLTGILIHIGSQPGKHLCVYLEAGKVTASMDSGAGGTSTSVTPKQSLCDGQWHSVAANLTTLRIPVWKSFFGCLRNIHVNHIPVPVTEALEVQGPVSLNGCPDQ

SEQ ID NO: 44961 - protein, 576 aa, Homo sapiens
  Payload ID: 9156
  Gene Symbol: LAMA3
  Gene Name: laminin, alpha 3
  ENSP ID: ENSP00000468316
MAAAARPRGRALGPVLPPTPLLLLVLRVLPACGATARDPGAAAGLSLHPTYFNLAEAARIWATATCGERGPGEGRPQPELYCKLVGGPTAPGSGHTIQGQFCDYCNSEDPRKAHPVTNAIDGSERWWQSPPLSSGTQYNRVNLTLDLGQLFHVAYILIKFANSPRPDLWVLERSVDFGSTYSPWQYFAHSKVDCLKEFGREANMAVTRDDDVLCVTEYSRIVPLENGEVVVSLINGRPGAKNFTFSHTLREFTKATNIRLRFLRTNTLLGHLISKAQRDPTVTRRYYYSIKDISIGGQCVCNGHAEVCNINNPEKLFRCECQHHTCGETCDRCCTGYNQRRWRPAAWEQSHECEACNCHGHASNCYYDPDVERQQASLNTQGIYAGGGVCINCQHNTAGVNCEQCAKGYYRPYGVPVDAPDGCIPCSCDPEHADGCEQGSGRCHCKPNFHGDNCEKCAIGYYNFPFCLRIPIFPVSTPSSEDPVAGDIKGCDCNLEGVLPEICDAHGRCLCRPGVEGPRCDTCRSGFYSFPICQGPSEKVAIYKPESRPSAETEPASTWILDFPASRTGEINFYCL

SEQ ID NO: 44962 - protein, 1823 aa, Homo sapiens
  Payload ID: 9157
  Gene Symbol: LAMA4
  Gene Name: laminin, alpha 4
  ENSP ID: ENSP00000230538
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGMDCPTISCDKCVWDLTDDLRLAALSIEEGKSGVLSVSSGAAAHRHVNEINATIYLLKTKLSERENQYALRKIQINNAENTMKSLLSDVEELVEKENQASRKGQLVQKESMDTINHASQLVEQAHDMRDKIQEINNKMLYYGEEHELSPKEISEKLVLAQKMLEEIRSRQPFFTQRELVDEEADEAYELLSQAESWQRLHNETRTLFPVVLEQLDDYNAKLSDLQEALDQALNYVRDAEDMNRATAARQRDHEKQQERVREQMEVVNMSLSTSADSLTTPRLTLSELDDIIKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGDAQQRLGQSRLITEEANRTTMEVQQATAPMANNLTNWSQNLQHFDSSAYNTAVNSARDAVRNLTEVVPQLLDQLRTVEQKRPASNVSASIQRIRELIAQTRSVASKIQVSMMFDGQSAVEVHSRTSMDDLKAFTSLSLYMKPPVKRPELTETADQFILYLGSKNAKKEYMGLAIKNDNLVYVYNLGTKDVEIPLDSKPVSSWPAYFSIVKIERVGKHGKVFLTVPSLSSTAEEKFIKKGEFSGDDSLLDLDPEDTVFYVGGVPSNFKLPTSLNLPGFVGCLELATLNNDVISLYNFKHIYNMDPSTSVPCARDKLAFTQSRAASYFFDGSGYAVVRDITRRGKFGQVTRFDIEVRTPADNGLILLMVNGSMFFRLEMRNGYLHVFYDFGFSGGPVHLEDTLKKAQINDAKYHEISIIYHNDKKMILVVDRRHVKSMDNEKMKIPFTDIYIGGAPPEILQSRALRAHLPLDINFRGCMKGFQFQKKDFNLLEQTETLGVGYGCPEDSLISRRAYFNGQSFIASIQKISFFDGFEGGFNFRTLQPNGLLFYYASGSDVFSISLDNGTVIMDVKGIKVQSVDKQYNDGLSHFVISSVSPTRYELIVDKSRVGSKNPTKGKIEQTQASEKKFYFGGSPISAQYANFTGCISNAYFTRVDRDVEVEDFQRYTEKVHTSLYECPIESSPLFLLHKKGKNLSKPKASQNKKGGKSKDAPSWDPVALKLPERNTPRNSHCHLSNSPRAIEHAYQYGGTANSRQEFEHLKGDFGAKSQFSIRLRTRSSHGMIFYVSDQEENDFMTLFLAHGRLVYMFNVGHKKLKIRSQEKYNDGLWHDVIFIRERSSGRLVIDGLRVLEESLPPTEATWKIKGPIYLGGVAPGKAVKNVQINSIYSFSGCLSNLQLNGASITSASQTFSVTPCFEGPMETGTYFSTEGGYVVLDESFNIGLKFEIAFEVRPRSSSGTLVHGHSVNGEYLNVHMKNGQVIVKVNNGIRDFSTSVTPKQSLCDGRWHRITVIRDSNVVQLDVDSEVNHVVGPLNPKPIDHREPVFVGGVPESLLTPRLAPSKPFTGCIRHFVIDGHPVSFSKAALVSGAVSINSCPAA

SEQ ID NO: 44963 - protein, 87 aa, Homo sapiens
  Payload ID: 9157
  Gene Symbol: LAMA4
  Gene Name: laminin, alpha 4
  ENSP ID: ENSP00000243219
MALSSAWRSVLPLWLLWSAACSRAASGDDNAFPFDIEGSSAVGRQDPPETSEPRVALGRLPPAAEKCNAGFFHTLSGECVPCDCNGN

SEQ ID NO: 44964 - protein, 120 aa, Homo sapiens
  Payload ID: 9157
  Gene Symbol: LAMA4
  Gene Name: laminin, alpha 4
  Uniprot ID: Q16363
  ENSP ID: ENSP00000357627
MALSSAWRSVLPLWLLWSAACSRAASGDDNAFPFDIEGSSAVGRQDPPETSEPRVALGRLPPAAEVQCPCHCHPAGAPAPPRAVPHSSFSLSPPLSSPQCLESFTWARSVRKLEIKSFPL

SEQ ID NO: 44965 - protein, 178 aa, Homo sapiens
  Payload ID: 9157
  Gene Symbol: LAMA4
  Gene Name: laminin, alpha 4
  ENSP ID: ENSP00000357629
  MOD_RES (1)..(1): Any amino acid
XIFEDCDEVTGQCRNCLRNTTGFKCERCAPGYYGDARIAKNCAVCNCGGGPCDSVTGECLEEGFEPPTGMDCPTISCDKCVWDLTDDLRLAALSIEEGKSGVLSVSSGAAAHRHVNEINATIYLLKTKLSERENQYALRKIQINNAENTMKSLLSDVEELVEKHWNKPRRRLELQEGV

SEQ ID NO: 44966 - protein, 1816 aa, Homo sapiens
  Payload ID: 9157
  Gene Symbol: LAMA4
  Gene Name: laminin, alpha 4
  ENSP ID: ENSP00000374114
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGCDKCVWDLTDDLRLAALSIEEGKSGVLSVSSGAAAHRHVNEINATIYLLKTKLSERENQYALRKIQINNAENTMKSLLSDVEELVEKENQASRKGQLVQKESMDTINHASQLVEQAHDMRDKIQEINNKMLYYGEEHELSPKEISEKLVLAQKMLEEIRSRQPFFTQRELVDEEADEAYELLSQAESWQRLHNETRTLFPVVLEQLDDYNAKLSDLQEALDQALNYVRDAEDMNRATAARQRDHEKQQERVREQMEVVNMSLSTSADSLTTPRLTLSELDDIIKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGDAQQRLGQSRLITEEANRTTMEVQQATAPMANNLTNWSQNLQHFDSSAYNTAVNSARDAVRNLTEVVPQLLDQLRTVEQKRPASNVSASIQRIRELIAQTRSVASKIQVSMMFDGQSAVEVHSRTSMDDLKAFTSLSLYMKPPVKRPELTETADQFILYLGSKNAKKEYMGLAIKNDNLVYVYNLGTKDVEIPLDSKPVSSWPAYFSIVKIERVGKHGKVFLTVPSLSSTAEEKFIKKGEFSGDDSLLDLDPEDTVFYVGGVPSNFKLPTSLNLPGFVGCLELATLNNDVISLYNFKHIYNMDPSTSVPCARDKLAFTQSRAASYFFDGSGYAVVRDITRRGKFGQVTRFDIEVRTPADNGLILLMVNGSMFFRLEMRNGYLHVFYDFGFSGGPVHLEDTLKKAQINDAKYHEISIIYHNDKKMILVVDRRHVKSMDNEKMKIPFTDIYIGGAPPEILQSRALRAHLPLDINFRGCMKGFQFQKKDFNLLEQTETLGVGYGCPEDSLISRRAYFNGQSFIASIQKISFFDGFEGGFNFRTLQPNGLLFYYASGSDVFSISLDNGTVIMDVKGIKVQSVDKQYNDGLSHFVISSVSPTRYELIVDKSRVGSKNPTKGKIEQTQASEKKFYFGGSPISAQYANFTGCISNAYFTRVDRDVEVEDFQRYTEKVHTSLYECPIESSPLFLLHKKGKNLSKPKASQNKKGGKSKDAPSWDPVALKLPERNTPRNSHCHLSNSPRAIEHAYQYGGTANSRQEFEHLKGDFGAKSQFSIRLRTRSSHGMIFYVSDQEENDFMTLFLAHGRLVYMFNVGHKKLKIRSQEKYNDGLWHDVIFIRERSSGRLVIDGLRVLEESLPPTEATWKIKGPIYLGGVAPGKAVKNVQINSIYSFSGCLSNLQLNGASITSASQTFSVTPCFEGPMETGTYFSTEGGYVVLDESFNIGLKFEIAFEVRPRSSSGTLVHGHSVNGEYLNVHMKNGQVIVKVNNGIRDFSTSVTPKQSLCDGRWHRITVIRDSNVVQLDVDSEVNHVVGPLNPKPIDHREPVFVGGVPESLLTPRLAPSKPFTGCIRHFVIDGHPVSFSKAALVSGAVSINSCPAA

SEQ ID NO: 44967 - protein, 120 aa, Homo sapiens; identical to SEQ ID NO: 44964
  Payload ID: 9157
  Gene Symbol: LAMA4
  Gene Name: laminin, alpha 4
  Uniprot ID: Q16363
  ENSP ID: ENSP00000398226

SEQ ID NO: 44968 - protein, 120 aa, Homo sapiens; identical to SEQ ID NO: 44964
  Payload ID: 9157
  Gene Symbol: LAMA4
  Gene Name: laminin, alpha 4
  Uniprot ID: Q16363
  ENSP ID: ENSP00000408604

SEQ ID NO: 44969 - protein, 129 aa, Homo sapiens
  Payload ID: 9157
  Gene Symbol: LAMA4
  Gene Name: laminin, alpha 4
  ENSP ID: ENSP00000412136
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVTTDGEDPGFSASALSFILSSQGAREARAPT

SEQ ID NO: 44970 - protein, 1816 aa, Homo sapiens; identical to SEQ ID NO: 44966
  Payload ID: 9157
  Gene Symbol: LAMA4
  Gene Name: laminin, alpha 4
  ENSP ID: ENSP00000416470

SEQ ID NO: 44971 - protein, 188 aa, Homo sapiens
  Payload ID: 9157
  Gene Symbol: LAMA4
  Gene Name: laminin, alpha 4
  ENSP ID: ENSP00000427837
  MOD_RES (1)..(1): Any amino acid
XKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGKHQRELKSHLLIHWSVR

SEQ ID NO: 44972 - protein, 187 aa, Homo sapiens
  Payload ID: 9157
  Gene Symbol: LAMA4
  Gene Name: laminin, alpha 4
  ENSP ID: ENSP00000427865
  MOD_RES (1)..(1): Any amino acid
XSTCKKCDCSGNSDPNLIFEDCDEVTGQCRNCLRNTTGFKCERCAPGYYGDARIAKNCAVCNCGGGPCDSVTGECLEEGFEPPTGCDKCVWDLTDDLRLAALSIEEGKSGVLSVSSGAAAHRHVNEINATIYLLKTKLSERENQYALRKIQINNAENTMKSLLSDVEELVEKHWNKPRRRLELQEGV

SEQ ID NO: 44973 - protein, 106 aa, Homo sapiens
  Payload ID: 9157
  Gene Symbol: LAMA4
  Gene Name: laminin, alpha 4
  ENSP ID: ENSP00000428583
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTT

SEQ ID NO: 44974 - protein, 1816 aa, Homo sapiens; identical to SEQ ID NO: 44966
  Payload ID: 9157
  Gene Symbol: LAMA4
  Gene Name: laminin, alpha 4
  ENSP ID: ENSP00000429488

SEQ ID NO: 44975 - protein, 331 aa, Homo sapiens
  Payload ID: 9157
  Gene Symbol: LAMA4
  Gene Name: laminin, alpha 4
  ENSP ID: ENSP00000430336
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGMDCPTISCDKCVWDLTDDLRLAALSIEEGKSGVLSVSSGAAAHRHVNEINATIYLLKTKLSERENQ

SEQ ID NO: 44976 - protein, 81 aa, Homo sapiens
  Payload ID: 9157
  Gene Symbol: LAMA4
  Gene Name: laminin, alpha 4
  ENSP ID: ENSP00000430415
MALSSAWRSVLPLWLLWSAACSRAASGDDNAFPFDIEGSSAVGRQDPPETSEPRVALGRLPPAAEKCNAGFFHTLSGECVP

SEQ ID NO: 44977 - protein, 3695 aa, Homo sapiens
  Payload ID: 9158
  Gene Symbol: LAMA5
  Gene Name: laminin, alpha 5
  Uniprot ID: O15230
  ENSP ID: ENSP00000252999
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEAGSCHPAGLAPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPKGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRPCDCGARLCDELTGQCICPPRTIPPDCLLCQPQTFGCHPLVGCEECNCSGPGIQELTDPTCDTDSGQCKCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVFLRRVALEVASPAGQGALASNVELCLCPASYRGDSCQECAPGFYRDVKGLFLGRCVPCQCHGHSDRCLPGSGVCVDCQHNTEGAHCERCQAGFVSSRDDPSAPCVSCPCPLSVPSNNFAEGCVLRGGRTQCLCKPGYAGASCERCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFDGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRRLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLDLPGATLPDVGLELEVRPLAVTGLIFHLGQARTPPYLQLQVTEKQVLLRADDGAGEFSTSVTRPSVLCDGQWHRLAVMKSGNVLRLEVDAQSNHTVGPLLAAAAGAPAPLYLGGLPEPMAVQPWPPAYCGCMRRLAVNRSPVAMTRSVEVHGAVGASGCPAA

SEQ ID NO: 44978 - protein, 38 aa, Homo sapiens
  Payload ID: 9158
  Gene Symbol: LAMA5
  Gene Name: laminin, alpha 5
  ENSP ID: ENSP00000420069
CVPGAYNFPYCEGAVWWDGTSVAAEGAGRCVFSGRPCG

SEQ ID NO: 44979 - protein, 241 aa, Homo sapiens
  Payload ID: 9158
  Gene Symbol: LAMA5
  Gene Name: laminin, alpha 5
  ENSP ID: ENSP00000481814
RLRFLRTNTLLGHLMGKALRDPTVTRRYYYSIKDISIGGRCVCHGHADACDAKDPTDPFSSPNLSGHNRQLPCCPSPDLHSSQAGTKAQDGDGRVGAANTPHLLCPVCLLSGAAEGTAEHPPPGSPSQDGQQPWCWHRHIPGPHPESSVRLQCTCQHNTCGGTCDRCCPGFNQQPWKPATANSANECQSCNCYGHATDCYYDPEVDRRRASQSLDGTYQGGGVCIDCQHHTTGVNCERCLP

SEQ ID NO: 44980 - protein, 1786 aa, Homo sapiens
  Payload ID: 9159
  Gene Symbol: LAMB1
  Gene Name: laminin, beta 1
  Uniprot ID: P07942
  ENSP ID: ENSP00000222399
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQRYLEDKAQELARLEGEVRSLLKDISQKVAVYSTCL

SEQ ID NO: 44981 - protein, 91 aa, Homo sapiens
  Payload ID: 9159
  Gene Symbol: LAMB1
  Gene Name: laminin, beta 1
  ENSP ID: ENSP00000377189
MGLLQLLAFSFLALCRARVRAQEPEFSYGCAEGSCYPATGDLLIGRAQKLSVTSTCGLHKPEPYCIVSHLQEDKKCFICNSQDPYHETLNP

SEQ ID NO: 44982 - protein, 850 aa, Homo sapiens
  Payload ID: 9159
  Gene Symbol: LAMB1
  Gene Name: laminin, beta 1
  ENSP ID: ENSP00000377190
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKRRFLKSIVMHSFRLTQPLWQGSIAAEPMLPS

SEQ ID NO: 44983 - protein, 1810 aa, Homo sapiens
  Payload ID: 9159
  Gene Symbol: LAMB1
  Gene Name: laminin, beta 1
  ENSP ID: ENSP00000377191
MDCPLSAPTPPPPLVRFFRAPLPACVPPTLLPVLPAALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQRYLEDKAQELARLEGEVRSLLKDISQKVAVYSTCL

SEQ ID NO: 44984 - protein, 183 aa, Homo sapiens
  Payload ID: 9159
  Gene Symbol: LAMB1
  Gene Name: laminin, beta 1
  ENSP ID: ENSP00000412686
MGLLQLLAFSFLETAGPGASLEWRSLETTPEPQGLSMGSPSSGKRRPPRAPAPRPQRSAGDPRACTHTHSRFPSSQISTRTLTPRMRGLPRARGFTCVALCRARVRAQEPEFSYGCAEGSCYPATGDLLIGRAQKLSVTSTCGLHKPEPYCIVSHLQEDKKCFICNSQDPYHETLNPDSHLIE

SEQ ID NO: 44985 - protein, 1798 aa, Homo sapiens
  Payload ID: 9160
  Gene Symbol: LAMB2
  Gene Name: laminin, beta 2 (laminin S)
  Uniprot ID: P55268
  ENSP ID: ENSP00000307156
MELTSRERGRGQPLPWELRLGLLLSVLAATLAQAPAPDVPGCSRGSCYPATGDLLVGRADRLTASSTCGLNGPQPYCIVSHLQDEKKCFLCDSRRPFSARDNPHSHRIQNVVTSFAPQRRAAWWQSENGIPAVTIQLDLEAEFHFTHLIMTFKTFRPAAMLVERSADFGRTWHVYRYFSYDCGADFPGVPLAPPRHWDDVVCESRYSEIEPSTEGEVIYRVLDPAIPIPDPYSSRIQNLLKITNLRVNLTRLHTLGDNLLDPRREIREKYYYALYELVVRGNCFCYGHASECAPAPGAPAHAEGMVHGACICKHNTRGLNCEQCQDFYRDLPWRPAEDGHSHACRKCECHGHTHSCHFDMAVYLASGNVSGGVCDGCQHNTAGRHCELCRPFFYRDPTKDLRDPAVCRSCDCDPMGSQDGGRCDSHDDPALGLVSGQCRCKEHVVGTRCQQCRDGFFGLSISDRLGCRRCQCNARGTVPGSTPCDPNSGSCYCKRLVTGRGCDRCLPGHWGLSHDLLGCRPCDCDVGGALDPQCDEGTGQCHCRQHMVGRRCEQVQPGYFRPFLDHLIWEAEDTRGQVLDVVERLVTPGETPSWTGSGFVRLQEGQTLEFLVASVPKAMDYDLLLRLEPQVPEQWAELELIVQRPGPVPAHSLCGHLVPKDDRIQGTLQPHARYLIFPNPVCLEPGISYKLHLKLVRTGGSAQPETPYSGPGLLIDSLVLLPRVLVLEMFSGGDAAALERQATFERYQCHEEGLVPSKTSPSEACAPLLISLSTLIYNGALPCQCNPQGSLSSECNPHGGQCLCKPGVVGRRCDLCAPGYYGFGPTGCQACQCSHEGALSSLCEKTSGQCLCRTGAFGLRCDRCQRGQWGFPSCRPCVCNGHADECNTHTGACLGCRDHTGGEHCERCIAGFHGDPRLPYGGQCRPCPCPEGPGSQRHFATSCHQDEYSQQIVCHCRAGYTGLRCEACAPGHFGDPSRPGGRCQLCECSGNIDPMDPDACDPHTGQCLRCLHHTEGPHCAHCKPGFHGQAARQSCHRCTCNLLGTNPQQCPSPDQCHCDPSSGQCPCLPNVQGPSCDRCAPNFWNLTSGHGCQPCACHPSRARGPTCNEFTGQCHCRAGFGGRTCSECQELHWGDPGLQCHACDCDSRGIDTPQCHRFTGHCSCRPGVSGVRCDQCARGFSGIFPACHPCHACFGDWDRVVQDLAARTQRLEQRAQELQQTGVLGAFESSFWHMQEKLGIVQGIVGARNTSAASTAQLVEATEELRREIGEATEHLTQLEADLTDVQDENFNANHALSGLERDRLALNLTLRQLDQHLDLLKHSNFLGAYDSIRHAHSQSAEAERRANTSALAVPSPVSNSASARHRTEALMDAQKEDFNSKHMANQRALGKLSAHTHTLSLTDINELVCGAPGDAPCATSPCGGAGCRDEDGQPRCGGLSCNGAAATADLALGRARHTQAELQRALAEGGSILSRVAETRRQASEAQQRAQAALDKANASRGQVEQANQELQELIQSVKDFLNQEGADPDSIEMVATRVLELSIPASAEQIQHLAGAIAERVRSLADVDAILARTVGDVRRAEQLLQDARRARSWAEDEKQKAETVQAALEEAQRAQGIAQGAIRGAVADTRDTEQTLYQVQERMAGAERALSSAGERARQLDALLEALKLKRAGNSLAASTAEETAGSAQGRAQEAEQLLRGPLGDQYQTVKALAERKAQGVLAAQARAEQLRDEARDLLQAAQDKLQRLQELEGTYEENERALESKAAQLDGLEARMRSVLQAINLQVQIYNTCQ

SEQ ID NO: 44986 - protein, 1798 aa, Homo sapiens; identical to SEQ ID NO: 44985
  Payload ID: 9160
  Gene Symbol: LAMB2
  Gene Name: laminin, beta 2 (laminin S)
  Uniprot ID: P55268
  ENSP ID: ENSP00000388325

SEQ ID NO: 44987 - protein, 151 aa, Homo sapiens
  Payload ID: 9160
  Gene Symbol: LAMB2
  Gene Name: laminin, beta 2 (laminin S)
  ENSP ID: ENSP00000444751
MTFKTFRPAAMLVERSADFGRTWHVYRYFSYDCGADFPGVPLAPPRHWDDVVCESRYSEIEPSTEGEVIYRVLDPAIPIPDPYSSRIQNLLKITNLRVNLTRLHTLGDNLLDPRREIREKYYYALYELVVRGNCFCYGHASECAPAPGAPA

SEQ ID NO: 44988 - protein, 1172 aa, Homo sapiens [sequence omitted]

SEQ ID NO: 44989 - protein, 1172 aa, Homo sapiens [sequence omitted]

SEQ ID NO: 44990 - protein, 1172 aa, Homo sapiens [sequence omitted]

SEQ ID NO: 44991 - protein, 188 aa, Homo sapiens
  Payload ID: 9161
  Gene Symbol: LAMB3
  Gene Name: laminin, beta 3
  ENSP ID: ENSP00000388960
MRPFFLLCFALPGLLHAQQACSRGACYPPVGDLLVGRTRFLRASSTCGLTKPETYCTQYGEWQMKCCKCDSRQPHNYYSHRVENVASSSGPMRWWQSQNDVNPVSLQLDLDRRFQLQEVMMEFQGPMPAGMLIERSSDFGKTWRVYQYLAADCTSTFPRVRQGRPQSWQDVRCQSLPQRPNARLNGGK

SEQ ID NO: 44992 - protein, 159 aa, Homo sapiens
  Payload ID: 9161
  Gene Symbol: LAMB3
  Gene Name: laminin, beta 3
  ENSP ID: ENSP00000398683
MNEIQAIAARLPNVDLVLSQTKQDIARARRLQAEAEEARSRAHAVEGQVEDVVGNLRQGTVALQEAQDTMQGTSRSLRLIQDRVAEVQQVLRPAEKLVTSMTKQLGDFWTRMEELRHQARQQGAEAVQAQQLAEGASEQALSAQEGFERIKQKYAELKD

SEQ ID NO: 44993 - protein, 1761 aa, Homo sapiens
  Payload ID: 9162
  Gene Symbol: LAMB4
  Gene Name: laminin, beta 4
  Uniprot ID: A4D0S4
  ENSP ID: ENSP00000205386
MQFQLTLFLHLGWLSYSKAQDDCNRGACHPTTGDLLVGRNTQLMASSTCGLSRAQKYCILSYLEGEQKCFICDSRFPYDPYDQPNSHTIENVIVSFEPDREKKWWQSENGLDHVSIRLDLEALFRFSHLILTFKTFRPAAMLVERSTDYGHNWKVFKYFAKDCATSFPNITSGQAQGVGDIVCDSKYSDIEPSTGGEVVLKVLDPSFEIENPYSPYIQDLVTLTNLRINFTKLHTLGDALLGRRQNDSLDKYYYALYEMIVRGSCFCNGHASECRPMQKMRGDVFSPPGMVHGQCVCQHNTDGPNCERCKDFFQDAPWRPAADLQDNACRSCSCNSHSSRCHFDMTTYLASGGLSGGVCEDCQHNTEGQHCDRCRPLFYRDPLKTISDPYACIPCECDPDGTISGGICVSHSDPALGSVAGQCLCKENVEGAKCDQCKPNHYGLSATDPLGCQPCDCNPLGSLPFLTCDVDTGQCLCLSYVTGAHCEECTVGYWGLGNHLHGCSPCDCDIGGAYSNVCSPKNGQCECRPHVTGRSCSEPAPGYFFAPLNFYLYEAEEATTLQGLAPLGSETFGQSPAVHVVLGEPVPGNPVTWTGPGFARVLPGAGLRFAVNNIPFPVDFTIAIHYETQSAADWTVQIVVNPPGGSEHCIPKTLQSKPQSFALPAATRIMLLPTPICLEPDVQYSIDVYFSQPLQGESHAHSHVLVDSLGLIPQINSLENFCSKQDLDEYQLHNCVEIASAMGPQVLPGACERLIISMSAKLHDGAVACKCHPQGSVGSSCSRLGGQCQCKPLVVGRCCDRCSTGSYDLGHHGCHPCHCHPQGSKDTVCDQVTGQCPCHGEVSGRRCDRCLAGYFGFPSCHPCPCNRFAELCDPETGSCFNCGGFTTGRNCERCIDGYYGNPSSGQPCRPCLCPDDPSSNQYFAHSCYQNLWSSDVICNCLQGYTGTQCGECSTGFYGNPRISGAPCQPCACNNNIDVTDPESCSRVTGECLRCLHNTQGANCQLCKPGHYGSALNQTCRRCSCHASGVSPMECPPGGGACLCDPVTGACPCLPNVTGLACDRCADGYWNLVPGRGCQSCDCDPRTSQSSHCDQLTGQCPCKLGYGGKRCSECQENYYGDPPGRCIPCDCNRAGTQKPICDPDTGMCRCREGVSGQRCDRCARGHSQEFPTCLQCHLCFDQWDHTISSLSKAVQGLMRLAANMEDKRETLPVCEADFKDLRGNVSEIERILKHPVFPSGKFLKVKDYHDSVRRQIMQLNEQLKAVYEFQDLKDTIERAKNEADLLLEDLQEEIDLQSSVLNASIADSSENIKKYYHISSSAEKKINETSSTINTSANTRNDLLTILDTLTSKGNLSLERLKQIKIPDIQILNEKVCGDPGNVPCVPLPCGGALCTGRKGHRKCRGPGCHGSLTLSTNALQKAQEAKSIIRNLDKQVRGLKNQIESISEQAEVSKNNALQLREKLGNIRNQSDSEEENINLFIKKVKNFLLEENVPPEDIEKVANGVLDIHLPIPSQNLTDELVKIQKHMQLCEDYRTDENRLNEEADGAQKLLVKAKAAEKAANILLNLDKTLNQLQQAQITQGRANSTITQLTANITKIKKNVLQAENQTREMKSELELAKQRSGLEDGLSLLQTKLQRHQDHAVNAKVQAESAQHQAGSLEKEFVELKKQYAILQRKTSTTGLTKETLGKVKQLKDAAEKLAGDTEAKIRRITDLERKIQDLNLSRQAKADQLRILEDQVVAIKNEIVEQEKKYARCYS

SEQ ID NO: 44994 - protein, 1761 aa, Homo sapiens; identical to SEQ ID NO: 44993
  Payload ID: 9162
  Gene Symbol: LAMB4
  Gene Name: laminin, beta 4
  Uniprot ID: A4D0S4
  ENSP ID: ENSP00000373433

SEQ ID NO: 44995 - protein, 772 aa, Homo sapiens
  Payload ID: 9162
  Gene Symbol: LAMB4
  Gene Name: laminin, beta 4
  ENSP ID: ENSP00000402353
MQFQLTLFLHLGWLSYSKAQDDCNRGACHPTTGDLLVGRNTQLMASSTCGLSRAQKYCILSYLEGEQKCFICDSRFPYDPYDQPNSHTIENVIVSFEPDREKKWWQSENGLDHVSIRLDLEALFRFSHLILTFKTFRPAAMLVERSTDYGHNWKVFKYFAKDCATSFPNITSGQAQGVGDIVCDSKYSDIEPSTGGEVVLKVLDPSFEIENPYSPYIQDLVTLTNLRINFTKLHTLGDALLGRRQNDSLDKYYYALYEMIVRGSCFCNGHASECRPMQKMRGDVFSPPGMVHGQCVCQHNTDGPNCERCKDFFQDAPWRPAADLQDNACRSCSCNSHSSRCHFDMTTYLASGGLSGGVCEDCQHNTEGQHCDRCRPLFYRDPLKTISDPYACIPCECDPDGTISGGICVSHSDPALGSVAGQCLCKENVEGAKCDQCKPNHYGLSATDPLGCQPCDCNPLGSLPFLTCDVDTGQCLCLSYVTGAHCEECTVGYWGLGNHLHGCSPCDCDIGGAYSNVCSPKNGQCECRPHVTGRSCSEPAPGYFFAPLNFYLYEAEEATTLQGLAPLGSETFGQSPAVHVVLGEPVPGNPVTWTGPGFARVLPGAGLRFAVNNIPFPVDFTIAIHYETQSAADWTVQIVVNPPGGSEHCIPKTLQSKPQSFALPAATRIMLLPTPICLEPDVQYSIDVYFSQPLQGESHAHSHVLVDSAAVQWHNLGSLQPPPPECKQFSCFSFPSSWDYRHPPPHLANFCIFSRDGVSPHWPGWSQTPDLR

SEQ ID NO: 44996 - protein, 749 aa, Homo sapiens
  Payload ID: 9162
  Gene Symbol: LAMB4
  Gene Name: laminin, beta 4
  ENSP ID: ENSP00000416562
NIDVTDPESCSRVTGECLRCLHNTQGANCQLCKPGHYGSALNQTCRRCSCHASGVSPMECPPGGGACLCDPVTGACPCLPNVTGLACDRCADGYWNLVPGRGCQSCDCDPRTSQSSHCDQLTGQCPCKLGYGGKRCSECQENYYGDPPGRCIPCDCNRAGTQKPICDPDTGMCRCREGVSGQRCDRCARGHSQEFPTCLQCHLCFDQWDHTISSLSKAVQGLMRLAANMEDKRETLPVCEADFKDLRGNVSEIERILKHPVFPSGKFLKVKDYHDSVRRQIMQLNEQLKAVYEFQDLKDTIERAKNEADLLLEDLQEEIDLQSSVLNASIADSSENIKKYYHISSSAEKKINETSSTINTSANTRNDLLTILDTLTSKGNLSLERLKQIKIPDIQILNEKVCGDPGNVPCVPLPCGGALCTGRKGHRKCRGPGCHGSLTLSTNALQKAQEAKSIIRNLDKQVRGLKNQIESISEQAEVSKNNALQLREKLGNIRNQSDSEEENINLFIKKVKNFLLEENVPPEDIEKVANGVLDIHLPIPSQNLTDELVKIQKHMQLCEDYRTDENRLNEEADGAQKLLVKAKAAEKAANILLNLDKTLNQLQQAQITQGRANSTITQLTANITKIKKNVLQAENQTREMKSELELAKQRSGLEDGLSLLQTKLQRHQDHAVNAKVQAESAQHQAGSLEKEFVELKKQYAILQRKTSTTGLTKETLGKVKQLKDAAEKLAGDTEAKIRRITGCFQNSAR

SEQ ID NO: 44997 - protein, 1609 aa, Homo sapiens
  Payload ID: 9163
  Gene Symbol: LAMC1
  Gene Name: laminin, gamma 1 (formerly LAMB2)
  Uniprot ID: P11047
  ENSP ID: ENSP00000258341
MRGSHRAAPALRPRGRLWPVLAVLAAAAAAGCAQAAMDECTDEGGRPQRCMPEFVNAAFNVTVVATNTCGTPPEEYCVQTGVTGVTKSCHLCDAGQPHLQHGAAFLTDYNNQADTTWWQSQTMLAGVQYPSSINLTLHLGKAFDITYVRLKFHTSRPESFAIYKRTREDGPWIPYQYYSGSCENTYSKANRGFIRTGGDEQQALCTDEFSDISPLTGGNVAFSTLEGRPSAYNFDNSPVLQEWVTATDIRVTLNRLNTFGDEVFNDPKVLKSYYYAISDFAVGGRCKCNGHASECMKNEFDKLVCNCKHNTYGVDCEKCLPFFNDRPWRRATAESASECLPCDCNGRSQECYFDPELYRSTGHGGHCTNCQDNTDGAHCERCRENFFRLGNNEACSSCHCSPVGSLSTQCDSYGRCSCKPGVMGDKCDRCQPGFHSLTEAGCRPCSCDPSGSIDECNIETGRCVCKDNVEGFNCERCKPGFFNLESSNPRGCTPCFCFGHSSVCTNAVGYSVYSISSTFQIDEDGWRAEQRDGSEASLEWSSERQDIAVISDSYFPRYFIAPAKFLGKQVLSYGQNLSFSFRVDRRDTRLSAEDLVLEGAGLRVSVPLIAQGNSYPSETTVKYVFRLHEATDYPWRPALTPFEFQKLLNNLTSIKIRGTYSERSAGYLDDVTLASARPGPGVPATWVESCTCPVGYGGQFCEMCLSGYRRETPNLGPYSPCVLCACNGHSETCDPETGVCNCRDNTAGPHCEKCSDGYYGDSTAGTSSDCQPCPCPGGSSCAVVPKTKEVVCTNCPTGTTGKRCELCDDGYFGDPLGRNGPVRLCRLCQCSDNIDPNAVGNCNRLTGECLKCIYNTAGFYCDRCKDGFFGNPLAPNPADKCKACNCNLYGTMKQQSSCNPVTGQCECLPHVTGQDCGACDPGFYNLQSGQGCERCDCHALGSTNGQCDIRTGQCECQPGITGQHCERCEVNHFGFGPEGCKPCDCHPEGSLSLQCKDDGRCECREGFVGNRCDQCEENYFYNRSWPGCQECPACYRLVKDKVADHRVKLQELESLIANLGTGDEMVTDQAFEDRLKEAEREVMDLLREAQDVKDVDQNLMDRLQRVNNTLSSQISRLQNIRNTIEETGNLAEQARAHVENTERLIEIASRELEKAKVAAANVSVTQPESTGDPNNMTLLAEEARKLAERHKQEADDIVRVAKTANDTSTEAYNLLLRTLAGENQTAFEIEELNRKYEQAKNISQDLEKQAARVHEEAKRAGDKAVEIYASVAQLSPLDSETLENEANNIKMEAENLEQLIDQKLKDYEDLREDMRGKELEVKNLLEKGKTEQQTADQLLARADAAKALAEEAAKKGRDTLQEANDILNNLKDFDRRVNDNKTAAEEALRKIPAINQTITEANEKTREAQQALGSAAADATEAKNKAHEAERIASAVQKNATSTKAEAERTFAEVTDLDNEVNNMLKQLQEAEKELKRKQDDADQDMMMAGMASQAAQEAEINARKAKNSVTSLLSIINDLLEQLGQLDTVDLNKLNEIEGTLNKAKDEMKVSDLDRKVSDLENEAKKQEAAIMDYNRDIEEIMKDIRNLEDIRKTLPSGCFNTPSIEKP

SEQ ID NO: 44998 - protein, 37 aa, Homo sapiens
  Payload ID: 9163
  Gene Symbol: LAMC1
  Gene Name: laminin, gamma 1 (formerly LAMB2)
  ENSP ID: ENSP00000473583
MKNEFDKLVCNCKHNTYGVDCEKCLPFFNDRPWRRAT

SEQ ID NO: 44999 - protein, 1193 aa, Homo sapiens
  Payload ID: 9164
  Gene Symbol: LAMC2
  Gene Name: laminin, gamma 2
  Uniprot ID: Q13753
  ENSP ID: ENSP00000264144
MPALWLGCCLCFSLLLPAARATSRREVCDCNGKSRQCIFDRELHRQTGNGFRCLNCNDNTDGIHCEKCKNGFYRHRERDRCLPCNCNSKGSLSARCDNSGRCSCKPGVTGARCDRCLPGFHMLTDAGCTQDQRLLDSKCDCDPAGIAGPCDAGRCVCKPAVTGERCDRCRSGYYNLDGGNPEGCTQCFCYGHSASCRSSAEYSVHKITSTFHQDVDGWKAVQRNGSPAKLQWSQRHQDVFSSAQRLDPVYFVAPAKFLGNQQVSYGQSLSFDYRVDRGGRHPSAHDVILEGAGLRITAPLMPLGKTLPCGLTKTYTFRLNEHPSNNWSPQLSYFEYRRLLRNLTALRIRATYGEYSTGYIDNVTLISARPVSGAPAPWVEQCICPVGYKGQFCQDCASGYKRDSARLGPFGTCIPCNCQGGGACDPDTGDCYSGDENPDIECADCPIGFYNDPHDPRSCKPCPCHNGFSCSVMPETEEVVCNNCPPGVTGARCELCADGYFGDPFGEHGPVRPCQPCQCNNNVDPSASGNCDRLTGRCLKCIHNTAGIYCDQCKAGYFGDPLAPNPADKCRACNCNPMGSEPVGCRSDGTCVCKPGFGGPNCEHGAFSCPACYNQVKIQMDQFMQQLQRMEALISKAQGGDGVVPDTELEGRMQQAEQALQDILRDAQISEGASRSLGLQLAKVRSQENSYQSRLDDLKMTVERVRALGSQYQNRVRDTHRLITQMQLSLAESEASLGNTNIPASDHYVGPNGFKSLAQEATRLAESHVESASNMEQLTRETEDYSKQALSLVRKALHEGVGSGSGSPDGAVVQGLVEKLEKTKSLAQQLTREATQAEIEADRSYQHSLRLLDSVSRLQGVSDQSFQVEEAKRIKQKADSLSSLVTRHMDEFKRTQKNLGNWKEEAQQLLQNGKSGREKSDQLLSRANLAKSRAQEALSMGNATFYEVESILKNLREFDLQVDNRKAEAEEAMKRLSYISQKVSDASDKTQQAERALGSAAADAQRAKNGAGEALEISSEIEQEIGSLNLEANVTADGALAMEKGLASLKSEMREVEGELERKELEFDTNMDAVQMVITEAQKVDTRAKNAGVTIQDTLNTLDGLLHLMDQPLSVDEEGLVLLEQKLSRAKTQINSQLRPMMSELEERARQQRGHLHLLETSIDGILADVKNLENIRDNLPPGCYNTQALEQQ

SEQ ID NO: 45000 - protein, 1111 aa, Homo sapiens
  Payload ID: 9164
  Gene Symbol: LAMC2
  Gene Name: laminin, gamma 2
  Uniprot ID: Q13753
  ENSP ID: ENSP00000432063
MPALWLGCCLCFSLLLPAARATSRREVCDCNGKSRQCIFDRELHRQTGNGFRCLNCNDNTDGIHCEKCKNGFYRHRERDRCLPCNCNSKGSLSARCDNSGRCSCKPGVTGARCDRCLPGFHMLTDAGCTQDQRLLDSKCDCDPAGIAGPCDAGRCVCKPAVTGERCDRCRSGYYNLDGGNPEGCTQCFCYGHSASCRSSAEYSVHKITSTFHQDVDGWKAVQRNGSPAKLQWSQRHQDVFSSAQRLDPVYFVAPAKFLGNQQVSYGQSLSFDYRVDRGGRHPSAHDVILEGAGLRITAPLMPLGKTLPCGLTKTYTFRLNEHPSNNWSPQLSYFEYRRLLRNLTALRIRATYGEYSTGYIDNVTLISARPVSGAPAPWVEQCICPVGYKGQFCQDCASGYKRDSARLGPFGTCIPCNCQGGGACDPDTGDCYSGDENPDIECADCPIGFYNDPHDPRSCKPCPCHNGFSCSVMPETEEVVCNNCPPGVTGARCELCADGYFGDPFGEHGPVRPCQPCQCNNNVDPSASGNCDRLTGRCLKCIHNTAGIYCDQCKAGYFGDPLAPNPADKCRACNCNPMGSEPVGCRSDGTCVCKPGFGGPNCEHGAFSCPACYNQVKIQMDQFMQQLQRMEALISKAQGGDGVVPDTELEGRMQQAEQALQDILRDAQISEGASRSLGLQLAKVRSQENSYQSRLDDLKMTVERVRALGSQYQNRVRDTHRLITQMQLSLAESEASLGNTNIPASDHYVGPNGFKSLAQEATRLAESHVESASNMEQLTRETEDYSKQALSLVRKALHEGVGSGSGSPDGAVVQGLVEKLEKTKSLAQQLTREATQAEIEADRSYQHSLRLLDSVSRLQGVSDQSFQVEEAKRIKQKADSLSSLVTRHMDEFKRTQKNLGNWKEEAQQLLQNGKSGREKSDQLLSRANLAKSRAQEALSMGNATFYEVESILKNLREFDLQVDNRKAEAEEAMKRLSYISQKVSDASDKTQQAERALGSAAADAQRAKNGAGEALEISSEIEQEIGSLNLEANVTADGALAMEKGLASLKSEMREVEGELERKELEFDTNMDAVQMVITEAQKVDTRAKNAGVTIQDTLNTLDGLLHLMGM

SEQ ID NO: 45001 - protein, 257 aa, Homo sapiens
  Payload ID: 9165
  Gene Symbol: LAMC3
  Gene Name: laminin, gamma 3
  ENSP ID: ENSP00000347627
  MOD_RES (1)..(1): Any amino acid
XTLQTAAQATLRQTEPLTKLHQEARAALTQASSSVQAATVTVMGARTLLADLEDTRKKTKQAERMLGNAAPLSSSAKKKGREAEVLAKDSAKLAKALLRERKQAHRRASRLTSQTQATLQQASQQVLASEARRQELEEAERVGAGLSEMEQQIRESRISLEKDIETLSELLARLGSLDTHQAPAQALNETQWALERLRLQLGSPGSLQRKLSLLEQESQQQELQIQGFESDLAEIRADKQNLEAILHSLPENCASWQ

SEQ ID NO: 45002 - protein, 1575 aa, Homo sapiens
  Payload ID: 9165
  Gene Symbol: LAMC3
  Gene Name: laminin, gamma 3
  Uniprot ID: Q9Y6N6
  ENSP ID: ENSP00000354360
MAAAALLLGLALLAPRAAGAGMGACYDGAGRPQRCLPVFENAAFGRLAQASHTCGSPPEDFCPHVGAAGAGAHCQRCDAADPQRHHNASYLTDFHSQDESTWWQSPSMAFGVQYPTSVNITLRLGKAYEITYVRLKFHTSRPESFAIYKRSRADGPWEPYQFYSASCQKTYGRPEGQYLRPGEDERVAFCTSEFSDISPLSGGNVAFSTLEGRPSAYNFEESPGLQEWVTSTELLISLDRLNTFGDDIFKDPKVLQSYYYAVSDFSVGGRCKCNGHASECGPDVAGQLACRCQHNTTGTDCERCLPFFQDRPWARGTAEAAHECLPCNCSGRSEECTFDRELFRSTGHGGRCHHCRDHTAGPHCERCQENFYHWDPRMPCQPCDCQSAGSLHLQCDDTGTCACKPTVTGWKCDRCLPGFHSLSEGGCRPCTCNPAGSLDTCDPRSGRCPCKENVEGNLCDRCRPGTFNLQPHNPAGCSSCFCYGHSKVCASTAQFQVHHILSDFHQGAEGWWARSVGGSEHPPQWSPNGVLLSPEDEEELTAPEKFLGDQRFSYGQPLILTFRVPPGDSPLPVQLRLEGTGLALSLRHSSLSGPQDAGHPREVELRFHLQETSEDVAPPLPPFHFQRLLANLTSLRLRVSPGPSPAGPVFLTEVRLTSARPGLSPPASWVEICSCPTGYTGQFCESCAPGYKREMPQGGPYASCVPCTCNQHGTCDPNTGICVCSHHTEGPSCERCLPGFYGNPFAGQADDCQPCPCPGQSACTTIPESREVVCTHCPPGQRGRRCEVCDDGFFGDPLGLFGHPQPCHQCQCSGNVDPNAVGNCDPLSGHCLRCLHNTTGDHCEHCQEGFYGSALAPRPADKCMPCSCHPQGSVSEQMPCDPVTGQCSCLPHVTARDCSRCYPGFFDLQPGRGCRSCKCHPLGSQEDQCHPKTGQCTCRPGVTGQACDRCQLGFFGFSIKGCRACRCSPLGAASAQCHENGTCVCRPGFEGYKCDRCHDNFFLTADGTHCQQCPSCYALVKEEAAKLKARLTLTEGWLQGSDCGSPWGPLDILLGEAPRGDVYQGHHLLPGAREAFLEQMMSLEGAVKAAREQLQRLNKGARCAQAGSQKTCTQLADLEAVLESSEEEILHAAAILASLEIPQEGPSQPTKWSHLATEARALARSHRDTATKIAATAWRALLASNTSYALLWNLLEGRVALETQRDLEDRYQEVQAAQKALRTAVAEVLPEAESVLATVQQVGADTAPYLALLASPGALPQKSRAEDLGLKAKALEKTVASWQHMATEAARTLQTAAQATLRQTEPLTKLHQEARAALTQASSSVQAATVTVMGARTLLADLEGMKLQFPRPKDQAALQRKADSVSDRLLADTRKKTKQAERMLGNAAPLSSSAKKKGREAEVLAKDSAKLAKALLRERKQAHRRASRLTSQTQATLQQASQQVLASEARRQELEEAERVGAGLSEMEQQIRESRISLEKDIETLSELLARLGSLDTHQAPAQALNETQWALERLRLQLGSPGSLQRKLSLLEQESQQQELQIQGFESDLAEIRADKQNLEAILHSLPENCASWQ

SEQ ID NO: 45003 - protein, 399 aa, Homo sapiens
  Payload ID: 9166
  Gene Symbol: LANCL1
  Gene Name: LanC lantibiotic synthetase component C-like 1 (bacterial)
  Uniprot ID: O43813
  ENSP ID: ENSP00000233714
MAQRAFPNPYADYNKSLAEGYFDAAGRLTPEFSQRLTNKIRELLQQMERGLKSADPRDGTGYTGWAGIAVLYLHLYDVFGDPAYLQLAHGYVKQSLNCLTKRSITFLCGDAGPLAVAAVLYHKMNNEKQAEDCITRLIHLNKIDPHAPNEMLYGRIGYIYALLFVNKNFGVEKIPQSHIQQICETILTSGENLARKRNFTAKSPLMYEWYQEYYVGAAHGLAGIYYYLMQPSLQVSQGKLHSLVKPSVDYVCQLKFPSGNYPPCIGDNRDLLVHWCHGAPGVIYMLIQAYKVFREEKYLCDAYQCADVIWQYGLLKKGYGLCHGSAGNAYAFLTLYNLTQDMKYLYRACKFAEWCLEYGEHGCRTPDTPFSLFEGMAGTIYFLADLLVPTKARFPAFEL

SEQ ID NO: 45004 - protein, 399 aa, Homo sapiens; identical to SEQ ID NO: 45003
  Payload ID: 9166
  Gene Symbol: LANCL1
  Gene Name: LanC lantibiotic synthetase component C-like 1 (bacterial)
  Uniprot ID: O43813
  ENSP ID: ENSP00000388713

SEQ ID NO: 45005 - protein, 399 aa, Homo sapiens; identical to SEQ ID NO: 45003
  Payload ID: 9166
  Gene Symbol: LANCL1
  Gene Name: LanC lantibiotic synthetase component C-like 1 (bacterial)
  Uniprot ID: O43813
  ENSP ID: ENSP00000393323

SEQ ID NO: 45006 - protein, 399 aa, Homo sapiens; identical to SEQ ID NO: 45003
  Payload ID: 9166
  Gene Symbol: LANCL1
  Gene Name: LanC lantibiotic synthetase component C-like 1 (bacterial)
  Uniprot ID: O43813
  ENSP ID: ENSP00000393597

SEQ ID NO: 45007 - protein, 82 aa, Homo sapiens
  Payload ID: 9166
  Gene Symbol: LANCL1
  Gene Name: LanC lantibiotic synthetase component C-like 1 (bacterial)
  ENSP ID: ENSP00000395442
MAQRAFPNPYADYNKSLAEGYFDAAGRLTPEFSQRLTNKIRELLQQMERGLKSADPRDGTGYTGWAVGRIGKSSKIQCLKRR

SEQ ID NO: 45008 - protein, 196 aa, Homo sapiens
  Payload ID: 9166
  Gene Symbol: LANCL1
  Gene Name: LanC lantibiotic synthetase component C-like 1 (bacterial)
  ENSP ID: ENSP00000396518
MAQRAFPNPYADYNKSLAEGYFDAAGRLTPEFSQRLTNKIRELLQQMERGLKSADPRDGTGYTGWAGIAVLYLHLYDVFGDPAYLQLAHGYVKQSLNCLTKRSITFLCGDAGPLAVAAVLYHKMNNEKQAEDCITRLIHLNKIDPHAPNEMLYGRIGYIYALLFVNKNFGVEKIPQSHIQQICETILTSGENLARK

SEQ ID NO: 45009 - protein, 399 aa, Homo sapiens; identical to SEQ ID NO: 45003
  Payload ID: 9166
  Gene Symbol: LANCL1
  Gene Name: LanC lantibiotic synthetase component C-like 1 (bacterial)
  Uniprot ID: O43813
  ENSP ID: ENSP00000397646

SEQ ID NO: 45010 - protein, 147 aa, Homo sapiens
  Payload ID: 9166
  Gene Symbol: LANCL1
  Gene Name: LanC lantibiotic synthetase component C-like 1 (bacterial)
  ENSP ID: ENSP00000405364
  MOD_RES (1)..(1): Any amino acid
XICETILTSGENLARKRNFTAKSPLMYEWYQEYYVGAAHGLAGIYYYLMQVFREEKYLCDAYQCADVIWQYGLLKKGYGLCHGSAGNAYAFLTLYNLTQDMKYLYRACKFAEWCLEYGEHGCRTPDTPFSLFEGMAGTIYFLADLLV

SEQ ID NO: 45011 - protein, 450 aa, Homo sapiens
  Payload ID: 9167
  Gene Symbol: LANCL2
  Gene Name: LanC lantibiotic synthetase component C-like 2 (bacterial)
  Uniprot ID: Q9NS86
  ENSP ID: ENSP00000254770
MGETMSKRLKLHLGGEAEMEERAFVNPFPDYEAAAGALLASGAAEETGCVRPPATTDEPGLPFHQDGKIIHNFIRRIQTKIKDLLQQMEEGLKTADPHDCSAYTGWTGIALLYLQLYRVTCDQTYLLRSLDYVKRTLRNLNGRRVTFLCGDAGPLAVGAVIYHKLRSDCESQECVTKLLQLQRSVVCQESDLPDELLYGRAGYLYALLYLNTEIGPGTVCESAIKEVVNAIIESGKTLSREERKTERCPLLYQWHRKQYVGAAHGMAGIYYMLMQPAAKVDQETLTEMVKPSIDYVRHKKFRSGNYPSSLSNETDRLVHWCHGAPGVIHMLMQAYKVFKEEKYLKEAMECSDVIWQRGLLRKGYGICHGTAGNGYSFLSLYRLTQDKKYLYRACKFAEWCLDYGAHGCRIPDRPYSLFEGMAGAIHFLSDVLGPETSRFPAFELDSSKRD

SEQ ID NO: 45012 - protein, 40 aa, Homo sapiens
  Payload ID: 9167
  Gene Symbol: LANCL2
  Gene Name: LanC lantibiotic synthetase component C-like 2 (bacterial)
  ENSP ID: ENSP00000387598
  MOD_RES (1)..(1): Any amino acid
XDYEAAAGALLASGAAEETGCVRPPATTDEPGLPFHQDGK

SEQ ID NO: 45013 - protein, 420 aa, Homo sapiens
  Payload ID: 9168
  Gene Symbol: LANCL3
  Gene Name: LanC lantibiotic synthetase component C-like 3 (bacterial)
  Uniprot ID: Q6ZV70
  ENSP ID: ENSP00000367882
MDTKRCFANRFDDYQGSLLAGQCEEAVAPLVTATIERILQELPPLGGGAEARGATAGASACQGGLYGGVAGVAYMLYHVSQSPLFATARERYLRSAKRLIDACARAEEWGEPDADTRAAFLLGGAGVYAVATLVYHALGRSDYVQPLGKFRALCAVCAPVSFLECGSDELFVGRAGYLCAALVLKQKLAQEVLTPAQIKSICQAILDSGKQYAIKKRKPFPLMYSYYGTEYLGAAHGLSSILQMLLSYHEHLKPSDRELVWQSVDFLMEQEQNCNWPPELGETIERENELVHWCHGAPGIAYLFAKAYLVSKKPQYLDTCIRCGELTWQKGLLKKGPGICHGVAGSAYVFLLLYRLTGNSKYIYRAQRFAQFLFTEEFKAGSRVLESIYSLYEGFSGTVCFLIDLLQPNQAEFPLFSVFV

SEQ ID NO: 45014 - protein, 388 aa, Homo sapiens
  Payload ID: 9168
  Gene Symbol: LANCL3
  Gene Name: LanC lantibiotic synthetase component C-like 3 (bacterial)
  Uniprot ID: Q6ZV70
  ENSP ID: ENSP00000367885
MDTKRCFANRFDDYQGSLLAGQCEEAVAPLVTATIERILQELPPLGGGAEARGATAGASACQGGLYGGVAGVAYMLYHVSQSPLFATARERYLRSAKRLIDACARAEEWGEPDADTRAAFLLGGAGVYAVATLVYHALGRSDYVQPLGKFRALCAVCAPVSFLECGSDELFVGRAGYLCAALVLKQKLAQEVLTPAQIKSICQAILDSGKQYAIKKRKPFPLMYSYYGTEYLGAAHGLSSILQMLLSYHEHLKPSDRELVWQSVDFLMEQEQNCNWPPELGETIERENELVHWCHGAPGIAYLFAKAYLVSKKPQYLDTCIRCGELTWQKGLLKKGPGICHGVAGSAYVFLLLYRLTGNSKYIYRAQSSFPVNLIKMEHLLYTRQHCF

SEQ ID NO: 45015 - protein, 388 aa, Homo sapiens; identical to SEQ ID NO: 45014
  Payload ID: 9168
  Gene Symbol: LANCL3
  Gene Name: LanC lantibiotic synthetase component C-like 3 (bacterial)
  Uniprot ID: Q6ZV70
  ENSP ID: ENSP00000479231

SEQ ID NO: 45016 - protein, 732 aa, Homo sapiens
  Payload ID: 9169
  Gene Symbol: LSS
  Gene Name: lanosterol synthase (2,3-oxidosqualene-lanosterol cyclase)
  Uniprot ID: P48449
  ENSP ID: ENSP00000348762
MTEGTCLRRRGGPYKTEPATDLGRWRLNCERGRQTWTYLQDERAGREQTGLEAYALGLDTKNYFKDLPKAHTAFEGALNGMTFYVGLQAEDGHWTGDYGGPLFLLPGLLITCHVARIPLPAGYREEIVRYLRSVQLPDGGWGLHIEDKSTVFGTALNYVSLRILGVGPDDPDLVRARNILHKKGGAVAIPSWGKFWLAVLNVYSWEGLNTLFPEMWLFPDWAPAHPSTLWCHCRQVYLPMSYCYAVRLSAAEDPLVQSLRQELYVEDFASIDWLAQRNNVAPDELYTPHSWLLRVVYALLNLYEHHHSAHLRQRAVQKLYEHIVADDRFTKSISIGPISKTINMLVRWYVDGPASTAFQEHVSRIPDYLWMGLDGMKMQGTNGSQIWDTAFAIQALLEAGGHHRPEFSSCLQKAHEFLRLSQVPDNPPDYQKYYRQMRKGGFSFSTLDCGWIVSDCTAEALKAVLLLQEKCPHVTEHIPRERLCDAVAVLLNMRNPDGGFATYETKRGGHLLELLNPSEVFGDIMIDYTYVECTSAVMQALKYFHKRFPEHRAAEIRETLTQGLEFCRRQQRADGSWEGSWGVCFTYGTWFGLEAFACMGQTYRDGTACAEVSRACDFLLSRQMADGGWGEDFESCEERRYLQSAQSQIHNTCWAMMGLMAVRHPDIEAQERGVRCLLEKQLPNGDWPQENIAGVFNKSCAISYTSYRNIFPIWALGRFSQLYPERALAGHP

SEQ ID NO: 45017 - protein, 732 aa, Homo sapiens; identical to SEQ ID NO: 45016
  Payload ID: 9169
  Gene Symbol: LSS
  Gene Name: lanosterol synthase (2,3-oxidosqualene-lanosterol cyclase)
  Uniprot ID: P48449
  ENSP ID: ENSP00000380837

SEQ ID NO: 45018 - protein, 262 aa, Homo sapiens
  Payload ID: 9169
  Gene Symbol: LSS
  Gene Name: lanosterol synthase (2,3-oxidosqualene-lanosterol cyclase)
  ENSP ID: ENSP00000391368
MRGGPRCLRRRGGPYKTEPATDLGRWRLNCERGRQTWTYLQDERAGREQTGLEAYALGLDTKNYFKDLPKAHTAFEGALNGMTFYVGLQAEDGHWTGDYGGPLFLLPGLLITCHVARIPLPAGYREEIVRYLRSVQLPDGGWGLHIEDKSTVFGTALNYVSLRILGVGPDDPDLVRARNILHKKGGAVAIPSWGKFWLAVLNVYSWEGLNTLFPEMWLFPDWAPAHPSTLWCHCRQVYLPMSYCYAVRLSAAEDPLVQSLRQ

SEQ ID NO: 45019 - protein, 652 aa, Homo sapiens
  Payload ID: 9169
  Gene Symbol: LSS
  Gene Name: lanosterol synthase (2,3-oxidosqualene-lanosterol cyclase)
  Uniprot ID: P48449
  ENSP ID: ENSP00000409191
MTFYVGLQAEDGHWTGDYGGPLFLLPGLLITCHVARIPLPAGYREEIVRYLRSVQLPDGGWGLHIEDKSTVFGTALNYVSLRILGVGPDDPDLVRARNILHKKGGAVAIPSWGKFWLAVLNVYSWEGLNTLFPEMWLFPDWAPAHPSTLWCHCRQVYLPMSYCYAVRLSAAEDPLVQSLRQELYVEDFASIDWLAQRNNVAPDELYTPHSWLLRVVYALLNLYEHHHSAHLRQRAVQKLYEHIVADDRFTKSISIGPISKTINMLVRWYVDGPASTAFQEHVSRIPDYLWMGLDGMKMQGTNGSQIWDTAFAIQALLEAGGHHRPEFSSCLQKAHEFLRLSQVPDNPPDYQKYYRQMRKGGFSFSTLDCGWIVSDCTAEALKAVLLLQEKCPHVTEHIPRERLCDAVAVLLNMRNPDGGFATYETKRGGHLLELLNPSEVFGDIMIDYTYVECTSAVMQALKYFHKRFPEHRAAEIRETLTQGLEFCRRQQRADGSWEGSWGVCFTYGTWFGLEAFACMGQTYRDGTACAEVSRACDFLLSRQMADGGWGEDFESCEERRYLQSAQSQIHNTCWAMMGLMAVRHPDIEAQERGVRCLLEKQLPNGDWPQENIAGVFNKSCAISYTSYRNIFPIWALGRFSQLYPERALAGHP

SEQ ID NO: 45020 - protein, 136 aa, Homo sapiens
  Payload ID: 9169
  Gene Symbol: LSS
  Gene Name: lanosterol synthase (2,3-oxidosqualene-lanosterol cyclase)
  ENSP ID: ENSP00000410678
  MOD_RES (1)..(1): Any amino acid
XESCEERRYLQSAQSQIHNTCWAMMGLMAVRHPDIEAQERGVRCLLEKQLPNGDWPQWPSSHRTQRFPALFGVITQAGLQCQYPCLQSSLEITSVFNPLFRGSVFFLFHEEDFLFTIGSQCRGVCSSPVGFSVLGG

SEQ ID NO: 45021 - protein, 721 aa, Homo sapiens
  Payload ID: 9169
  Gene Symbol: LSS
  Gene Name: lanosterol synthase (2,3-oxidosqualene-lanosterol cyclase)
  Uniprot ID: P48449
  ENSP ID: ENSP00000429133
MTEGTCLRRRGGPYKTEPATDLGRWRLNCERGRQTWTYLQDERAGREQTGLEAYALGLDTKNYFKDLPKAHTAFEGALNGMTFYVGLQAEDGHWTGDYGGPLFLLPGLLITCHVARIPLPAGYREEIVRYLRHIEDKSTVFGTALNYVSLRILGVGPDDPDLVRARNILHKKGGAVAIPSWGKFWLAVLNVYSWEGLNTLFPEMWLFPDWAPAHPSTLWCHCRQVYLPMSYCYAVRLSAAEDPLVQSLRQELYVEDFASIDWLAQRNNVAPDELYTPHSWLLRVVYALLNLYEHHHSAHLRQRAVQKLYEHIVADDRFTKSISIGPISKTINMLVRWYVDGPASTAFQEHVSRIPDYLWMGLDGMKMQGTNGSQIWDTAFAIQALLEAGGHHRPEFSSCLQKAHEFLRLSQVPDNPPDYQKYYRQMRKGGFSFSTLDCGWIVSDCTAEALKAVLLLQEKCPHVTEHIPRERLCDAVAVLLNMRNPDGGFATYETKRGGHLLELLNPSEVFGDIMIDYTYVECTSAVMQALKYFHKRFPEHRAAEIRETLTQGLEFCRRQQRADGSWEGSWGVCFTYGTWFGLEAFACMGQTYRDGTACAEVSRACDFLLSRQMADGGWGEDFESCEERRYLQSAQSQIHNTCWAMMGLMAVRHPDIEAQERGVRCLLEKQLPNGDWPQENIAGVFNKSCAISYTSYRNIFPIWALGRFSQLYPERALAGHP

SEQ ID NO: 45022 - protein, 549 aa, Homo sapiens
  Payload ID: 9169
  Gene Symbol: LSS
  Gene Name: lanosterol synthase (2,3-oxidosqualene-lanosterol cyclase)
  ENSP ID: ENSP00000485757
  MOD_RES (1)..(1): Any amino acid
XGAVAIPSWGKFWLAVLNVYSWEGLNTLFPEMWLFPDWAPAHPSTLWCHCRQVYLPMSYCYAVRLSAAEDPLVQSLRQELYVEDFASIDWLAQRNNVAPDELYTPHSWLLRVVYALLNLYEHHHSAHLRQRAVQKLYEHIVADDRFTKSISIGPISKTINMLVRWYVDGPASTAFQEHVSRIPDYLWMGLDGMKMQGTNGSQIWDTAFAIQALLEAGGHHRPEFSSCLQKAHEFLRLSQVPDNPPDYQKYYRQMRKGGFSFSTLDCGWIVSDCTAEALKAVLLLQEKCPHVTEHIPRERLCDAVAVLLNMRNPDGGFATYETKRGGHLLELLNPSEVFGDIMIDYTYVECTSAVMQALKYFHKRFPEHRAAEIRETLTQGLEFCRRQQRADGSWEGSWGVCFTYGTWFGLEAFACMGQTYRDGTACAEVSRACDFLLSRQMADGGWGEDFESCEERRYLQSAQSQIHNTCWAMMGLMAVRHPDIEAQERGVRCLLEKQLPNGDWPQENIAGVFNKSCAISYTSYRNIFPIWALGRFSQLYPERALAGHP

SEQ ID NO: 45023 - protein, 549 aa, Homo sapiens; identical to SEQ ID NO: 45022
  Payload ID: 9169
  Gene Symbol: LSS
  Gene Name: lanosterol synthase (2,3-oxidosqualene-lanosterol cyclase)
  ENSP ID: ENSP00000486113
  MOD_RES (1)..(1): Any amino acid

SEQ ID NO: 45024 - protein, 549 aa, Homo sapiens; identical to SEQ ID NO: 45022
  Payload ID: 9169
  Gene Symbol: LSS
  Gene Name: lanosterol synthase (2,3-oxidosqualene-lanosterol cyclase)
  ENSP ID: ENSP00000487109
  MOD_RES (1)..(1): Any amino acid

SEQ ID NO: 45025 - protein, 136 aa, Homo sapiens; identical to SEQ ID NO: 45020
  Payload ID: 9169
  Gene Symbol: LSS
  Gene Name: lanosterol synthase (2,3-oxidosqualene-lanosterol cyclase)
  ENSP ID: ENSP00000487196
  MOD_RES (1)..(1): Any amino acid

SEQ ID NO: 45026 - protein, 78 aa, Homo sapiens
  Payload ID: 9169
  Gene Symbol: LSS
  Gene Name: lanosterol synthase (2,3-oxidosqualene-lanosterol cyclase)
  ENSP ID: ENSP00000487418
  MOD_RES (1)..(1): Any amino acid
XGAVAIPSWGKFWLAVLNVYSWEGLNTLFPEMWLFPDWAPAHPSTLWCHCRQVYLPMSYCYAVRLSAAEDPLVQSLRQ

SEQ ID NO: 45027 - protein, 658 aa, Homo sapiens
  Payload ID: 9170
  Gene Symbol: LSG1
  Gene Name: large 60S subunit nuclear export GTPase 1
  Uniprot ID: Q9H089
  ENSP ID: ENSP00000265245
MGRRRAPAGGSLGRALMRHQTQRSRSHRHTDSWLHTSELNDGYDWGRLNLQSVTEQSSLDDFLATAELAGTEFVAEKLNIKFVPAEARTGLLSFEESQRIKKLHEENKQFLCIPRRPNWNQNTTPEELKQAEKDNFLEWRRQLVRLEEEQKLILTPFERNLDFWRQLWRVIERSDIVVQIVDARNPLLFRCEDLECYVKEMDANKENVILINKADLLTAEQRSAWAMYFEKEDVKVIFWSALAGAIPLNGDSEEEANRDDRQSNTTKFGHSSFDQAEISHSESEHLPARDSPSLSENPTTDEDDSEYEDCPEEEEDDWQTCSEEDGPKEEDCSQDWKESSTADSEARSRKTPQKRQIHNFSHLVSKQELLELFKELHTGRKVKDGQLTVGLVGYPNVGKSSTINTIMGNKKVSVSATPGHTKHFQTLYVEPGLCLCDCPGLVMPSFVSTKAEMTCSGILPIDQMRDHVPPVSLVCQNIPRHVLEATYGINIITPREDEDPHRPPTSEELLTAYGYMRGFMTAHGQPDQPRSARYILKDYVSGKLLYCHPPPGRDPVTFQHQHQRLLENKMNSDEIKMQLGRNKKAKQIENIVDKTFFHQENVRALTKGVQAVMGYKPGSGVVTASTASSENGAGKPWKKHGNRNKKEKSRRLYKHLDM

SEQ ID NO: 45028 - protein, 178 aa, Homo sapiens
  Payload ID: 9170
  Gene Symbol: LSG1
  Gene Name: large 60S subunit nuclear export GTPase 1
  ENSP ID: ENSP00000400903
MGRRRAPAGGSLGRALMRHQTQRSRSHRHTDSWLHTSELNDGYDWGRLNLQSVTEQSSLDDFLATAELAGTEFVAEKLNIKFVPAEARTGLLSFEESQRIKKLHEENKQFLCIPRRPNWNQNTTPEELKQAEKDNFLEWRRQLVRLEEEQKLILTPFERNLDFWRQLWRVIERSAGHL

SEQ ID NO: 45029 - protein, 285 aa, Homo sapiens
  Payload ID: 9170
  Gene Symbol: LSG1
  Gene Name: large 60S subunit nuclear export GTPase 1
  ENSP ID: ENSP00000408264
  MOD_RES (1)..(1): Any amino acid
XFGHSSFDQAEISHSESEHLPARDSPSLSENPTTDEDDSEYEDCPEEEEDDWQTCSEEDGPKEEDCSQDWKESSTADSEARSRKTPQKRQIHNFSHLVSKQELLELFKELHTGRKVKDGQLTVGLVGYPNVGKSSTINTIMGNKKVSVSATPGHTKHFQTLYVEPGLCLCDCPGLVMPSFVSTKAEMTCSGILPIDQMRDHVPPVSLIITPREDEDPHRPPTSEELLTAYGYMRGFMTAHGQPDQPRSARYILKDYVSGKLLYCHPPPGRDPVTFQHQHQRLLEN

SEQ ID NO: 45030 - protein, 1130 aa, Homo sapiens
  Payload ID: 9171
  Gene Symbol: LATS1
  Gene Name: large tumor suppressor kinase 1
  Uniprot ID: O95835
  ENSP ID: ENSP00000253339
MKRSEKPEGYRQMRPKTFPASNYTVSSRQMLQEIRESLRNLSKPSDAAKAEHNMSKMSTEDPRQVRNPPKFGTHHKALQEIRNSLLPFANETNSSRSTSEVNPQMLQDLQAAGFDEDMVIQALQKTNNRSIEAAIEFISKMSYQDPRREQMAAAAARPINASMKPGNVQQSVNRKQSWKGSKESLVPQRHGPPLGESVAYHSESPNSQTDVGRPLSGSGISAFVQAHPSNGQRVNPPPPPQVRSVTPPPPPRGQTPPPRGTTPPPPSWEPNSQTKRYSGNMEYVISRISPVPPGAWQEGYPPPPLNTSPMNPPNQGQRGISSVPVGRQPIIMQSSSKFNFPSGRPGMQNGTGQTDFMIHQNVVPAGTVNRQPPPPYPLTAANGQSPSALQTGGSAAPSSYTNGSIPQSMMVPNRNSHNMELYNISVPGLQTNWPQSSSAPAQSSPSSGHEIPTWQPNIPVRSNSFNNPLGNRASHSANSQPSATTVTAITPAPIQQPVKSMRVLKPELQTALAPTHPSWIPQPIQTVQPSPFPEGTASNVTVMPPVAEAPNYQGPPPPYPKHLLHQNPSVPPYESISKPSKEDQPSLPKEDESEKSYENVDSGDKEKKQITTSPITVRKNKKDEERRESRIQSYSPQAFKFFMEQHVENVLKSHQQRLHRKKQLENEMMRVGLSQDAQDQMRKMLCQKESNYIRLKRAKMDKSMFVKIKTLGIGAFGEVCLARKVDTKALYATKTLRKKDVLLRNQVAHVKAERDILAEADNEWVVRLYYSFQDKDNLYFVMDYIPGGDMMSLLIRMGIFPESLARFYIAELTCAVESVHKMGFIHRDIKPDNILIDRDGHIKLTDFGLCTGFRWTHDSKYYQSGDHPRQDSMDFSNEWGDPSSCRCGDRLKPLERRAARQHQRCLAHSLVGTPNYIAPEVLLRTGYTQLCDWWSVGVILFEMLVGQPPFLAQTPLETQMKVINWQTSLHIPPQAKLSPEASDLIIKLCRGPEDRLGKNGADEIKAHPFFKTIDFSSDLRQQSASYIPKITHPTDTSNFDPVDPDKLWSDDNEEENVNDTLNGWYKNGKHPEHAFYEFTFRRFFDDNGYPYNYPKPIEYEYINSQGSEQQSDEDDQNTGSEIKNRDLVYV

SEQ ID NO: 45031 - protein, 135 aa, Homo sapiens
  Payload ID: 9171
  Gene Symbol: LATS1
  Gene Name: large tumor suppressor kinase 1
  ENSP ID: ENSP00000403815
MKRSEKPEGYRQMRPKTFPASNYTVSSRQMLQEIRESLRNLSKPSDAAKAEHNMSKMSTEDPRQVRNPPKFGTHHKALQEIRNSLLPFANETNSSRSTSEVNPQMLQDLQAAGFDEEDHLSVACSPISLTKPFLI

SEQ ID NO: 45032 - protein, 1130 aa, Homo sapiens; identical to SEQ ID NO: 45030
  Payload ID: 9171
  Gene Symbol: LATS1
  Gene Name: large tumor suppressor kinase 1
  Uniprot ID: O95835
  ENSP ID: ENSP00000437550

SEQ ID NO: 45033 - protein, 200 aa, Homo sapiens
  Payload ID: 9171
  Gene Symbol: LATS1
  Gene Name: large tumor suppressor kinase 1
  ENSP ID: ENSP00000441265
VKGRARSSRPLGRAALARGSPPVRLPALPHQGYLGLLGRTLAASASALRPVAAVQELCSPLQDMVIQALQKTNNRSIEAAIEFISKMSYQDPRREQMAAAAARPINASMKPGNVQQSVNRKQSWKGSKESLVPQRHGPPLGESVAYHSESPNSQTDVGRPLSGSGISAFVQAHPSNGQRVNPPPPPQVRSVTPPPPPRGQ

SEQ ID NO: 45034 - protein, 135 aa, Homo sapiens; identical to SEQ ID NO: 45031
  Payload ID: 9171
  Gene Symbol: LATS1
  Gene Name: large tumor suppressor kinase 1
  ENSP ID: ENSP00000444535

SEQ ID NO: 45035 - protein, 690 aa, Homo sapiens
  Payload ID: 9171
  Gene Symbol: LATS1
  Gene Name: large tumor suppressor kinase 1
  Uniprot ID: O95835
  ENSP ID: ENSP00000444678
MKRSEKPEGYRQMRPKTFPASNYTVSSRQMLQEIRESLRNLSKPSDAAKAEHNMSKMSTEDPRQVRNPPKFGTHHKALQEIRNSLLPFANETNSSRSTSEVNPQMLQDLQAAGFDEDMVIQALQKTNNRSIEAAIEFISKMSYQDPRREQMAAAAARPINASMKPGNVQQSVNRKQSWKGSKESLVPQRHGPPLGESVAYHSESPNSQTDVGRPLSGSGISAFVQAHPSNGQRVNPPPPPQVRSVTPPPPPRGQTPPPRGTTPPPPSWEPNSQTKRYSGNMEYVISRISPVPPGAWQEGYPPPPLNTSPMNPPNQGQRGISSVPVGRQPIIMQSSSKFNFPSGRPGMQNGTGQTDFMIHQNVVPAGTVNRQPPPPYPLTAANGQSPSALQTGGSAAPSSYTNGSIPQSMMVPNRNSHNMELYNISVPGLQTNWPQSSSAPAQSSPSSGHEIPTWQPNIPVRSNSFNNPLGNRASHSANSQPSATTVTAITPAPIQQPVKSMRVLKPELQTALAPTHPSWIPQPIQTVQPSPFPEGTASNVTVMPPVAEAPNYQGPPPPYPKHLLHQNPSVPPYESISKPSKEDQPSLPKEDESEKSYENVDSGDKEKKQITTSPITVRKNKKDEERRESRIQSYSPQAFKFFMEQHVENVLKSHQQRLHRKKQLENEMMRVKPFKMSIFILNHLFAWCLF

SEQ ID NO: 45036 - protein, 1088 aa, Homo sapiens
  Payload ID: 9172
  Gene Symbol: LATS2
  Gene Name: large tumor suppressor kinase 2
  Uniprot ID: Q9NRM7
  ENSP ID: ENSP00000372035
MRPKTFPATTYSGNSRQRLQEIREGLKQPSKSSVQGLPAGPNSDTSLDAKVLGSKDATRQQQQMRATPKFGPYQKALREIRYSLLPFANESGTSAAAEVNRQMLQELVNAGCDQEMAGRALKQTGSRSIEAALEYISKMGYLDPRNEQIVRVIKQTSPGKGLMPTPVTRRPSFEGTGDSFASYHQLSGTPYEGPSFGADGPTALEEMPRPYVDYLFPGVGPHGPGHQHQHPPKGYGASVEAAGAHFPLQGAHYGRPHLLVPGEPLGYGVQRSPSFQSKTPPETGGYASLPTKGQGGPPGAGLAFPPPAAGLYVPHPHHKQAGPAAHQLHVLGSRSQVFASDSPPQSLLTPSRNSLNVDLYELGSTSVQQWPAATLARRDSLQKPGLEAPPRAHVAFRPDCPVPSRTNSFNSHQPRPGPPGKAEPSLPAPNTVTAVTAAHILHPVKSVRVLRPEPQTAVGPSHPAWVPAPAPAPAPAPAPAAEGLDAKEEHALALGGAGAFPLDVEYGGPDRRCPPPPYPKHLLLRSKSEQYDLDSLCAGMEQSLRAGPNEPEGGDKSRKSAKGDKGGKDKKQIQTSPVPVRKNSRDEEKRESRIKSYSPYAFKFFMEQHVENVIKTYQQKVNRRLQLEQEMAKAGLCEAEQEQMRKILYQKESNYNRLKRAKMDKSMFVKIKTLGIGAFGEVCLACKVDTHALYAMKTLRKKDVLNRNQVAHVKAERDILAEADNEWVVKLYYSFQDKDSLYFVMDYIPGGDMMSLLIRMEVFPEHLARFYIAELTLAIESVHKMGFIHRDIKPDNILIDLDGHIKLTDFGLCTGFRWTHNSKYYQKGSHVRQDSMEPSDLWDDVSNCRCGDRLKTLEQRARKQHQRCLAHSLVGTPNYIAPEVLLRKGYTQLCDWWSVGVILFEMLVGQPPFLAPTPTETQLKVINWENTLHIPAQVKLSPEARDLITKLCCSADHRLGRNGADDLKAHPFFSAIDFSSDIRKQPAPYVPTISHPMDTSNFDPVDEESPWNDASEGSTKAWDTLTSPNNKHPEHAFYEFTFRRFFDDNGYPFRCPKPSGAEASQAESSDLESSDLVDQTEGCQPVYV

SEQ ID NO: 45037 - protein, 675 aa, Homo sapiens
  Payload ID: 9173
  Gene Symbol: LAS1L
  Gene Name: LAS1-like, ribosome biogenesis factor
  Uniprot ID: Q9Y4W2
  ENSP ID: ENSP00000363937
MSWESGAGPGLGSQGMDLVWSAWYGKCVKGKGSLPLSAHGIVVAWLSRAEWDQVTVYLFCDDHKLQRYALNRITVWRSRFVNLISERKTKFAKVPLKCLAQEVNIPDWIVDLRHELTHKKMPHINDCRRGCYFVLDWLQKTYWCRQLENSLRETWELEEFREGIEEEDQEEDKNIVVDDITEQKPEPQDDGKSTESDVKADGDSKGSEEVDSHCKKALSHKELYERARELLVSYEEEQFTVLEKFRYLPKAIKAWNNPSPRVECVLAELKGVTCENREAVLDAFLDDGFLVPTFEQLAALQIEYEENVDLNDVLVPKPFSQFWQPLLRGLHSQNFTQALLERMLSELPALGISGIRPTYILRWTVELIVANTKTGRNARRFSAGQWEARRGWRLFNCSASLDWPRMVESCLGSPCWASPQLLRIIFKAMGQGLPDEEQEKLLRICSIYTQSGENSLVQEGSEASPIGKSPYTLDSLYWSVKPASSSFGSEAKAQQQEEQGSVNDVKEEEKEEKEVLPDQVEEEEENDDQEEEEEDEDDEDDEEEDRMEVGPFSTGQESPTAENARLLAQKRGALQGSAWQVSSEDVRWDTFPLGRMPGQTEDPAELMLENYDTMYLLDQPVLEQRLEPSTCKTDTLGLSCGVGSGNCSNSSSSNFEGLLWSQGQLHGLKTGLQLF

SEQ ID NO: 45038 - protein, 717 aa, Homo sapiens
  Payload ID: 9173
  Gene Symbol: LAS1L
  Gene Name: LAS1-like, ribosome biogenesis factor
  Uniprot ID: Q9Y4W2
  ENSP ID: ENSP00000363940
MSWESGAGPGLGSQGMDLVWSAWYGKCVKGKGSLPLSAHGIVVAWLSRAEWDQVTVYLFCDDHKLQRYALNRITVWRSRSGNELPLAVASTADLIRCKLLDVTGGLGTDELRLLYGMALVRFVNLISERKTKFAKVPLKCLAQEVNIPDWIVDLRHELTHKKMPHINDCRRGCYFVLDWLQKTYWCRQLENSLRETWELEEFREGIEEEDQEEDKNIVVDDITEQKPEPQDDGKSTESDVKADGDSKGSEEVDSHCKKALSHKELYERARELLVSYEEEQFTVLEKFRYLPKAIKAWNNPSPRVECVLAELKGVTCENREAVLDAFLDDGFLVPTFEQLAALQIEYEENVDLNDVLVPKPFSQFWQPLLRGLHSQNFTQALLERMLSELPALGISGIRPTYILRWTVELIVANTKTGRNARRFSAGQWEARRGWRLFNCSASLDWPRMVESCLGSPCWASPQLLRIIFKAMGQGLPDEEQEKLLRICSIYTQSGENSLVQEGSEASPIGKSPYTLDSLYWSVKPASSSFGSEAKAQQQEEQGSVNDVKEEEKEEKEVLPDQVEEEEENDDQEEEEEDEDDEDDEEEDRMEVGPFSTGQESPTAENARLLAQKRGALQGSAWQVSSEDVRWDTFPLGRMPGQTEDPAELMLENYDTMYLLDQPVLEQRLEPSTCKTDTLGLSCGVGSGNCSNSSSSNFEGLLWSQGQLHGLKTGLQLF

SEQ ID NO: 45039 - protein, 734 aa, Homo sapiens
  Payload ID: 9173
  Gene Symbol: LAS1L
  Gene Name: LAS1-like, ribosome biogenesis factor
  Uniprot ID: Q9Y4W2
  ENSP ID: ENSP00000363944
MSWESGAGPGLGSQGMDLVWSAWYGKCVKGKGSLPLSAHGIVVAWLSRAEWDQVTVYLFCDDHKLQRYALNRITVWRSRSGNELPLAVASTADLIRCKLLDVTGGLGTDELRLLYGMALVRFVNLISERKTKFAKVPLKCLAQEVNIPDWIVDLRHELTHKKMPHINDCRRGCYFVLDWLQKTYWCRQLENSLRETWELEEFREGIEEEDQEEDKNIVVDDITEQKPEPQDDGKSTESDVKADGDSKGSEEVDSHCKKALSHKELYERARELLVSYEEEQFTVLEKFRYLPKAIKAWNNPSPRVECVLAELKGVTCENREAVLDAFLDDGFLVPTFEQLAALQIEYEDGQTEVQRGEGTDPKSHKNVDLNDVLVPKPFSQFWQPLLRGLHSQNFTQALLERMLSELPALGISGIRPTYILRWTVELIVANTKTGRNARRFSAGQWEARRGWRLFNCSASLDWPRMVESCLGSPCWASPQLLRIIFKAMGQGLPDEEQEKLLRICSIYTQSGENSLVQEGSEASPIGKSPYTLDSLYWSVKPASSSFGSEAKAQQQEEQGSVNDVKEEEKEEKEVLPDQVEEEEENDDQEEEEEDEDDEDDEEEDRMEVGPFSTGQESPTAENARLLAQKRGALQGSAWQVSSEDVRWDTFPLGRMPGQTEDPAELMLENYDTMYLLDQPVLEQRLEPSTCKTDTLGLSCGVGSGNCSNSSSSNFEGLLWSQGQLHGLKTGLQLF

SEQ ID NO: 45040 - protein, 291 aa, Homo sapiens
  Payload ID: 9173
  Gene Symbol: LAS1L
  Gene Name: LAS1-like, ribosome biogenesis factor
  Uniprot ID: Q9Y4W2
  ENSP ID: ENSP00000473471
MSWESGAGPGLGSQGMDLVWSAWYGKCVKGKGSLPLSAHGIVVAWLSRAEWDQVTVYLFCDDHKLQRYALNRITVWRSRSGNELPLAVASTADLIRCKLLDVTGGLGTDELRLLYGMALVRFVNLISERKTKFAKVPLKCLAQEVNIPDWIVDLRHELTHKKMPHINDCRRGCYFVLDWLQKTYWCRQLENSLRETWELEEFREGIEEEDQEEDKNIVVDDITEQKPEPQDDGKSTESDVKADGDSKGSEEVDSHCKKALSHKELYERARELLVSYEEEQFTGGCAGCFSG

SEQ ID NO: 45041 - protein, 73 aa, Homo sapiens
  Payload ID: 9173
  Gene Symbol: LAS1L
  Gene Name: LAS1-like, ribosome biogenesis factor
  ENSP ID: ENSP00000473630
  MOD_RES (1)..(1): Any amino acid
XMVESCLGSPCWASPQLLRIACRVEAAGLGEVWTTEIFSQPKHTRGMRHMPAVTAAHLGTISCAQILPFPDKQ

SEQ ID NO: 45042 - protein, 110 aa, Homo sapiens
  Payload ID: 9174
  Gene Symbol: LCE1A
  Gene Name: late cornified envelope 1A
  Uniprot ID: Q5T7P2
  ENSP ID: ENSP00000334869
MSCQQSQQQCQPPPKCTPKCPPKCPTPKCPPKCPPKCPPVSSCCSVSSGGCCGSSSGGGCSSGGGGCCLSHHRRHRSHRHRLQSSGCCSQPSGGSSCCGGDSGQHSGGCC

SEQ ID NO: 45043 - protein, 118 aa, Homo sapiens
  Payload ID: 9175
  Gene Symbol: LCE1B
  Gene Name: late cornified envelope 1B
  Uniprot ID: Q5T7P3
  ENSP ID: ENSP00000353203
MSCQQNQQQCQPPPKCIPKCPPKCLTPRCPPKCPPKCPPVSSCCSVSSGGCCGSSSGGSCGSSSGGCCSSGGGGCCLSHHRRRRSHCHRPQSSGCCSQPSGGSSCCGGGSGQHSGGCC

SEQ ID NO: 45044 - protein, 118 aa, Homo sapiens
  Payload ID: 9176
  Gene Symbol: LCE1C
  Gene Name: late cornified envelope 1C
  Uniprot ID: Q5T751
  ENSP ID: ENSP00000475270
MSCQQSQQQCQPPPKCTPKCPPKCPTPKCPPKCPPKCPPVSSCCSVSSGGCCGSSSGGSCGSSSGGCCSSGGGGCCLSHHRRRRSHCHRPQSSGCCSQPSGGSSCCGGGSGQHSGGCC

SEQ ID NO: 45045 - protein, 54 aa, Homo sapiens
  Payload ID: 9176
  Gene Symbol: LCE1C
  Gene Name: late cornified envelope 1C
  ENSP ID: ENSP00000476034
MSCQQSQQQCQPPPNVSSGGCCGSSSGGSCGSSSGGCCSSGGGGCCLSHHRRRR

SEQ ID NO: 45046 - protein, 114 aa, Homo sapiens
  Payload ID: 9177
  Gene Symbol: LCE1D
  Gene Name: late cornified envelope 1D
  Uniprot ID: Q5T752
  ENSP ID: ENSP00000316737
MSCQQSQQQCQPPPKCTPKCTPKCPAPKCPPKCPPVSSCCSVSSGGCCGSSSGGGCGSNSGGCCSSGGGGCCLSHHRRHRSHRRRPQSSDCCSQPSGGSSCCGGGSSQHSGGCC

SEQ ID NO: 45047 - protein, 118 aa, Homo sapiens
  Payload ID: 9178
  Gene Symbol: LCE1E
  Gene Name: late cornified envelope 1E
  Uniprot ID: Q5T753
  ENSP ID: ENSP00000357759
MSCQQSQQQCQPPPKCTPKCPPKCPTPKCPPKCPPKCPPVSSCCSVSSGGCCGSSSGGSCGSSSGGCCSSGGGGCCLSHHRHHRSHRHRPQSSDCCSQPSGGSSCCGGGSGQHSGGCC

SEQ ID NO: 45048 - protein, 118 aa, Homo sapiens; identical to SEQ ID NO: 45047
  Payload ID: 9178
  Gene Symbol: LCE1E
  Gene Name: late cornified envelope 1E
  Uniprot ID: Q5T753
  ENSP ID: ENSP00000357760

SEQ ID NO: 45049 - protein, 88 aa, Homo sapiens
  Payload ID: 9178
  Gene Symbol: LCE1E
  Gene Name: late cornified envelope 1E
  ENSP ID: ENSP00000480425
MSCQQSQQQCQPPPNVSSGGCCGSSSGGSCGSSSGGCCSSGGGGCCLSHHRHHRSHRHRPQSSDCCSQPSGGSSCCGGGSGQHSGGCC

SEQ ID NO: 45050 - protein, 118 aa, Homo sapiens
  Payload ID: 9179
  Gene Symbol: LCE1F
  Gene Name: late cornified envelope 1F
  Uniprot ID: Q5T754
  ENSP ID: ENSP00000334187
MSCQQSQQQCQPPPKCTPKCPPKCPTPKCPPKCPPKCPPVSSCCSVSSGGCCGSSSGGCCSSGGGGCCSSGGGGCCLSHHRRRRSHRHRPQSSDCCSQPSAGSSCCGGGSGQHSGGCC

SEQ ID NO: 45051 - protein, 106 aa, Homo sapiens
  Payload ID: 9180
  Gene Symbol: LCE2A
  Gene Name: late cornified envelope 2A
  Uniprot ID: Q5TA79
  ENSP ID: ENSP00000357768
MSCQQNQQQCQPPPKCPPKCPPKCPPKCRPQCPAPCPPPVSSCCGPSSGGCCGSSSGGCCSSGGGGCCLSHHRPRLFHRHRHQSPDCCECEPSGGSGCCHSSGDCC

SEQ ID NO: 45052 - protein, 110 aa, Homo sapiens
  Payload ID: 9181
  Gene Symbol: LCE2B
  Gene Name: late cornified envelope 2B
  Uniprot ID: O14633
  ENSP ID: ENSP00000357769
MSCQQNQQQCQPPPKCPPKCTPKCPPKCPPKCLPQCPAPCSPAVSSCCGPISGGCCGPSSGGCCNSGAGGCCLSHHRPRLFHRRRHQSPDCCESEPSGGSGCCHSSGGCC

SEQ ID NO: 45053 - protein, 110 aa, Homo sapiens
  Payload ID: 9182
  Gene Symbol: LCE2C
  Gene Name: late cornified envelope 2C
  Uniprot ID: Q5TA81
  ENSP ID: ENSP00000357772
MSCQQNQQQCQPPPKCPPKCTPKCPPKCPPKCPPQCPAPCFPAVSSCCGPSSGSCCGPSSGGCCSSGAGGCSLSHHRPRLFHRRRHQSPDCCESEPSGGSGCCHSSGGCC

SEQ ID NO: 45054 - protein, 110 aa, Homo sapiens
  Payload ID: 9183
  Gene Symbol: LCE2D
  Gene Name: late cornified envelope 2D
  Uniprot ID: Q5TA82
  ENSP ID: ENSP00000357773
MSCQQNQQQCQPPPKCPPKCTPKCPPKCPPKCPPQCPAPCSPAVSSCCGPSSGSCCGPSSGGCCSSGGGGCCLSHHRPRLFHRRRHQSPDCCESEPSGASGCCHSSGGCC

SEQ ID NO: 45055 - protein, 89 aa, Homo sapiens
  Payload ID: 9184
  Gene Symbol: LCE3A
  Gene Name: late cornified envelope 3A
  Uniprot ID: Q5TA76
  ENSP ID: ENSP00000335006
MSCQQNQQQCQPPPKCPAKSPAQCLPPASSSCAPSSGGCGPSSERSCCLSHHRCRRSHRCRCQSSNSCDRGSGQQGGSSSCGHSSAGCC

SEQ ID NO: 45056 - protein, 95 aa, Homo sapiens
  Payload ID: 9185
  Gene Symbol: LCE3B
  Gene Name: late cornified envelope 3B
  Uniprot ID: Q5TA77
  ENSP ID: ENSP00000335358
MSCQQNQQQCQPLPKCPSPKCPPKSSAQCLPPASSCCAPRPGCCGGPSSEGGCCLSHHRCCRSHRCRRQSSNSCDRGSGQQDGASDCGYGSGGCC

SEQ ID NO: 45057 - protein, 94 aa, Homo sapiens
  Payload ID: 9186
  Gene Symbol: LCE3C
  Gene Name: late cornified envelope 3C
  Uniprot ID: Q5T5A8
  ENSP ID: ENSP00000334644
MSCQQNQQQCQPPPSCPSPKCPPKSPAQCLPPPSSDCALSSGGCGPSSESGCCLSHHRHFRSHQCRRQRSNSCDRGSGQQGGGSCRGHGSGGCC

SEQ ID NO: 45058 - protein, 89 aa, Homo sapiens
  Payload ID: 9186
  Gene Symbol: LCE3C
  Gene Name: late cornified envelope 3C
  ENSP ID: ENSP00000482477
MSCQQSQQQCQPPPKCPPKSPAQCLPPPSSDCALSSGGCGPSSESGCCLSHHRHFRSHQCRRQRSNSCDRGSGQQGGGSCRGHGSGGCC

SEQ ID NO: 45059 - protein, 92 aa, Homo sapiens
  Payload ID: 9187
  Gene Symbol: LCE3D
  Gene Name: late cornified envelope 3D
  Uniprot ID: Q9BYE3
  ENSP ID: ENSP00000357776
MSCQQNQQQCQPPPKCPSPKCPPKSPVQCLPPASSGCAPSSGGCGPSSEGGCFLNHHRRHHRCRRQRPNSCDRGSGQQGGGSGCGHGSGGCC

SEQ ID NO: 45060 - protein, 92 aa, Homo sapiens
  Payload ID: 9188
  Gene Symbol: LCE3E
  Gene Name: late cornified envelope 3E
  Uniprot ID: Q5T5B0
  ENSP ID: ENSP00000357778
MSCQQNQKQCQPPPKCPSPKCPPKNPVQCLPPASSGCAPSSGGCGPSSEGGCFLNHHRRHHRCRRQRSNSCDRGSGQQGGGSGCCHGSGGCC

SEQ ID NO: 45061 - protein, 99 aa, Homo sapiens
  Payload ID: 9189
  Gene Symbol: LCE4A
  Gene Name: late cornified envelope 4A
  Uniprot ID: Q5TA78
  ENSP ID: ENSP00000335223
MSCQQNQQQCQPPPKCPIPKYPPKCPSKCASSCPPPISSCCGSSSGGCGCCSSEGGGCCLSHHRHHRSHCHRPKSSNCYGSGSGQQSGGSGCCSGGGCC

SEQ ID NO: 45062 - protein, 99 aa, Homo sapiens; identical to SEQ ID NO: 45061
  Payload ID: 9189
  Gene Symbol: LCE4A
  Gene Name: late cornified envelope 4A
  Uniprot ID: Q5TA78
  ENSP ID: ENSP00000357766

SEQ ID NO: 45063 - protein, 118 aa, Homo sapiens
  Payload ID: 9190
  Gene Symbol: LCE5A
  Gene Name: late cornified envelope 5A
  Uniprot ID: Q5TCM9
  ENSP ID: ENSP00000333952
MSCQQSQQQCQPPPKCTPKCPPKCTPKCPPKCPPKCPPQCSAPCPPPVSSCCGSSSGGCCSSEGGGCCLSHHRPRQSLRRRPQSSSCCGSGSGQQSGGSSCCHSSGGSGCCHSSGGCC

SEQ ID NO: 45064 - protein, 80 aa, Homo sapiens
  Payload ID: 9191
  Gene Symbol: LCE6A
  Gene Name: late cornified envelope 6A
  Uniprot ID: A0A183
  ENSP ID: ENSP00000411070
MSQQKQQSWKPPNVPKCSPPQRSNPCLAPYSTPCGAPHSEGCHSSSQRPEVQKPRRARQKLRCLSRGTTYHCKEEECEGD

SEQ ID NO: 45065 - protein, 98 aa, Homo sapiens
  Payload ID: 9192
  Gene Symbol: LELP1
  Gene Name: late cornified envelope-like proline-rich 1
  Uniprot ID: Q5T871
  ENSP ID: ENSP00000357736
MSSDDKSKSNDPKTEPKNCDPKCEQKCESKCQPSCLKKLLQRCFEKCPWEKCPAPPKCLPCPSQSPSSCPPQPCTKPCPPKCPSSCPHACPPPCPPPE

SEQ ID NO: 45066 - protein, 161 aa, Homo sapiens
  Payload ID: 9193
  Gene Symbol: LAMTOR1
  Gene Name: late endosomal/lysosomal adaptor, MAPK and MTOR activator 1
  Uniprot ID: Q6IAA8
  ENSP ID: ENSP00000278671
MGCCYSSENEDSDQDREERKLLLDPSSPPTKALNGAEPNYHSLPSARTDEQALLSSILAKTASNIIDVSAADSQGMEQHEYMDRARQYSTRLAVLSSSLTHWKKLPPLPSLTSQPHQVLASEPIPFSDLQQVSRIAAYAYSALSQIRVDAKEELVVQFGIP

SEQ ID NO: 45067 - protein, 79 aa, Homo sapiens
  Payload ID: 9193
  Gene Symbol: LAMTOR1
  Gene Name: late endosomal/lysosomal adaptor, MAPK and MTOR activator 1
  ENSP ID: ENSP00000438717
  MOD_RES (1)..(1): Any amino acid
XDREERKLLLDPSSPPTKALNGAEPNYHSLPSARTDEQALLSSILAKTASNIIDVSAADSQGMEQHEYMDRARQYRSPG

SEQ ID NO: 45068 - protein, 160 aa, Homo sapiens
  Payload ID: 9193
  Gene Symbol: LAMTOR1
  Gene Name: late endosomal/lysosomal adaptor, MAPK and MTOR activator 1
  ENSP ID: ENSP00000439011
MGCCYSSENEDSDQDREERKLLLDPSSPPTKALNGAEPNYHSLPSARTDEQALLSSILAKTASNIIDVSAADSQGMEQHEYMDRARQYSTRLAVLSSSLTHWKKLPPLPSLTSQPHQVLASEPIPFSDLQQVRHPSPAPAHPSHTAQGMAEGSPTLPQRR

SEQ ID NO: 45069 - protein, 76 aa, Homo sapiens
  Payload ID: 9193
  Gene Symbol: LAMTOR1
  Gene Name: late endosomal/lysosomal adaptor, MAPK and MTOR activator 1
  ENSP ID: ENSP00000439482
MGCCWTLAAPLPKLSMEPSPTTTACLPLALMSRPCSLPSLPRQPATSLMCLLQTHRAWSSMSTWTVPGSTAPAWLC

SEQ ID NO: 45070 - protein, 142 aa, Homo sapiens
  Payload ID: 9193
  Gene Symbol: LAMTOR1
  Gene Name: late endosomal/lysosomal adaptor, MAPK and MTOR activator 1
  ENSP ID: ENSP00000440738
MGCCYSSENEDSDQDREERKLLLDPSSPPTKALNGAEPNYHSLPSARTDEQALLSSILAKTASNIIDVSAADSQGMEQHEYMDRARQYSTRLAVLSSSLTHWKKLPPLPSLTSQPHQVLASEPIPFSDLQQVQLFQSTPCSQ

SEQ ID NO: 45071 - protein, 99 aa, Homo sapiens
  Payload ID: 9193
  Gene Symbol: LAMTOR1
  Gene Name: late endosomal/lysosomal adaptor, MAPK and MTOR activator 1
  ENSP ID: ENSP00000445170
MGCCYSSENEDSDQDREERKLLLDPSSPPTKALNGAEPNYHSLPSARTDEQALLSSILAKTASNIIDVSAADSQGMEQHEYMDRARQYRHTGHHTEKEL

SEQ ID NO: 45072 - protein, 150 aa, Homo sapiens
  Payload ID: 9194
  Gene Symbol: LAMTOR2
  Gene Name: late endosomal/lysosomal adaptor, MAPK and MTOR activator 2
  Uniprot ID: Q9Y2Q5
  ENSP ID: ENSP00000357285
MLRPKALTQVLSQANTGGVQSTLLLNNEGSLLAYSGYGDTDARVTAAIASNIWAAYDRNGNQAFNEDNLKFILMDCMEGRVAITRVANLLLCMYAKETVGFGMLKAKAVCGTDLCSPSAGPGFGAVPGGAPHPSGGILTALVEAGVRKEK

SEQ ID NO: 45073 - protein, 95 aa, Homo sapiens
  Payload ID: 9194
  Gene Symbol: LAMTOR2
  Gene Name: late endosomal/lysosomal adaptor, MAPK and MTOR activator 2
  Uniprot ID: Q9Y2Q5
  ENSP ID: ENSP00000357287
MLRPKALTQVLSQANTGGVQSTLLLNNEGSLLAYSGYGDTDARVTAAIASNIWAAYDRNGNQAFNEDNLKFILMDCMAQALVQYLEEPLTQVAAS

SEQ ID NO: 45074 - protein, 125 aa, Homo sapiens
  Payload ID: 9194
  Gene Symbol: LAMTOR2
  Gene Name: late endosomal/lysosomal adaptor, MAPK and MTOR activator 2
  Uniprot ID: Q9Y2Q5
  ENSP ID: ENSP00000357288
MLRPKALTQVLSQANTGGVQSTLLLNNEGSLLAYSGYGDTDARVTAAIASNIWAAYDRNGNQAFNEDNLKFILMDCMEGRVAITRVANLLLCMYAKETVGFGMLKAKAQALVQYLEEPLTQVAAS

SEQ ID NO: 45075 - protein, 117 aa, Homo sapiens
  Payload ID: 9195
  Gene Symbol: LAMTOR3
  Gene Name: late endosomal/lysosomal adaptor, MAPK and MTOR activator 3
  Uniprot ID: Q9UHA4
  ENSP ID: ENSP00000226522
MADDLKRFLYKKLPSVEGLHAIVVSDRDGVPVIKEHALRPGFLSTFALATDQGSKLGLSKNKSIICYYNTYQVVQFNRLPLVVSFIASSSANTGLIVSLEKELAPLFEELRQVVEVS

SEQ ID NO: 45076 - protein, 124 aa, Homo sapiens
  Payload ID: 9195
  Gene Symbol: LAMTOR3
  Gene Name: late endosomal/lysosomal adaptor, MAPK and MTOR activator 3
  Uniprot ID: Q9UHA4
  ENSP ID: ENSP00000424183
MADDLKRFLYKKLPSVEGLHAIVVSDRDGVPVIKVANDNAPEHALRPGFLSTFALATDQGSKLGLSKNKSIICYYNTYQVVQFNRLPLVVSFIASSSANTGLIVSLEKELAPLFEELRQVVEVS

SEQ ID NO: 45077 - protein, 99 aa, Homo sapiens
  Payload ID: 9196
  Gene Symbol: LAMTOR4
  Gene Name: late endosomal/lysosomal adaptor, MAPK and MTOR activator 4
  Uniprot ID: Q0VGL1
  ENSP ID: ENSP00000343118
MTSALTQGLERIPDQLGYLVLSEGAVLASSGDLENDEQAASAISELVSTACGFRLHRGMNVPFKRLSVVFGEHTLLVTVSGQRVFVVKRQNRGREPIDV

SEQ ID NO: 45078 - protein, 137 aa, Homo sapiens
  Payload ID: 9196
  Gene Symbol: LAMTOR4
  Gene Name: late endosomal/lysosomal adaptor, MAPK and MTOR activator 4
  ENSP ID: ENSP00000387926
MTSALTQGLERIPDQLGYLVLSEGAVLASSGDLENDEQAASAISELVSTACGFRLHRGMNVPFKRLSGEPLPLPLVVVLGAGGYFQGLLGFSSSSLLPSPGVSGLATFLPLGLPGIRIVNEKARERRSSRGHSSSNL

SEQ ID NO: 45079 - protein, 72 aa, Homo sapiens
  Payload ID: 9196
  Gene Symbol: LAMTOR4
  Gene Name: late endosomal/lysosomal adaptor, MAPK and MTOR activator 4
  ENSP ID: ENSP00000477680
MSSGDLENDEQAASAISELVSTACGFRLHRGMNVPFKRLSVVFGEHTLLVTVSGQRVFVVKRQNRGREPIDV

SEQ ID NO: 45080 - protein, 41 aa, Homo sapiens
  Payload ID: 9196
  Gene Symbol: LAMTOR4
  Gene Name: late endosomal/lysosomal adaptor, MAPK and MTOR activator 4
  ENSP ID: ENSP00000478095
MNVPFKRLSVVFGEHTLLVTVSGQRVFVVKRQNRGREPIDV

SEQ ID NO: 45081 - protein, 82 aa, Homo sapiens
  Payload ID: 9196
  Gene Symbol: LAMTOR4
  Gene Name: late endosomal/lysosomal adaptor, MAPK and MTOR activator 4
  ENSP ID: ENSP00000479176
MTSALTQGLERIPDQLGYLVLSEGAVLASSGDLENDEQAASAISELVSTACGFRLHRGMNVPFKRLSGVSLLQWSLENTHCW

SEQ ID NO: 45082 - protein, 24 aa, Homo sapiens
  Payload ID: 9196
  Gene Symbol: LAMTOR4
  Gene Name: late endosomal/lysosomal adaptor, MAPK and MTOR activator 4
  ENSP ID: ENSP00000479500
MNVPFKRLSGVSLLQWSLENTHCW

SEQ ID NO: 45083 - protein, 41 aa, Homo sapiens; identical to SEQ ID NO: 45080
  Payload ID: 9196
  Gene Symbol: LAMTOR4
  Gene Name: late endosomal/lysosomal adaptor, MAPK and MTOR activator 4
  ENSP ID: ENSP00000479685

SEQ ID NO: 45084 - protein, 20 aa, Homo sapiens
  Payload ID: 9196
  Gene Symbol: LAMTOR4
  Gene Name: late endosomal/lysosomal adaptor, MAPK and MTOR activator 4
  ENSP ID: ENSP00000480432
MNVPFKRLSVVFGEHTLLVT

SEQ ID NO: 45085 - protein, 19 aa, Homo sapiens
  Payload ID: 9196
  Gene Symbol: LAMTOR4
  Gene Name: late endosomal/lysosomal adaptor, MAPK and MTOR activator 4
  ENSP ID: ENSP00000481202
  MOD_RES (1)..(1): Any amino acid
XGMNVPFKRLSAFYFIPKI

SEQ ID NO: 45086 - protein, 173 aa, Homo sapiens
  Payload ID: 9197
  Gene Symbol: LAMTOR5
  Gene Name: late endosomal/lysosomal adaptor, MAPK and MTOR activator 5
  ENSP ID: ENSP00000256644
MEPGAGHLDGHRAGSPSLRQALCDGSAVMFSSKERGRCTVINFVPLEAPLRSTPRSRQVTEACGGEGRAVPLGSEPEWSVGGMEATLEQHLEDTMKNPSIVGVLCTDSQGLNLGCRGTLSDEHAGVISVLAQQAAKLTSDPTDIPVVCLESDNGNIMIQKHDGITVAVHKMAS

SEQ ID NO: 45087 - protein, 90 aa, Homo sapiens
  Payload ID: 9197
  Gene Symbol: LAMTOR5
  Gene Name: late endosomal/lysosomal adaptor, MAPK and MTOR activator 5
  ENSP ID: ENSP00000434828
MSLSFHLPSRRMKNPSIVGVLCTDSQGLNLGCRGTLSDEHAGVISVLAQQAAKLTSDPTDIPVVCLESDNGNIMIQKHDGITVAVHKMAS

SEQ ID NO: 45088 - protein, 90 aa, Homo sapiens; identical to SEQ ID NO: 45087
  Payload ID: 9197
  Gene Symbol: LAMTOR5
  Gene Name: late endosomal/lysosomal adaptor, MAPK and MTOR activator 5
  ENSP ID: ENSP00000435085

SEQ ID NO: 45089 - protein, 79 aa, Homo sapiens [sequence omitted]

SEQ ID NO: 45090 - protein, 91 aa, Homo sapiens
  Payload ID: 9197
  Gene Symbol: LAMTOR5
  Gene Name: late endosomal/lysosomal adaptor, MAPK and MTOR activator 5
  Uniprot ID: O43504
  ENSP ID: ENSP00000473439
MEATLEQHLEDTMKNPSIVGVLCTDSQGLNLGCRGTLSDEHAGVISVLAQQAAKLTSDPTDIPVVCLESDNGNIMIQKHDGITVAVHKMAS

SEQ ID NO: 45091 - protein, 173 aa, Homo sapiens; identical to SEQ ID NO: 45086
  Payload ID: 9197
  Gene Symbol: LAMTOR5
  Gene Name: late endosomal/lysosomal adaptor, MAPK and MTOR activator 5
  ENSP ID: ENSP00000480529

SEQ ID NO: 45092 - protein, 1395 aa, Homo sapiens
  Payload ID: 9198
  Gene Symbol: LTBP1
  Gene Name: latent transforming growth factor beta binding protein 1
  Uniprot ID: Q14766
  ENSP ID: ENSP00000384091
MDTKLMCLLFFFSLPPLLVSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDLDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 45093 - protein, 1340 aa, Homo sapiens
  Payload ID: 9198
  Gene Symbol: LTBP1
  Gene Name: latent transforming growth factor beta binding protein 1
  ENSP ID: ENSP00000384373
MDTKLMCLLFFFSLPPLLVSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 45094 - protein, 1342 aa, Homo sapiens
  Payload ID: 9198
  Gene Symbol: LTBP1
  Gene Name: latent transforming growth factor beta binding protein 1
  Uniprot ID: Q14766
  ENSP ID: ENSP00000385359
MDTKLMCLLFFFSLPPLLVSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDLDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 45095 - protein, 1721 aa, Homo sapiens
  Payload ID: 9198
  Gene Symbol: LTBP1
  Gene Name: latent transforming growth factor beta binding protein 1
  Uniprot ID: Q14766
  ENSP ID: ENSP00000386043
MAGAWLRWGLLLWAGLLASSAHGRLRRITYVVHPGPGLAAGALPLSGPPRSRTFNVALNARYSRSSAAAGAPSRASPGVPSERTRRTSKPGGAALQGLRPPPPPPPEPARPAVPGGQLHPNPGGHPAAAPFTKQGRQVVRSKVPQETQSGGGSRLQVHQKQQLQGVNVCGGRCCHGWSKAPGSQRCTKPSCVPPCQNGGMCLRPQLCVCKPGTKGKACETIAAQDTSSPVFGGQSPGAASSWGPPEQAAKHTSSKKADTLPRVSPVAQMTLTLKPKPSVGLPQQIHSQVTPLSSQSVVIHHGQTQEYVLKPKYFPAQKGISGEQSTEGSFPLRYVQDQVAAPFQLSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDLDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 45096 - protein, 266 aa, Homo sapiens
  Payload ID: 9198
  Gene Symbol: LTBP1
  Gene Name: latent transforming growth factor beta binding protein 1
  ENSP ID: ENSP00000388154
  MOD_RES (1)..(1): Any amino acid
XGRCEDIDECLNPSTCPDEQCVNSPGSYQCVPCTEGFRGWNGQCLDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGE

SEQ ID NO: 45097 - protein, 1353 aa, Homo sapiens
  Payload ID: 9198
  Gene Symbol: LTBP1
  Gene Name: latent transforming growth factor beta binding protein 1
  ENSP ID: ENSP00000393057
MDTKLMCLLFFFSLPPLLVSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDVNECELLSGVCGEAFCENVEGSFLCVCADENQEYSPMTGQCRSRTSTDLDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 45098 - protein, 270 aa, Homo sapiens
  Payload ID: 9198
  Gene Symbol: LTBP1
  Gene Name: latent transforming growth factor beta binding protein 1
  ENSP ID: ENSP00000395211
ECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDVNECELLSGVCGEAFCENVEGSFLCVCADENQEYSPMTGQCRSRTSTDLDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQE

SEQ ID NO: 45099 - protein, 101 aa, Homo sapiens
  Payload ID: 9198
  Gene Symbol: LTBP1
  Gene Name: latent transforming growth factor beta binding protein 1
  ENSP ID: ENSP00000405993
MNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTG

SEQ ID NO: 45100 - protein, 219 aa, Homo sapiens
  Payload ID: 9198
  Gene Symbol: LTBP1
  Gene Name: latent transforming growth factor beta binding protein 1
  ENSP ID: ENSP00000415412
MGSYRCTCKIGFGPDPTFSSCVPDPPVISEEKGPCYRLVSSGRQCMHPLSVHLTKQLCCCSVGKAWGPHCEKCPLPGTGKGPVFVKPKNTQPVAKSTHPPPLPAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCIN

SEQ ID NO: 45101 - protein, 220 aa, Homo sapiens
  Payload ID: 9198
  Gene Symbol: LTBP1
  Gene Name: latent transforming growth factor beta binding protein 1
  ENSP ID: ENSP00000417591
SSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPGIVIEKTSPPVPVEVAPEASTSSASQVIAPTQVTEINECTVNPDICGAGHCINLPVRYTCICYE

SEQ ID NO: 45102 - protein, 1821 aa, Homo sapiens
  Payload ID: 9199
  Gene Symbol: LTBP2
  Gene Name: latent transforming growth factor beta binding protein 2
  Uniprot ID: Q14767
  ENSP ID: ENSP00000261978
MRPRTKARSPGRALRNPWRGFLPLTLALFVGAGHAQRDPVGRYEPAGGDANRLRRPGGSYPAAAAAKVYSLFREQDAPVAGLQPVERAQPGWGSPRRPTEAEARRPSRAQQSRRVQPPAQTRRSTPLGQQQPAPRTRAAPALPRLGTPQRSGAAPPTPPRGRLTGRNVCGGQCCPGWTTANSTNHCIKPVCEPPCQNRGSCSRPQLCVCRSGFRGARCEEVIPDEEFDPQNSRLAPRRWAERSPNLRRSSAAGEGTLARAQPPAPQSPPAPQSPPAGTLSGLSQTHPSQQHVGLSRTVRLHPTATASSQLSSNALPPGPGLEQRDGTQQAVPLEHPSSPWGLNLTEKIKKIKIVFTPTICKQTCARGHCANSCERGDTTTLYSQGGHGHDPKSGFRIYFCQIPCLNGGRCIGRDECWCPANSTGKFCHLPIPQPDREPPGRGSRPRALLEAPLKQSTFTLPLSNQLASVNPSLVKVHIHHPPEASVQIHQVAQVRGGVEEALVENSVETRPPPWLPASPGHSLWDSNNIPARSGEPPRPLPPAAPRPRGLLGRCYLNTVNGQCANPLLELTTQEDCCGSVGAFWGVTLCAPCPPRPASPVIENGQLECPQGYKRLNLTHCQDINECLTLGLCKDAECVNTRGSYLCTCRPGLMLDPSRSRCVSDKAISMLQGLCYRSLGPGTCTLPLAQRITKQICCCSRVGKAWGSECEKCPLPGTEAFREICPAGHGYTYASSDIRLSMRKAEEEELARPPREQGQRSSGALPGPAERQPLRVVTDTWLEAGTIPDKGDSQAGQVTTSVTHAPAWVTGNATTPPMPEQGIAEIQEEQVTPSTDVLVTLSTPGIDRCAAGATNVCGPGTCVNLPDGYRCVCSPGYQLHPSQAYCTDDNECLRDPCKGKGRCINRVGSYSCFCYPGYTLATSGATQECQDINECEQPGVCSGGQCTNTEGSYHCECDQGYIMVRKGHCQDINECRHPGTCPDGRCVNSPGSYTCLACEEGYRGQSGSCVDVNECLTPGVCAHGKCTNLEGSFRCSCEQGYEVTSDEKGCQDVDECASRASCPTGLCLNTEGSFACSACENGYWVNEDGTACEDLDECAFPGVCPSGVCTNTAGSFSCKDCDGGYRPSPLGDSCEDVDECEDPQSSCLGGECKNTVGSYQCLCPQGFQLANGTVCEDVNECMGEEHCAPHGECLNSHGSFFCLCAPGFVSAEGGTSCQDVDECATTDPCVGGHCVNTEGSFNCLCETGFQPSPESGECVDIDECEDYGDPVCGTWKCENSPGSYRCVLGCQPGFHMAPNGDCIDIDECANDTMCGSHGFCDNTDGSFRCLCDQGFEISPSGWDCVDVNECELMLAVCGAALCENVEGSFLCLCASDLEEYDAQEGHCRPRGAGGQSMSEAPTGDHAPAPTRMDCYSGQKGHAPCSSVLGRNTTQAECCCTQGASWGDACDLCPSEDSAEFSEICPSGKGYIPVEGAWTFGQTMYTDADECVIFGPGLCPNGRCLNTVPGYVCLCNPGFHYDASHKKCEDHDECQDLACENGECVNTEGSFHCFCSPPLTLDLSQQRCMNSTSSTEDLPDHDIHMDICWKKVTNDVCSEPLRGHRTTYTECCCQDGEAWSQQCALCPPRSSEVYAQLCNVARIEAEREAGVHFRPGYEYGPGPDDLHYSIYGPDGAPFYNYLGPEDTVPEPAFPNTAGHSADRTPILESPLQPSELQPHYVASHPEPPAGFEGLQAEECGILNGCENGRCVRVREGYTCDCFEGFQLDAAHMACVDVNECDDLNGPAVLCVHGYCENTEGSYRCHCSPGYVAEAGPPHCTAKE

SEQ ID NO: 45103 - protein, 233 aa, Homo sapiens
  Payload ID: 9199
  Gene Symbol: LTBP2
  Gene Name: latent transforming growth factor beta binding protein 2
  ENSP ID: ENSP00000450668
  MOD_RES (1)..(1): Any amino acid
XTEGSFACSACENGYWVNEDGTACEDLDECAFPGVCPSGVCTNTAGSFSCKDCDGGYRPSPLGDSCEDVDECEDPQSSCLGGECKNTVGSYQCLCPQGFQLANGTVCEDVNECMGEEHCAPHGECLNSHGSFFCLCAPGFVSAEGGTSCQDIDECEDYGDPVCGTWKCENSPGSYRCVLGCQPGFHMAPNGDCIDIDECANDTMCGSHGFCDNTDGSFRCLCDQGFEISPSGW

SEQ ID NO: 45104 - protein, 1777 aa, Homo sapiens
  Payload ID: 9199
  Gene Symbol: LTBP2
  Gene Name: latent transforming growth factor beta binding protein 2
  ENSP ID: ENSP00000451477
MRPRTKARSPGRALRNPWRGFLPLTLALFVGAGHAQRDPVGRYEPAGGDANRLRRPGGSYPAAAAAKVYSLFREQDAPVAGLQPVERAQPGWGSPRRPTEAEARRPSRAQQSRRVQPPAQTRRSTPLGQQQPAPRTRAAPALPRLGTPQRSGAAPPTPPRGRLTGRNVCGGQCCPGWTTANSTNHCIKPVCEPPCQNRGSCSRPQLCVCRSGFRGARCEEVIPDEEFDPQNSRLAPRRWAERSPNLRRSSAAGEGTLARAQPPAPQSPPAPQSPPAGTLSGLSQTHPSQQHVGLSRTVRLHPTATASSQLSSNALPPGPGLEQRDGTQQAVPLEHPSSPWGLNLTEKIKKIKIVFTPTICKQTCARGHCANSCERGDTTTLYSQGGHGHDPKSGFRIYFCQIPCLNGGRCIGRDECWCPANSTGKFCHLPIPQPDREPPGRGSRPRALLEAPLKQSTFTLPLSNQLASVNPSLVKVHIHHPPEASVQIHQVAQVRGGVEEALVENSVETRPPPWLPASPGHSLWDSNNIPARSGEPPRPLPPAAPRPRGLLGRCYLNTVNGQCANPLLELTTQEDCCGSVGAFWGVTLCAPCPPRPASPVIENGQLECPQGYKRLNLTHCQDINECLTLGLCKDAECVNTRGSYLCTCRPGLMLDPSRSRCVSDKAISMLQGLCYRSLGPGTCTLPLAQRITKQICCCSRVGKAWGSECEKCPLPGTEAFREICPAGHGYTYASSDIRLSMRKAEEEELARPPREQGQRSSGALPGPAERQPLRVVTDTWLEAGTIPDKGDSQAGQVTTSVTHAPAWVTGNATTPPMPEQGIAEIQEEQVTPSTDVLVTLSTPGIDRCAAGATNVCGPGTCVNLPDGYRCVCSPGYQLHPSQAYCTDDNECLRDPCKGKGRCINRVGSYSCFCYPGYTLATSGATQECQDINECEQPGVCSGGQCTNTEGSYHCECDQGYIMVRKGHCQDINECRHPGTCPDGRCVNSPGSYTCLACEEGYRGQSGSCVDVNECLTPGVCAHGKCTNLEGSFRCSCEQGYEVTSDEKGCQDVDECASRASCPTGLCLNTEGSFACSACENGYWVNEDGTACEDLDECAFPGVCPSGVCTNTAGSFSCKDCDGGYRPSPLGDSCEDVDECEDPQSSCLGGECKNTVGSYQCLCPQGFQLANGTVCEDVNECMGEEHCAPHGECLNSHGSFFCLCAPGFVSAEGGTSCQDVDECATTDPCVGGHCVNTEGSFNCLCETGFQPSPESGECVDIDECANDTMCGSHGFCDNTDGSFRCLCDQGFEISPSGWDCVDVNECELMLAVCGAALCENVEGSFLCLCASDLEEYDAQEGHCRPRGAGGQSMSEAPTGDHAPAPTRMDCYSGQKGHAPCSSVLGRNTTQAECCCTQGASWGDACDLCPSEDSAEFSEICPSGKGYIPVEGAWTFGQTMYTDADECVIFGPGLCPNGRCLNTVPGYVCLCNPGFHYDASHKKCEDHDECQDLACENGECVNTEGSFHCFCSPPLTLDLSQQRCMNSTSSTEDLPDHDIHMDICWKKVTNDVCSEPLRGHRTTYTECCCQDGEAWSQQCALCPPRSSEVYAQLCNVARIEAEREAGVHFRPGYEYGPGPDDLHYSIYGPDGAPFYNYLGPEDTVPEPAFPNTAGHSADRTPILESPLQPSELQPHYVASHPEPPAGFEGLQAEECGILNGCENGRCVRVREGYTCDCFEGFQLDAAHMACVDVNECDDLNGPAVLCVHGYCENTEGSYRCHCSPGYVAEAGPPHCTAKE

SEQ ID NO: 45105 - protein, 1769 aa, Homo sapiens
  Payload ID: 9199
  Gene Symbol: LTBP2
  Gene Name: latent transforming growth factor beta binding protein 2
  ENSP ID: ENSP00000452110
MRPRTKARSPGRALRNPWRGFLPLTLALFVGAGHAQRDPVGRYEPAGGDANRLRRPGGSYPAAAAAKVYSLFREQDAPVAGLQPVERAQPGWGSPRRPTEAEARRPSRAQQSRRVQPPAQTRRSTPLGQQQPAPRTRAAPALPRLGTPQRSGAAPPTPPRGRLTGRNVCGGQCCPGWTTANSTNHCIKPVCEPPCQNRGSCSRPQLCVCRSGFRGARCEEVIPDEEFDPQNSRLAPRRWAERSPNLRRSSAAGEGTLARAQPPAPQSPPAPQSPPAGTLSGLSQTHPSQQHVGLSRTVRLHPTATASSQLSSNALPPGPGLEQRDGTQQAVPLEHPSSPWGLNLTEKIKKIKIVFTPTICKQTCARGHCANSCERGDTTTLYSQGGHGHDPKSGFRIYFCQIPCLNGGRCIGRDECWCPANSTGKFCHLPIPQPDREPPGRGSRPRALLEAPLKQSTFTLPLSNQLASVNPSLVKVHIHHPPEASVQIHQVAQVRGGVEEALVENSVETRPPPWLPASPGHSLWDSNNIPARSGEPPRPLPPAAPRPRGLLGRCYLNTVNGQCANPLLELTTQEDCCGSVGAFWGVTLCAPCPPRPASPVIENGQLECPQGYKRLNLTHCQDINECLTLGLCKDAECVNTRGSYLCTCRPGLMLDPSRSRCVSDKAISMLQGLCYRSLGPGTCTLPLAQRITKQICCCSRVGKAWGSECEKCPLPGTEAFREICPAGHGYTYASSDIRLSMRKAEEEELARPPREQGQRSSGALPGPAERQPLRVVTDTWLEAGTIPDKGDSQAGQVTTSVTHAPAWVTGNATTPPMPEQGIAEIQEEQVTPSTDVLVTLSTPGIDRCAAGATNVCGPGTCVNLPDGYRCVCSPGYQLHPSQAYCTDDNECLRDPCKGKGRCINRVGSYSCFCYPGYTLATSGATQECQDINECEQPGVCSGGQCTNTEGSYHCECDQGYIMVRKGHCQDINECRHPGTCPDGRCVNSPGSYTCLACEEGYRGQSGSCVDVNECLTPGVCAHGKCTNLEGSFRCSCEQGYEVTSDEKGCQDVDECASRASCPTGLCLNTEGSFACSACENGYWVNEDGTACEDLDECAFPGVCPSGVCTNTAGSFSCKDCDGGYRPSPLGDSCEDVDECEDPQSSCLGGECKNTVGSYQCLCPQGFQLANGTVCEDVNECMGEEHCAPHGECLNSHGSFFCLCAPGFVSAEGGTSCQDVDECATTDPCVGGHCVNTEGSFNCLCETGFQPSPESGECVDIDECEDYGDPVCGTWKCENSPGSYRCVLGCQPGFHMAPNGDCIDIDECANDTMCGSHGFCDNTDGSFRCLCDQGFEISPSGWDCVDVNECELMLAVCGAALCENVEGSFLCLCASDLEEYDAQEGHCRPRGAGGQSMSEAPTGDHAPAPTRMDCYSGQKGHAPCSSVLGRNTTQAECCCTQGASWGDACDLCPSEDSAEFSEICPSGKGYIPVEGAWTFGQTMYTDADECVIFGPGLCPNGRCLNTVPGYVCLCNPGFHYDASHKKCEDHDECQDLACENGECVNTEGSFHCFCSPPLTLDLSQQRCMNSTSSTEDLPDHDIHMDICWKKVTNDVCSEPLRGHRTTYTECCCQDGEAWSQQCALCPPRSSEVYAQLCNVARIEAEREAGVHFRPGYEYGPGPDDLHYSIYGPDGAPFYNYLGPEDTVPEPAFPNTAGHSADRTPILESPLQPSELQPHYVASHPGLCCCKTGEEVGTKAVSLPSPPPASHIASRSPQPASKGFRRRSAAS

SEQ ID NO: 45106 - protein, 1303 aa, Homo sapiens
  Payload ID: 9200
  Gene Symbol: LTBP3
  Gene Name: latent transforming growth factor beta binding protein 3
  Uniprot ID: Q9NS15
  ENSP ID: ENSP00000301873
MPGPRGAAGGLAPEMRGAGAAGLLALLLLLLLLLLGLGGRVEGGPAGERGAGGGGALARERFKVVFAPVICKRTCLKGQCRDSCQQGSNMTLIGENGHSTDTLTGSGFRVVVCPLPCMNGGQCSSRNQCLCPPDFTGRFCQVPAGGAGGGTGGSGPGLSRTGALSTGALPPLAPEGDSVASKHAIYAVQVIADPPGPGEGPPAQHAAFLVPLGPGQISAEVQAPPPVVNVRVHHPPEASVQVHRIESSNAESAAPSQHLLPHPKPSHPRPPTQKPLGRCFQDTLPKQPCGSNPLPGLTKQEDCCGSIGTAWGQSKCHKCPQLQYTGVQKPGPVRGEVGADCPQGYKRLNSTHCQDINECAMPGVCRHGDCLNNPGSYRCVCPPGHSLGPSRTQCIADKPEEKSLCFRLVSPEHQCQHPLTTRLTRQLCCCSVGKAWGARCQRCPTDGTAAFKEICPAGKGYHILTSHQTLTIQGESDFSLFLHPDGPPKPQQLPESPSQAPPPEDTEEERGVTTDSPVSEERSVQQSHPTATTTPARPYPELISRPSPPTMRWFLPDLPPSRSAVEIAPTQVTETDECRLNQNICGHGECVPGPPDYSCHCNPGYRSHPQHRYCVDVNECEAEPCGPGRGICMNTGGSYNCHCNRGYRLHVGAGGRSCVDLNECAKPHLCGDGGFCINFPGHYKCNCYPGYRLKASRPPVCEDIDECRDPSSCPDGKCENKPGSFKCIACQPGYRSQGGGACRDVNECAEGSPCSPGWCENLPGSFRCTCAQGYAPAPDGRSCLDVDECEAGDVCDNGICSNTPGSFQCQCLSGYHLSRDRSHCEDIDECDFPAACIGGDCINTNGSYRCLCPQGHRLVGGRKCQDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMDVDECQDPAACRPGRCVNLPGSYRCECRPPWVPGPSGRDCQLPESPAERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKAGFARSRPHGACVPQRRR

SEQ ID NO: 45107 - protein, 1256 aa, Homo sapiens
  Payload ID: 9200
  Gene Symbol: LTBP3
  Gene Name: latent transforming growth factor beta binding protein 3
  Uniprot ID: Q9NS15
  ENSP ID: ENSP00000326647
MPGPRGAAGGLAPEMRGAGAAGLLALLLLLLLLLLGLGGRVEGGPAGERGAGGGGALARERFKVVFAPVICKRTCLKGQCRDSCQQGSNMTLIGENGHSTDTLTGSGFRVVVCPLPCMNGGQCSSRNQCLCPPDFTGRFCQVPAGGAGGGTGGSGPGLSRTGALSTGALPPLAPEGDSVASKHAIYAVQVIADPPGPGEGPPAQHAAFLVPLGPGQISAEVQAPPPVVNVRVHHPPEASVQVHRIESSNAESAAPSQHLLPHPKPSHPRPPTQKPLGRCFQDTLPKQPCGSNPLPGLTKQEDCCGSIGTAWGQSKCHKCPQLQYTGVQKPGPVRGEVGADCPQGYKRLNSTHCQDINECAMPGVCRHGDCLNNPGSYRCVCPPGHSLGPSRTQCIADKPEEKSLCFRLVSPEHQCQHPLTTRLTRQLCCCSVGKAWGARCQRCPTDGTAAFKEICPAGKGYHILTSHQTLTIQGESDFSLFLHPDGPPKPQQLPESPSQAPPPEDTEEERGVTTDSPVSEERSVQQSHPTATTTPARPYPELISRPSPPTMRWFLPDLPPSRSAVEIAPTQVTETDECRLNQNICGHGECVPGPPDYSCHCNPGYRSHPQHRYCVDVNECEAEPCGPGRGICMNTGGSYNCHCNRGYRLHVGAGGRSCVDLNECAKPHLCGDGGFCINFPGHYKCNCYPGYRLKASRPPVCEDIDECRDPSSCPDGKCENKPGSFKCIACQPGYRSQGGGACRDVNECAEGSPCSPGWCENLPGSFRCTCAQGYAPAPDGRSCLDVDECEAGDVCDNGICSNTPGSFQCQCLSGYHLSRDRSHCEDIDECDFPAACIGGDCINTNGSYRCLCPQGHRLVGGRKCQDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKAGFARSRPHGACVPQRRR

SEQ ID NO: 45108 - protein, 907 aa, Homo sapiens
  Payload ID: 9200
  Gene Symbol: LTBP3
  Gene Name: latent transforming growth factor beta binding protein 3
  ENSP ID: ENSP00000431219
  MOD_RES (1)..(1): Any amino acid
XFAPVICKRTCLKGQCRDSCQQGSNMTLIGENGHSTDTLTGSGFRVADKPEEKSLCFRLVSPEHQCQHPLTTRLTRQLCCCSVGKAWGARCQRCPTDGTAAFKEICPAGKGYHILTSHQTLTIQGESDFSLFLHPDGPPKPQQLPESPSQAPPPEDTEEERGVTTDSPVSEERSVQQSHPTATTTPARPYPELISRPSPPTMRWFLPDLPPSRSAVEIAPTQVTETDECRLNQNICGHGECVPGPPDYSCHCNPGYRSHPQHRYCVDVNECEAEPCGPGRGICMNTGGSYNCHCNRGYRLHVGAGGRSCVDLNECAKPHLCGDGGFCINFPGHYKCNCYPGYRLKASRPPVCEDIDECRDPSSCPDGKCENKPGSFKCIACQPGYRSQGGGACRDVNECAEGSPCSPGWCENLPGSFRCTCAQGYAPAPDGRSCLDVDECEAGDVCDNGICSNTPGSFQCQCLSGYHLSRDRSHCEDIDECDFPAACIGGDCINTNGSYRCLCPQGHRLVGGRKCQDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKAGFARSRPHGACVPQRRR

SEQ ID NO: 45109 - protein, 140 aa, Homo sapiens
  Payload ID: 9200
  Gene Symbol: LTBP3
  Gene Name: latent transforming growth factor beta binding protein 3
  ENSP ID: ENSP00000432121
LNECAKPHLCGDGGFCINFPGHYKCNCYPGYRLKASRPPVCEDIDECRDPSSCPDGKCENKPGSFKCIACQPGYRSQGGGACRDVNECAEGSPCSPGWCENLPGSFRCTCAQGYAPAPDGRSCLGERQHPRPGPPPPPTR

SEQ ID NO: 45110 - protein, 116 aa, Homo sapiens
  Payload ID: 9200
  Gene Symbol: LTBP3
  Gene Name: latent transforming growth factor beta binding protein 3
  ENSP ID: ENSP00000432350
MPGPRGAAGGLAPEMRGAGAAGLLALLLLLLLLLLGLGGRVEGGPAGERGAGGGGALARERFKVVFAPVICKRTCLKGQCRDSCQQGSNMTLIGENGHSTDTLTGSGFRWCALSPA

SEQ ID NO: 45111 - protein, 143 aa, Homo sapiens
  Payload ID: 9200
  Gene Symbol: LTBP3
  Gene Name: latent transforming growth factor beta binding protein 3
  ENSP ID: ENSP00000432476
FQDTLPKQPCGSNPLPGLTKQEDCCGSIGTAWGQSKCHKCPQLQYTGVQKPGPVRGEVGADCPQGYKRLNSTHCQADKPEEKSLCFRLVSPEHQCQHPLTTRLTRQLCCCSVGKAWGARCQRCPTDGTAAFKEICPAGKGYHI

SEQ ID NO: 45112 - protein, 306 aa, Homo sapiens
  Payload ID: 9200
  Gene Symbol: LTBP3
  Gene Name: latent transforming growth factor beta binding protein 3
  ENSP ID: ENSP00000434315
MLFGSEICKEGKCVNTQPGYECYCKQGFYYDGNLLECVDVDECLDESNCRNGVCENTRGGYRCACTPPAEYSPAQRQCLSPEEMDVDECQDPAACRPGRCVNLPGSYRCECRPPWVPGPSGRDCQLPESPAERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKAGFARSRPHGACVPQRRR

SEQ ID NO: 45113 - protein, 259 aa, Homo sapiens
  Payload ID: 9200
  Gene Symbol: LTBP3
  Gene Name: latent transforming growth factor beta binding protein 3
  ENSP ID: ENSP00000434406
MLFGSEICKEGKCVNTQPGYECYCKQGFYYDGNLLECVDVDECLDESNCRNGVCENTRGGYRCACTPPAEYSPAQRQCLSPEEMERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKAGFARSRPHGACVPQRRR

SEQ ID NO: 45114 - protein, 69 aa, Homo sapiens
  Payload ID: 9200
  Gene Symbol: LTBP3
  Gene Name: latent transforming growth factor beta binding protein 3
  ENSP ID: ENSP00000435146
  MOD_RES (1)..(1): Any amino acid
XFAPVICKRTCLKGQCRDSCQQGSNMTLIGENGHSTDTLTGSGFRVGPAPRGECARPSPARGLSPGAPH

SEQ ID NO: 45115 - protein, 1136 aa, Homo sapiens
  Payload ID: 9200
  Gene Symbol: LTBP3
  Gene Name: latent transforming growth factor beta binding protein 3
  ENSP ID: ENSP00000435276
MTLIGENGHSTDTLTGSGFRVVVCPLPCMNGGQCSSRNQCLCPPDFTGRFCQVPAGGAGGGTGGSGPGLSRTGALSTGALPPLAPEGDSVASKHAIYAVQVIADPPGPGEGPPAQHAAFLVPLGPGQISAEVQAPPPVVNVRVHHPPEASVQVHRIESSNAESAAPSQHLLPHPKPSHPRPPTQKPLGRCFQDTLPKQPCGSNPLPGLTKQEDCCGSIGTAWGQSKCHKCPQLQYTGVQKPGPVRGEVGADCPQGYKRLNSTHCQDINECAMPGVCRHGDCLNNPGSYRCVCPPGHSLGPSRTQCIADKPEEKSLCFRLVSPEHQCQHPLTTRLTRQLCCCSVGKAWGARCQRCPTDGTAAFKEICPAGKGYHILTSHQTLTIQGESDFSLFLHPDGPPKPQQLPESPSQAPPPEDTEEERGVTTDSPVSEERSVQQSHPTATTTPARPYPELISRPSPPTMRWFLPDLPPSRSAVEIAPTQVTETDECRLNQNICGHGECVPGPPDYSCHCNPGYRSHPQHRYCVDVNECEAEPCGPGRGICMNTGGSYNCHCNRGYRLHVGAGGRSCVDLNECAKPHLCGDGGFCINFPGHYKCNCYPGYRLKASRPPVCEDIDECRDPSSCPDGKCENKPGSFKCIACQPGYRSQGGGACRDVNECAEGSPCSPGWCENLPGSFRCTCAQGYAPAPDGRSCLDVDECEAGDVCDNGICSNTPGSFQCQCLSGYHLSRDRSHCEDIDECDFPAACIGGDCINTNGSYRCLCPQGHRLVGGRKCQDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMDVDECQDPAACRPGRCVNLPGSYRCECRPPWVPGPSGRDCQLPESPAERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVS

SEQ ID NO: 45116 - protein, 733 aa, Homo sapiens
  Payload ID: 9200
  Gene Symbol: LTBP3
  Gene Name: latent transforming growth factor beta binding protein 3
  ENSP ID: ENSP00000435530
MPAETDECRLNQNICGHGECVPGPPDYSCHCNPGYRSHPQHRYCVDVNECEAEPCGPGRGICMNTGGSYNCHCNRGYRLHVGAGGRSCVDLNECAKPHLCGDGGFCINFPGHYKCNCYPGYRLKASRPPVCEDIDECRDPSSCPDGKCENKPGSFKCIACQPGYRSQGGGACRDVNECAEGSPCSPGWCENLPGSFRCTCAQGYAPAPDGRSCLDVDECEAGDVCDNGICSNTPGSFQCQCLSGYHLSRDRSHCEDIDECDFPAACIGGDCINTNGSYRCLCPQGHRLVGGRKCQDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMDVDECQDPAACRPGRCVNLPGSYRCECRPPWVPGPSGRDCQLPESPAERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKAGFARSRPHGACVPQRRR

SEQ ID NO: 45117 - protein, 123 aa, Homo sapiens
  Payload ID: 9200
  Gene Symbol: LTBP3
  Gene Name: latent transforming growth factor beta binding protein 3
  ENSP ID: ENSP00000436032
MERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRA

SEQ ID NO: 45118 - protein, 221 aa, Homo sapiens
  Payload ID: 9200
  Gene Symbol: LTBP3
  Gene Name: latent transforming growth factor beta binding protein 3
  ENSP ID: ENSP00000436341
MLFGSEICKEGKCVNTQPGYECYCKQGFYYDGNLLECVDVDECLDESNCRNGVCENTRGGYRCACTPPAEYSPAQRQCLSPEEMERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRG

SEQ ID NO: 45119 - protein, 263 aa, Homo sapiens
  Payload ID: 9200
  Gene Symbol: LTBP3
  Gene Name: latent transforming growth factor beta binding protein 3
  ENSP ID: ENSP00000441912
MLFGSEICKEGKCVNTQPGYECYCKQGFYYDGNLLECVDVDECLDESNCRNGVCENTRGGYRCACTPPAEYSPAQRQCLSPEEMDVDECQDPAACRPGRCVNLPGSYRCECRPPWVPGPSGRDCQLPESPAERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSAAACRGRAAPCASVPAASSSTPPAPAAWISTSAES

SEQ ID NO: 45120 - protein, 1587 aa, Homo sapiens
  Payload ID: 9201
  Gene Symbol: LTBP4
  Gene Name: latent transforming growth factor beta binding protein 4
  ENSP ID: ENSP00000204005
MGDVKALLFVAAARARRLGGAAASESLAVSEAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVDECRNRSFCGAHAVCQNLPGSFQCLCDQGYEGARDGRHCVDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 45121 - protein, 957 aa, Homo sapiens
  Payload ID: 9201
  Gene Symbol: LTBP4
  Gene Name: latent transforming growth factor beta binding protein 4
  ENSP ID: ENSP00000243562
  MOD_RES (1)..(1): Any amino acid
XVDECRRVPPPCAPGRCENSPGSFRCVCGPGFRAGPRAAECLDVDECHRVPPPCDLGRCENTPGSFLCVCPAGYQAAPHGASCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVDECRNRSFCGAHAVCQNLPGSFQCLCDQGYEGARDGRHCVDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 45122 - protein, 1624 aa, Homo sapiens
  Payload ID: 9201
  Gene Symbol: LTBP4
  Gene Name: latent transforming growth factor beta binding protein 4
  Uniprot ID: Q8N2S1
  ENSP ID: ENSP00000311905
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVDECRNRSFCGAHAVCQNLPGSFQCLCDQGYEGARDGRHCVDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 45123 - protein, 1557 aa, Homo sapiens
  Payload ID: 9201
  Gene Symbol: LTBP4
  Gene Name: latent transforming growth factor beta binding protein 4
  Uniprot ID: Q8N2S1
  ENSP ID: ENSP00000380031
MAGGVRLLWVSLLVLLAQLGPQPGLGRLGERLRVRFTPVVCGLRCVHGPTGSRCTPTCAPRNATSVDSGAPGGAAPGGPGFRAFLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVDECRNRSFCGAHAVCQNLPGSFQCLCDQGYEGARDGRHCVDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 45124 - protein, 191 aa, Homo sapiens
  Payload ID: 9201
  Gene Symbol: LTBP4
  Gene Name: latent transforming growth factor beta binding protein 4
  ENSP ID: ENSP00000469406
  MOD_RES (1)..(1): Any amino acid
XVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVNECETLQGVCGAALCENVEGSFLCVCPNSPEEFDPMTGRCVPPRTSADVDECQLFRDQVC

SEQ ID NO: 45125 - protein, 303 aa, Homo sapiens
  Payload ID: 9201
  Gene Symbol: LTBP4
  Gene Name: latent transforming growth factor beta binding protein 4
  ENSP ID: ENSP00000469785
ECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVNECETLQGVCGAALCENVEGSFLCVCPNSPEEFDPMTGRCVPPRTSADVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQD

SEQ ID NO: 45126 - protein, 673 aa, Homo sapiens
  Payload ID: 9201
  Gene Symbol: LTBP4
  Gene Name: latent transforming growth factor beta binding protein 4
  ENSP ID: ENSP00000470824
  MOD_RES (1)..(1): Any amino acid
XNTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAE

SEQ ID NO: 45127 - protein, 224 aa, Homo sapiens
  Payload ID: 9201
  Gene Symbol: LTBP4
  Gene Name: latent transforming growth factor beta binding protein 4
  ENSP ID: ENSP00000472995
  MOD_RES (1)..(1): Any amino acid
XNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVNECETLQGVCGAALCENVEGSFLCVCPNSPEEFDPMTGRCVPPRTSAGTFPGSQPQAPASPVLPARPP

SEQ ID NO: 45128 - protein, 182 aa, Homo sapiens
  Payload ID: 9201
  Gene Symbol: LTBP4
  Gene Name: latent transforming growth factor beta binding protein 4
  ENSP ID: ENSP00000478928
  MOD_RES (1)..(1): Any amino acid
XGPEICGAQRCENTPGSYRCTPACDPGYQPTPGGGCQDVDECRNRSFCGAHAVCQNLPGSFQCLCDQGYEGARDGRHCVDVNECETLQGVCGAALCENVEGSFLCVCPNSPEEFDPMTGRCVPPRTSADVDECQLFRDQVCKSGVCVNTAPGYSCYCSNGYYYHTQRLECIDNDECADEEPA

SEQ ID NO: 45129 - protein, 94 aa, Homo sapiens
  Payload ID: 9201
  Gene Symbol: LTBP4
  Gene Name: latent transforming growth factor beta binding protein 4
  ENSP ID: ENSP00000479612
  MOD_RES (1)..(1): Any amino acid
XRFDMPDFEDDGGPYGESEAEECGILDGCTNGRCVRVPEGFTCRCFDGYRLDMTRMACVDINECDEAEAASPLCVNARCLNTDGSFRCICRPGF

SEQ ID NO: 45130 - protein, 252 aa, Homo sapiens
  Payload ID: 9201
  Gene Symbol: LTBP4
  Gene Name: latent transforming growth factor beta binding protein 4
  ENSP ID: ENSP00000479712
  MOD_RES (1)..(1): Any amino acid
XFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECRNRSFCGAHAVCQNLPGSFQCLCDQGYEGARDGRHCVDVNECETLQGVCGAALCENVEGSFLCVCPNSPEEFDPMTGRCVPPRTSAGTFPGSQPQAPAS

SEQ ID NO: 45131 - protein, 70 aa, Homo sapiens
  Payload ID: 9201
  Gene Symbol: LTBP4
  Gene Name: latent transforming growth factor beta binding protein 4
  ENSP ID: ENSP00000480629
MSARTAPFSWSGGKLRPKDQETLASGHTSWKALLFVAAARARRLGGAAASEPSAGSEAASPKSVQAPSGA

SEQ ID NO: 45132 - protein, 189 aa, Homo sapiens
  Payload ID: 9201
  Gene Symbol: LTBP4
  Gene Name: latent transforming growth factor beta binding protein 4
  ENSP ID: ENSP00000480888
  MOD_RES (1)..(1): Any amino acid
XVDECSEEDLCQSGICTNTDGSFECICPPGHRAGPDLASCLDVDECRERGPALCGSQRCENSPGSYRCVRDCDPGYHAGPEGTCDDVDECRNRSFCGAHAVCQNLPGSFQCLCDQGYEGARDGRHCVDVNECETLQGVCGAALCENVEGSFLCVCPNSPEEFDPMTGRCVPPRTSAGTFPGSQPQAPAS

SEQ ID NO: 45133 - protein, 145 aa, Homo sapiens
  Payload ID: 9201
  Gene Symbol: LTBP4
  Gene Name: latent transforming growth factor beta binding protein 4
  ENSP ID: ENSP00000481081
PPGPGTRWPYRSRDTRRSFPEPEEPPEGGSYAGSLAEPYEELEAEECGILDGCTNGRCVRVPEGFTCRCFDGYRLDMTRMACVAFSSDRCLPSADINECDEAEAASPLCVNARCLNTDGSFRCICRPGFAPTHQPHHCAPARPRA

SEQ ID NO: 45134 - protein, 44 aa, Homo sapiens
  Payload ID: 9201
  Gene Symbol: LTBP4
  Gene Name: latent transforming growth factor beta binding protein 4
  ENSP ID: ENSP00000482179
MLQPQALLFVAAARARRLGGAAASEPSAGSEAASPKSVQAPSGA

SEQ ID NO: 45135 - protein, 44 aa, Homo sapiens
  Payload ID: 9201
  Gene Symbol: LTBP4
  Gene Name: latent transforming growth factor beta binding protein 4
  ENSP ID: ENSP00000483230
MGDVKALLFVAAARARRLGGAAASEPSAGSEAASPKSVQAPSGA

SEQ ID NO: 45136 - protein, 222 aa, Homo sapiens
  Payload ID: 9202
  Gene Symbol: LXN
  Gene Name: latexin
  Uniprot ID: Q9BS40
  ENSP ID: ENSP00000264265
MEIPPTNYPASRAALVAQNYINYQQGTPHRVFEVQKVKQASMEDIPGRGHKYHLKFAVEEIIQKQVKVNCTAEVLYPSTGQETAPEVNFTFEGETGKNPDEEDNTFYQRLKSMKEPLEAQNIPDNFGNVSPEMTLVLHLAWVACGYIIWQNSTEDTWYKMVKIQTVKQVQRNDDFIELDYTILLHNIASQEIIPWQMQVLWHPQYGTKVKHNSRLPKEVQLE

SEQ ID NO: 45137 - protein, 157 aa, Homo sapiens
  Payload ID: 9202
  Gene Symbol: LXN
  Gene Name: latexin
  ENSP ID: ENSP00000419373
  MOD_RES (1)..(1): Any amino acid
XTAEVLYPSTGQETAPEVNFTFEGETGKNPDEEDNTFYQRLKSMKEPLEAQNIPDNFGNVSPEMTLVLHLAWVACGYIIWQNSTEDTWYKMVKIQTVKQVQRNDDFIELDYTILLHNIASQFHGIHDSTNSIFTFHLNTSTAIQTFSVPAFQEGKKS

SEQ ID NO: 45138 - protein, 374 aa, Homo sapiens
  Payload ID: 9203
  Gene Symbol: LAYN
  Gene Name: layilin
  Uniprot ID: Q6UX15
  ENSP ID: ENSP00000364764
MRPGTALQAVLLAVLLVGLRAATGRLLSGQPVCRGGTQRPCYKVIYFHDTSRRLNFEEAKEACRRDGGQLVSIESEDEQKLIEKFIENLLPSDGDFWIGLRRREEKQSNSTACQDLYAWTDGSISQFRNWYVDEPSCGSEVCVVMYHQPSAPAGIGGPYMFQWNDDRCNMKNNFICKYSDEKPAVPSREAEGEETELTTPVLPEETQEEDAKKTFKESREAALNLAYILIPSIPLLLLLVVTTVVCWVWICRKRKREQPDPSTKKQHTIWPSPHQGNSPDLEVYNVIRKQSEADLAETRPDLKNISFRVCSGEATPDDMSCDYDNMAVNPSESGFVTLVSVESGFVTNDIYEFSPDQMGRSKESGWVENEIYGY

SEQ ID NO: 45139 - protein, 382 aa, Homo sapiens
  Payload ID: 9203
  Gene Symbol: LAYN
  Gene Name: layilin
  Uniprot ID: Q6UX15
  ENSP ID: ENSP00000364765
MRPGTALQAVLLAVLLVGLRAATGRLLSASDLDLRGGQPVCRGGTQRPCYKVIYFHDTSRRLNFEEAKEACRRDGGQLVSIESEDEQKLIEKFIENLLPSDGDFWIGLRRREEKQSNSTACQDLYAWTDGSISQFRNWYVDEPSCGSEVCVVMYHQPSAPAGIGGPYMFQWNDDRCNMKNNFICKYSDEKPAVPSREAEGEETELTTPVLPEETQEEDAKKTFKESREAALNLAYILIPSIPLLLLLVVTTVVCWVWICRKRKREQPDPSTKKQHTIWPSPHQGNSPDLEVYNVIRKQSEADLAETRPDLKNISFRVCSGEATPDDMSCDYDNMAVNPSESGFVTLVSVESGFVTNDIYEFSPDQMGRSKESGWVENEIYGY

SEQ ID NO: 45140 - protein, 229 aa, Homo sapiens
  Payload ID: 9203
  Gene Symbol: LAYN
  Gene Name: layilin
  Uniprot ID: Q6UX15
  ENSP ID: ENSP00000392942
MVTSGLGSGGVRRNKAIAQPARTFMLGLMAAYHNLEKPAVPSREAEGEETELTTPVLPEETQEEDAKKTFKESREAALNLAYILIPSIPLLLLLVVTTVVCWVWICRKRKREQPDPSTKKQHTIWPSPHQGNSPDLEVYNVIRKQSEADLAETRPDLKNISFRVCSGEATPDDMSCDYDNMAVNPSESGFVTLVSVESGFVTNDIYEFSPDQMGRSKESGWVENEIYGY

SEQ ID NO: 45141 - protein, 109 aa, Homo sapiens
  Payload ID: 9203
  Gene Symbol: LAYN
  Gene Name: layilin
  ENSP ID: ENSP00000431627
MYHQPSAPAGIGGPYMFQWNDDRCNMKNNFICKYSDEKPAVPSREAEGEETELTTPVLPEETQEEDAKKTFKESREAALNLAYILIPSIPLLLLLVVTTVVCWVWICRK

SEQ ID NO: 45142 - protein, 49 aa, Homo sapiens
  Payload ID: 9203
  Gene Symbol: LAYN
  Gene Name: layilin
  ENSP ID: ENSP00000432434
MYHQPSAPAGIGGPYMFQWNDDRCNMKNNFICKYSDEKPAVPSREAEGE

SEQ ID NO: 45143 - protein, 134 aa, Homo sapiens
  Payload ID: 9203
  Gene Symbol: LAYN
  Gene Name: layilin
  ENSP ID: ENSP00000434300
MRPGTALQAVLLAVLLVGLRAATGRLLSGQPVCRGGTQRPCYKVIYFHDTSRRLNFEEAKEACRRDGGQLVSIESEDEQKLIEKFIENLLPSDGDFWIGLRRREEKQSNSTACQDLYAWTDGSISQFRETSSSF

SEQ ID NO: 45144 - protein, 270 aa, Homo sapiens
  Payload ID: 9203
  Gene Symbol: LAYN
  Gene Name: layilin
  ENSP ID: ENSP00000434328
MRPGTALQAVLLAVLLVGLRAATGRLLSASDLDLRGGQPVCRGGTQRPCYKVIYFHDTSRRLNFEEAKEACRRDGGQLVSIESEDEQKLIEKFIENLLPSDGDFWIGLRRREEKQSNSTACQDLYAWTDGSISQFRNWYVDEPSCGSEVCVVMYHQPSAPAGIGGPYMFQWNDDRCNMKNNFICKYSDEKPAVPSREAEGEETELTTPVLPEETQEEDAKKTFKESREAALNLAYILIPSIPLLLLLVVTTVVCWVWICRKRQKTGAARP

SEQ ID NO: 45145 - protein, 262 aa, Homo sapiens
  Payload ID: 9203
  Gene Symbol: LAYN
  Gene Name: layilin
  ENSP ID: ENSP00000434972
MRPGTALQAVLLAVLLVGLRAATGRLLSGQPVCRGGTQRPCYKVIYFHDTSRRLNFEEAKEACRRDGGQLVSIESEDEQKLIEKFIENLLPSDGDFWIGLRRREEKQSNSTACQDLYAWTDGSISQFRNWYVDEPSCGSEVCVVMYHQPSAPAGIGGPYMFQWNDDRCNMKNNFICKYSDEKPAVPSREAEGEETELTTPVLPEETQEEDAKKTFKESREAALNLAYILIPSIPLLLLLVVTTVVCWVWICRKRQKTGAARP

SEQ ID NO: 45146 - protein, 108 aa, Homo sapiens
  Payload ID: 9203
  Gene Symbol: LAYN
  Gene Name: layilin
  ENSP ID: ENSP00000486561
MVTSGLGSGGVRRNKAIAQPARTFMLGLMAAYHNLEKPAVPSREAEGEETELTTPVLPEETQEEDAKKTFKESREAALNLAYILIPSIPLLLLLVVTTVVCWVWICRK

SEQ ID NO: 45147 - protein, 263 aa, Homo sapiens
  Payload ID: 9204
  Gene Symbol: LBHD1
  Gene Name: LBH domain containing 1
  Uniprot ID: Q9BQE6
  ENSP ID: ENSP00000346600
MALVPGRSKEDGLWTRNSPGSSQHPESPRLPNPLWDRGKIGKVEGHQHIQDFSQKSHLPSIVVESSEVNEESGDLHLPHEELLLLTDGEEEDAEAFFQDQSEEPGWAWSPQDPRSPLRTFNAGLSWGQDQDEEDACWILEDTACLEATNHCPFWDSTGSRVCRSGFVEYSHLLPPNSFEGAEEEAVQTPAGVESGAASEAPGGRGCDRPRADHAAPPQEAGVQCTCQHYTVREEAQKTPPADPACPEREDSHGSGSPFKASQD

SEQ ID NO: 45148 - protein, 264 aa, Homo sapiens
  Payload ID: 9204
  Gene Symbol: LBHD1
  Gene Name: LBH domain containing 1
  ENSP ID: ENSP00000410979
MAACTASGAPTGAPRSRKLLPRGLTTPWRRLERPIAETIDKRPAREDLLEETFGIRSAWISGRSKEDGLWTRNSPGSSQHPESPRLPNPLWDRGKIGKVEGHQHIQDFSQKSHLPSIVVESSEVNEESGDLHLPHEELLLLTDGEEEDAEAFFQDQSEEPGWAWSPQDPRSPLRTFNAGLSWGQDQDEEDACWILEDTACLEATNHCPFWDSTGSRVCRSGFVEYSHLLPPNSFEGAEEEAVQTPAGVESGAASEAPGGRGCDR

SEQ ID NO: 45149 - protein, 289 aa, Homo sapiens
  Payload ID: 9204
  Gene Symbol: LBHD1
  Gene Name: LBH domain containing 1
  Uniprot ID: Q9BQE6
  ENSP ID: ENSP00000416856
MALVPGRSKEDGLWTRNSPGSSQHPESPRLPNPLWDRGKIGKVEGHQHIQVSTSSACVWQLAYPPVWPNLPAVPIQDFSQKSHLPSIVVESSEVNEESGDLHLPHEELLLLTDGEEEDAEAFFQDQSEEPGWAWSPQDPRSPLRTFNAGLSWGQDQDEEDACWILEDTACLEATNHCPFWDSTGSRVCRSGFVEYSHLLPPNSFEGAEEEAVQTPAGVESGAASEAPGGRGCDRPRADHAAPPQEAGVQCTCQHYTVREEAQKTPPADPACPEREDSHGSGSPFKASQD

SEQ ID NO: 45150 - protein, 122 aa, Homo sapiens
  Payload ID: 9204
  Gene Symbol: LBHD1
  Gene Name: LBH domain containing 1
  ENSP ID: ENSP00000434489
MVSRSGLSAGPTKEKGCLGFLRPSQGPAPTEDFSQKSHLPSIVVESSEVNEESGDLHLPHEELLLLTDGEEEDAEAFFQDQSEEPGWAWSPQDPRSPLRTFNAGLSWGQDQDEEDACWILED

SEQ ID NO: 45151 - protein, 263 aa, Homo sapiens; identical to SEQ ID NO: 45147
  Payload ID: 9204
  Gene Symbol: LBHD1
  Gene Name: LBH domain containing 1
  Uniprot ID: Q9BQE6
  ENSP ID: ENSP00000436848

SEQ ID NO: 45152 - protein, 121 aa, Homo sapiens
  Payload ID: 9204
  Gene Symbol: LBHD1
  Gene Name: LBH domain containing 1
  ENSP ID: ENSP00000437582
MEGIYTHTHPSPSPQLWNKHSKSSILVGEMGRSKEDGLWTRNSPGSSQHPESPRLPNPLWDRGKIGKVEGHQHIQDFSQKSHLPSIVVESSEVNEESGDLHLPHEELLLLTDGEEEDAEAF

SEQ ID NO: 45153 - protein, 295 aa, Homo sapiens
  Payload ID: 9205
  Gene Symbol: LIME1
  Gene Name: Lck interacting transmembrane adaptor 1
  Uniprot ID: Q9H400
  ENSP ID: ENSP00000309521
MGLPVSWAPPALWVLGCCALLLSLWALCTACRRPEDAVAPRKRARRQRARLQGSATAAEASLLRRTHLCSLSKSDTRLHELHRGPRSSRALRPASMDLLRPHWLEVSRDITGPQAAPSAFPHQELPRALPAAAATAGCAGLEATYSNVGLAALPGVSLAASPVVAEYARVQKRKGTHRSPQEPQQGKTEVTPAAQVDVLYSRVCKPKRRDPGPTTDPLDPKGQGAILALAGDLAYQTLPLRALDVDSGPLENVYESIRELGDPAGRSSTCGAGTPPASSCPSLGRGWRPLPASLP

SEQ ID NO: 45154 - protein, 106 aa, Homo sapiens
  Payload ID: 9205
  Gene Symbol: LIME1
  Gene Name: Lck interacting transmembrane adaptor 1
  ENSP ID: ENSP00000414506
MGLPVSWAPPALWVLGCCALLLSLWALCTACRRPEDAVAPRKRARRQRARLQGSATAAEASLLRRTHLCSLSKSDTRLHELHRGPRSSRALRPASMDLLRPHWLEV

SEQ ID NO: 45155 - protein, 131 aa, Homo sapiens
  Payload ID: 9205
  Gene Symbol: LIME1
  Gene Name: Lck interacting transmembrane adaptor 1
  ENSP ID: ENSP00000476772
MGLPVSWAPPALWVLGCCALLLSLWALCTACRRPEDAVAPRKRARRQRARLQGSATAAEAQVGHQTARAAPGPAQQQGPAACQHGSPAPTLAGGVQGHHRTAGSPLCLPTPGAAPGSAGSCSHRRVRWPRG

SEQ ID NO: 45156 - protein, 176 aa, Homo sapiens
  Payload ID: 9205
  Gene Symbol: LIME1
  Gene Name: Lck interacting transmembrane adaptor 1
  ENSP ID: ENSP00000477561
MGLPVSWAPPALWVLGCCALLLSLWALCTACRRPEDAVAPRKRARRQRARLQGSATAAEAQVGHQTARAAPGPAQQQGPAACQHGSPAPTLAGGVQGHHRTAGSPLCLPTPGAAPGSAGSCSHRRVRWPRGHLFQRGAGGPSRGQPGGQPCGGRVCPRPEAQRDPSQSPRATAGED

SEQ ID NO: 45157 - protein, 252 aa, Homo sapiens
  Payload ID: 9205
  Gene Symbol: LIME1
  Gene Name: Lck interacting transmembrane adaptor 1
  ENSP ID: ENSP00000478705
MGLPVSWAPPALWVLGCCALLLSLWALCTACRRKRARRQRARLQGSATAAEASLLRRTHLCSLSKSDTRLHELHRGPRSSRALRPASMDLLRPHWLEVSRDITGPQAAPSAFPHQELPRALPAAAATAGCAGLEATYSNVGLAALPGVSLAASPVVAEYARVQKRKGTHRSPQEPQQGKTEVTPAAQVDVLYSRVCKPKRRDPGPTTDPLDPKGQGAILALAGDLAYQTLPLRALDVDSGPLENVYESIREL

SEQ ID NO: 45158 - protein, 211 aa, Homo sapiens
  Payload ID: 9205
  Gene Symbol: LIME1
  Gene Name: Lck interacting transmembrane adaptor 1
  ENSP ID: ENSP00000482812
MGLPVSWAPPALWVLGCCALLLSLWALCTACRRPEDAVAPRKRARRQRARLQGSATAAEAVSARLSRGPGWGPQGTDQPSSPPVPTEADPPLLPQQVGHQTARAAPGPAQQQGPAACQHGSPAPTLAGGVQGHHRTAGSPLCLPTPGAAPGSAGSCSHRRVRWPRGHLFQRGAGGPSRGQPGGQPCGGRVCPRPEAQRDPSQSPRATAGED

SEQ ID NO: 45159 - protein, 539 aa, Homo sapiens
  Payload ID: 9206
  Gene Symbol: LCK
  Gene Name: LCK proto-oncogene, Src family tyrosine kinase
  Uniprot ID: P06239
  ENSP ID: ENSP00000328213
MGCGCSSHPEDDWMENIDVCENCHYPIVPLDGKGTLLIRNGSEVRDPLVTYEGSNPPASPLQDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTNASDGLCTRLSRPCQTQKPQKPWWEDEWEVPRETLKLVERLGAGQFGEVWMGYYNGHTKVAVKSLKQGSMSPDAFLAEANLMKQLQHQRLVRLYAVVTQEPIYIITEYMENDTLLDSQLEEKGLGASPWGNLGQQLLLLPTGSLVDFLKTPSGIKLTINKLLDMAAQIAEGMAFIEERNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYQLMRLCWKERPEDRPTFDYLRSVLEDFFTATEGQYQPQP

SEQ ID NO: 45160 - protein, 509 aa, Homo sapiens
  Payload ID: 9206
  Gene Symbol: LCK
  Gene Name: LCK proto-oncogene, Src family tyrosine kinase
  Uniprot ID: P06239
  ENSP ID: ENSP00000337825
MGCGCSSHPEDDWMENIDVCENCHYPIVPLDGKGTLLIRNGSEVRDPLVTYEGSNPPASPLQDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTNASDGLCTRLSRPCQTQKPQKPWWEDEWEVPRETLKLVERLGAGQFGEVWMGYYNGHTKVAVKSLKQGSMSPDAFLAEANLMKQLQHQRLVRLYAVVTQEPIYIITEYMENGSLVDFLKTPSGIKLTINKLLDMAAQIAEGMAFIEERNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYQLMRLCWKERPEDRPTFDYLRSVLEDFFTATEGQYQPQP

SEQ ID NO: 45161 - protein, 285 aa, Homo sapiens
  Payload ID: 9206
  Gene Symbol: LCK
  Gene Name: LCK proto-oncogene, Src family tyrosine kinase
  ENSP ID: ENSP00000362658
MGIPGSHNLRYFWNFPGQGPIISDVGGADLGGAPSAPSSIPSGTMGCGCSSHPEDDWMENIDVCENCHYPIVPLDGKGTLLIRNGSEVRDPLVTYEGSNPPASPLQDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTNASDGLCTRLSRPCQTQKPQKPWWEDEWEVP

SEQ ID NO: 45162 - protein, 137 aa, Homo sapiens
  Payload ID: 9206
  Gene Symbol: LCK
  Gene Name: LCK proto-oncogene, Src family tyrosine kinase
  ENSP ID: ENSP00000362663
MGCGCSSHPEDDWMENIDVCENCHYPIVPLDGKGTLLIRNGSEVRDPLVTYEGSNPPASPLQDNLVIALHSYEPSHDGDLGFEKGEQLRILEQSGEWWKAQSLTTGQEGFIPFNFVAKANSLEPEPWFFKNLSRKDA

SEQ ID NO: 45163 - protein, 516 aa, Homo sapiens
  Payload ID: 9206
  Gene Symbol: LCK
  Gene Name: LCK proto-oncogene, Src family tyrosine kinase
  ENSP ID: ENSP00000362665
MGCGCSSHPEDDWMENIDVCENCHYPIVPLDGKGTLLIRNGSEVRDPLVTYEGSNPPASPLQGDPRQQGLKDKACGSLAVGFHLSPTYFLPGLAFLVPHPVTPGFLPIPARFSLMPLVFTDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTRYYNGHTKVAVKSLKQGSMSPDAFLAEANLMKQLQHQRLVRLYAVVTQEPIYIITEYMENGSLVDFLKTPSGIKLTINKLLDMAAQIAEGMAFIEERNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYQLMRLCWKERPEDRPTFDYLRSVLEDFFTATEGQYQPQP

SEQ ID NO: 45164 - protein, 200 aa, Homo sapiens
  Payload ID: 9206
  Gene Symbol: LCK
  Gene Name: LCK proto-oncogene, Src family tyrosine kinase
  ENSP ID: ENSP00000431517
MGCGCSSHPEDDWMENIDVCENCHYPIVPLDGKGTLLIRNGSEVRDPLVTYEGSNPPASPLQGDPRQQGLKDKACGSLAVGFHLSPTYFLPGLAFLVPHPVTPGFLPIPARFSLMPLVFTDNLVIALHSYEPSHDGDLGFEKGEQLRILEQSGEWWKAQSLTTGQEGFIPFNFVAKANSLEPEPWFFKNLSRKDAERQLL

SEQ ID NO: 45165 - protein, 149 aa, Homo sapiens
  Payload ID: 9206
  Gene Symbol: LCK
  Gene Name: LCK proto-oncogene, Src family tyrosine kinase
  ENSP ID: ENSP00000434525
MGCGCSSHPEDDWMENIDVCENCHYPIVPLDGKGTLLIRNGSEVRDPLVTYEGSNPPASPLQGDPRQQGLKDKACGSLAVGFHLSPTYFLPGLAFLVPHPVTPGFLPIPARFSLMPLVFTDNLVIALHSYEPSHDGDLGFEKGEQLRIL

SEQ ID NO: 45166 - protein, 319 aa, Homo sapiens
  Payload ID: 9206
  Gene Symbol: LCK
  Gene Name: LCK proto-oncogene, Src family tyrosine kinase
  ENSP ID: ENSP00000435605
MGCGCSSHPEDDWMENIDVCENCHYPIVPLDGKGTLLIRNGSEVRDPLVTYEGSNPPASPLQDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTRYYNGHTKVAVKSLKQGSMSPDAFLAEANLMKQLQHQRLVRLYAVVTQEPIYIITEYMENGSLVDFLKTPSGIKLTINKLLDMAAQIAEGMAFIEERNYIHRDLRAANI

SEQ ID NO: 45167 - protein, 167 aa, Homo sapiens
  Payload ID: 9206
  Gene Symbol: LCK
  Gene Name: LCK proto-oncogene, Src family tyrosine kinase
  ENSP ID: ENSP00000436554
MGIPGSHNLRYFWNFPGQGPIISDVGGADLGGAPSAPSSIPSGTMGCGCSSHPEDDWMENIDVCENCHYPIVPLDGKGTLLIRNGSEVRDPLVTYEGSNPPASPLQGDPRQQGLKDKACGSLAVGFHLSPTYFLPGLAFLVPHPVTPGFLPIPARFSLMPLVFTDNL

SEQ ID NO: 45168 - protein, 509 aa, Homo sapiens; identical to SEQ ID NO: 45160
  Payload ID: 9206
  Gene Symbol: LCK
  Gene Name: LCK proto-oncogene, Src family tyrosine kinase
  Uniprot ID: P06239
  ENSP ID: ENSP00000477713

SEQ ID NO: 45169 - protein, 697 aa, Homo sapiens
  Payload ID: 9207
  Gene Symbol: LCA5
  Gene Name: Leber congenital amaurosis 5
  Uniprot ID: Q86VQ0
  ENSP ID: ENSP00000358861
MGERAGSPGTDQERKAGKHHYSYLSDFETPQSSGRSSLVSSSPASVRRKNPKRQTSDGQVHHQAPRKPSPKGLPNRKGVRVGFRSQSLNREPLRKDTDLVTKRILSARLLKINELQNEVSELQVKLAELLKENKSLKRLQYRQEKALNKFEDAENEISQLIFRHNNEITALKERLRKSQEKERATEKRVKDTESELFRTKFSLQKLKEISEARHLPERDDLAKKLVSAELKLDDTERRIKELSKNLELSTNSFQRQLLAERKRAYEAHDENKVLQKEVQRLYHKLKEKERELDIKNIYSNRLPKSSPNKEKELALRKNAACQSDFADLCTKGVQTMEDFKPEEYPLTPETIMCYENKWEEPGHLTLDLQSQKQDRHGEAGILNPIMEREEKFVTDEELHVVKQEVEKLEDEWEREELDKKQKEKASLLEREEKPEWETGRYQLGMYPIQNMDKLQGEEEERLKREMLLAKLNEIDRELQDSRNLKYPVLPLLPDFESKLHSPERSPKTYRFSESSERLFNGHHLQDISFSTPKGEGQNSGNVRSPASPNEFAFGSYVPSFAKTSERSNPFSQKSSFLDFQRNSMEKLSKDGVDLITRKEKKANLMEQLFGASGSSTISSKSSDPNSVASSKGDIDPLNFLPGNKGSRDQEHDEDEGFFLSEGRSFNPNRHRLKHADDKPAVKAADSVEDEIEEVALR

SEQ ID NO: 45170 - protein, 697 aa, Homo sapiens; identical to SEQ ID NO: 45169
  Payload ID: 9207
  Gene Symbol: LCA5
  Gene Name: Leber congenital amaurosis 5
  Uniprot ID: Q86VQ0
  ENSP ID: ENSP00000376686

SEQ ID NO: 45171 - protein, 430 aa, Homo sapiens
  Payload ID: 9207
  Gene Symbol: LCA5
  Gene Name: Leber congenital amaurosis 5
  ENSP ID: ENSP00000474463
MGERAGSPGTDQERKAGKHHYSYLSDFETPQSSGRSSLVSSSPASVRRKNPKRQTSDGQVHHQAPRKPSPKGLPNRKGVRVGFRSQSLNREPLRKDTDLVTKRILSARLLKINELQNEVSELQVKLAELLKENKSLKRLQYRQEKALNKFEDAENEISQLIFRHNNEITALKERLRKSQEKERATEKRVKDTESELFRTKFSLQKLKEISEARHLPERDDLAKKLVSAELKLDDTERRIKELSKNLELSTNSFQRQLLAERKRAYEAHDENKVLQKEVQRLYHKLKEKERELDIKNIYSNRLPKSSPNKEKELALRKNAACQSDFADLCTKGVQTMEDFKPEEYPLTPETIMCYENKWEEPGHLTLDLQSQKQDRHGEAGILNPIMEREEKFVTDEELHVVKQEVEKLEDGKKKSLFKHVTSQHPLRKKE

SEQ ID NO: 45172 - protein, 670 aa, Homo sapiens
  Payload ID: 9208
  Gene Symbol: LCA5L
  Gene Name: Leber congenital amaurosis 5-like
  Uniprot ID: O95447
  ENSP ID: ENSP00000288350
MSLADLTKTNIDEHFFGVALENNRRSAACKRSPGTGDFSRNSNASNKSVDYSRSQCSCGSLSSQYDYSEDFLCDCSEKAINRNYLKQPVVKEKEKKKYNVSKISQSKGQKEISVEKKHTWNASLFNSQIHMIAQRRDAMAHRILSARLHKIKGLKNELADMHHKLEAILTENQFLKQLQLRHLKAIGKYENSQNNLPQIMAKHQNEVKNLRQLLRKSQEKERTLSRKLRETDSQLLKTKDILQALQKLSEDKNLAEREELTHKLSIITTKMDANDKKIQSLEKQLRLNCRAFSRQLAIETRKTLAAQTATKTLQVEVKHLQQKLKEKDRELEIKNIYSHRILKNLHDTEDYPKVSSTKSVQADRKILPFTSMRHQGTQKSDVPPLTTKGKKATGNIDHKEKSTEINHEIPHCVNKLPKQEDSKRKYEDLSGEEKHLEVQILLENTGRQKDKKEDQEKKNIFVKEEQELPPKIIEVIHPERESNQEDVLVREKFKRSMQRNGVDDTLGKGTAPYTKGPLRQRRHYSFTEATENLHHGLPASGGPANAGNMRYSHSTGKHLSNREEMELEHSDSGYEPSFGKSSRIKVKDTTFRDKKSSLMEELFGSGYVLKTDQSSPGVAKGSEEPLQSKESHPLPPSQASTSHAFGDSKVTVVNSIKPSSPTEGKRKIII

SEQ ID NO: 45173 - protein, 670 aa, Homo sapiens; identical to SEQ ID NO: 45172
  Payload ID: 9208
  Gene Symbol: LCA5L
  Gene Name: Leber congenital amaurosis 5-like
  Uniprot ID: O95447
  ENSP ID: ENSP00000351008

SEQ ID NO: 45174 - protein, 670 aa, Homo sapiens; identical to SEQ ID NO: 45172
  Payload ID: 9208
  Gene Symbol: LCA5L
  Gene Name: Leber congenital amaurosis 5-like
  Uniprot ID: O95447
  ENSP ID: ENSP00000370046

SEQ ID NO: 45175 - protein, 69 aa, Homo sapiens
  Payload ID: 9208
  Gene Symbol: LCA5L
  Gene Name: Leber congenital amaurosis 5-like
  ENSP ID: ENSP00000395593
MSLADLTKTNIDEHFFGVALENNRRSAACKRSPGTGDFSRNSNASNKSVDYSRSQCSCGSLSSQYDYSE

SEQ ID NO: 45176 - protein, 95 aa, Homo sapiens
  Payload ID: 9208
  Gene Symbol: LCA5L
  Gene Name: Leber congenital amaurosis 5-like
  ENSP ID: ENSP00000400086
MSLADLTKTNIDEHFFGVALENNRRSAACKRSPGTGDFSRNSNASNKSVDYSRSQCSCGSLSSQYDYSEDFLCDCSEKAINRNYLKQPVVKEKEK

SEQ ID NO: 45177 - protein, 10 aa, Homo sapiens
  Payload ID: 9208
  Gene Symbol: LCA5L
  Gene Name: Leber congenital amaurosis 5-like
  ENSP ID: ENSP00000401084
MSLADLTKTN

SEQ ID NO: 45178 - protein, 189 aa, Homo sapiens
  Payload ID: 9208
  Gene Symbol: LCA5L
  Gene Name: Leber congenital amaurosis 5-like
  ENSP ID: ENSP00000404521
MSLADLTKTNIDEHFFGVALENNRRSAACKRSPGTGDFSRNSNASNKSVDYSRSQCSCGSLSSQYDYSEDFLCDCSEKAINRNYLKQPVVKEKEKKKYNVSKISQSKGQKEISVEKKHTWNASLFNSQIHMIAQRRDAMAHRILSARLHKIKGLKNELADMHHKLEAILTENQFLKQLQLRHLKAIGKY

SEQ ID NO: 45179 - protein, 94 aa, Homo sapiens
  Payload ID: 9208
  Gene Symbol: LCA5L
  Gene Name: Leber congenital amaurosis 5-like
  ENSP ID: ENSP00000405130
MSLADLTKTNIDEHFFGVALENNRRSAACKRSPGTGDFSRNSNASNKSVDYSRSQCSCGSLSSQYDYSEDFLCDCSEKAINRNYLKQPVVKEKE

SEQ ID NO: 45180 - protein, 107 aa, Homo sapiens
  Payload ID: 9208
  Gene Symbol: LCA5L
  Gene Name: Leber congenital amaurosis 5-like
  ENSP ID: ENSP00000405598
MSLADLTKTNIDEHFFGVALENNRRSAACKRSPGTGDFSRNSNASNKSVDYSRSQCSCGSLSSQYDYSEDFLCDCSEKAINRNYLKQPVVKEKEKKKYNVSKISQSK

SEQ ID NO: 45181 - protein, 30 aa, Homo sapiens
  Payload ID: 9208
  Gene Symbol: LCA5L
  Gene Name: Leber congenital amaurosis 5-like
  ENSP ID: ENSP00000407065
MSLADLTKTNIDEHFFGVALENNRRSAACK

SEQ ID NO: 45182 - protein, 93 aa, Homo sapiens
  Payload ID: 9208
  Gene Symbol: LCA5L
  Gene Name: Leber congenital amaurosis 5-like
  ENSP ID: ENSP00000412691
MSLADLTKTNIDEHFFGVALENNRRSAACKRSPGTGDFSRNSNASNKSVDYSRSQCSCGSLSSQYDYSEDFLCDCSEKAINRNYLKQPVVKEK

SEQ ID NO: 45183 - protein, 63 aa, Homo sapiens
  Payload ID: 9208
  Gene Symbol: LCA5L
  Gene Name: Leber congenital amaurosis 5-like
  ENSP ID: ENSP00000414784
MSLADLTKTNIDEHFFGVALENNRRSAACKRSPGTGDFSRNSNASNKSVDYSRSQCSCGSLSS

SEQ ID NO: 45184 - protein, 288 aa, Homo sapiens
  Payload ID: 9208
  Gene Symbol: LCA5L
  Gene Name: Leber congenital amaurosis 5-like
  ENSP ID: ENSP00000475187
MSLADLTKTNIDEHFFGVALENNRRSAACKRSPGTGDFSRNSNASNKSVDYSRSQCSCGSLSSQYDYSEDFLCDCSEKAINRNYLKQPVVKEKEKKKYNVSKISQSKGQKEISVEKKHTWNASLFNSQIHMIAQRRDAMAHRILSARLHKIKGLKNELADMHHKLEAILTENQFLKQLQLRHLKAIGKYENSQNNLPQIMAKHQNEVKNLRQLLRKSQEKERTLSRKLRETDSQLLKTKDILQALQKLSEDKNLAEREELTHKLSIITTKMDANDKKIQVCISGAQTV

SEQ ID NO: 45185 - protein, 230 aa, Homo sapiens
  Payload ID: 9209
  Gene Symbol: LRAT
  Gene Name: lecithin retinol acyltransferase (phosphatidylcholine--retinol O-acyltransferase)
  Uniprot ID: O95237
  ENSP ID: ENSP00000337224
MKNPMLEVVSLLLEKLLLISNFTLFSSGAAGEDKGRNSFYETSSFHRGDVLEVPRTHLTHYGIYLGDNRVAHMMPDILLALTDDMGRTQKVVSNKRLILGVIVKVASIRVDTVEDFAYGANILVNHLDESLQKKALLNEEVARRAEKLLGFTPYSLLWNNCEHFVTYCRYGTPISPQSDKFCETVKIIIRDQRSVLASAVLGLASIVCTGLVSYTTLPAIFIPFFLWMAG

SEQ ID NO: 45186 - protein, 69 aa, Homo sapiens
  Payload ID: 9209
  Gene Symbol: LRAT
  Gene Name: lecithin retinol acyltransferase (phosphatidylcholine--retinol O-acyltransferase)
  ENSP ID: ENSP00000422324
MKNPMLEVVSLLLEKLLLISNFTLFSSGAAGEDKGRNSFYETSSFHRGDVLEVPRTHLTHYGIYLGDNR

SEQ ID NO: 45187 - protein, 230 aa, Homo sapiens; identical to SEQ ID NO: 45185
  Payload ID: 9209
  Gene Symbol: LRAT
  Gene Name: lecithin retinol acyltransferase (phosphatidylcholine--retinol O-acyltransferase)
  Uniprot ID: O95237
  ENSP ID: ENSP00000426761

SEQ ID NO: 45188 - protein, 440 aa, Homo sapiens
  Payload ID: 9210
  Gene Symbol: LCAT
  Gene Name: lecithin-cholesterol acyltransferase
  Uniprot ID: P04180
  ENSP ID: ENSP00000264005
MGPPGSPWQWVTLLLGLLLPPAAPFWLLNVLFPPHTTPKAELSNHTRPVILVPGCLGNQLEAKLDKPDVVNWMCYRKTEDFFTIWLDLNMFLPLGVDCWIDNTRVVYNRSSGLVSNAPGVQIRVPGFGKTYSVEYLDSSKLAGYLHTLVQNLVNNGYVRDETVRAAPYDWRLEPGQQEEYYRKLAGLVEEMHAAYGKPVFLIGHSLGCLHLLYFLLRQPQAWKDRFIDGFISLGAPWGGSIKPMLVLASGDNQGIPIMSSIKLKEEQRITTTSPWMFPSRMAWPEDHVFISTPSFNYTGRDFQRFFADLHFEEGWYMWLQSRDLLAGLPAPGVEVYCLYGVGLPTPRTYIYDHGFPYTDPVGVLYEDGDDTVATRSTELCGLWQGRQPQPVHLLPLHGIQHLNMVFSNLTLEHINAILLGAYRQGPPASPTASPEPPPPE

SEQ ID NO: 45189 - protein, 80 aa, Homo sapiens
  Payload ID: 9210
  Gene Symbol: LCAT
  Gene Name: lecithin-cholesterol acyltransferase
  ENSP ID: ENSP00000458141
  MOD_RES (1)..(1): Any amino acid
XEYYRKLAGLVEEMHAAYGKPVFLIGHSLGCLHLLYFLLRQPQAWKDRFIDGFISLGAPWGGSIKPMLVLASGSGTRAQH

SEQ ID NO: 45190 - protein, 107 aa, Homo sapiens
  Payload ID: 9210
  Gene Symbol: LCAT
  Gene Name: lecithin-cholesterol acyltransferase
  ENSP ID: ENSP00000459014
  MOD_RES (1)..(1): Any amino acid
XLPLGVDCWIDNTRVVYNRSSGLVSNAPGVQIRVPGFGKTYSVEYLDSSKLAGPPATACAPAAPARDTASQHGLQQPDPGAHQCHPAGCLPPGSPCIPDCQPRAPAS

SEQ ID NO: 45191 - protein, 61 aa, Homo sapiens
  Payload ID: 9210
  Gene Symbol: LCAT
  Gene Name: lecithin-cholesterol acyltransferase
  ENSP ID: ENSP00000459291
SPRPGRTALLMASSLLGLPGVAPSSPCWSWPQECLCPGMCFTEDGSARARARPPEAPPALP

SEQ ID NO: 45192 - protein, 93 aa, Homo sapiens
  Payload ID: 9210
  Gene Symbol: LCAT
  Gene Name: lecithin-cholesterol acyltransferase
  ENSP ID: ENSP00000460653
MGPPGSPWQWVTLLLGLLLPPAAPFWLLNVLFPPHTTPKAELSNHTRPVILARSQAGQTRCGELDVLPQDRGLLHHLAGSQHVPTPWGRLLDR

SEQ ID NO: 45193 - protein, 138 aa, Homo sapiens
  Payload ID: 9210
  Gene Symbol: LCAT
  Gene Name: lecithin-cholesterol acyltransferase
  ENSP ID: ENSP00000463220
VQIRVPGFGKTYSVEYLDSSKLAGYLHTLVQNLVNNGYVRDETVRAAPYDWRLEPGQQEEYYRKLAGLVEEMHAAYGKPVFLIGHSLGCLHLLYFLLRQPQAWKDRFIDGFISLGAPWGGSIKPMLVLASETGSHCIA

SEQ ID NO: 45194 - protein, 255 aa, Homo sapiens
  Payload ID: 9210
  Gene Symbol: LCAT
  Gene Name: lecithin-cholesterol acyltransferase
  ENSP ID: ENSP00000464651
MCYRKTEDFFTIWLDLNMFLPLGVDCWIDNTRVVYNRSSGLVSNAPGVQIRVPGFGKTYSVEYLDSSKLAGYLHTLVQNLVNNGYVRDETVRAAPYDWRLEPGQQEEYYRKLAGLVEEMHAAYGKPVFLIGHSLGCLHLLYFLLRQPQAWKDRFIDGFISLGAPWGGSIKPMLVLASGDNQGIPIMSSIKLKEEQRITTTSPWMFPSRMAWPEDHVFISTPSFNYTGRDFQRFFADLHFEEGWYMWLQSRDLLAG

SEQ ID NO: 45195 - protein, 135 aa, Homo sapiens
  Payload ID: 9211
  Gene Symbol: LGALS1
  Gene Name: lectin, galactoside-binding, soluble, 1
  Uniprot ID: P09382
  ENSP ID: ENSP00000215909
MACGLVASNLNLKPGECLRVRGEVAPDAKSFVLNLGKDSNNLCLHFNPRFNAHGDANTIVCNSKDGGAWGTEQREAVFPFQPGSVAEVCITFDQANLTVKLPDGYEFKFPNRLNLEAINYMAADGDFKIKCVAFD

SEQ ID NO: 45196 - protein, 38 aa, Homo sapiens
  Payload ID: 9211
  Gene Symbol: LGALS1
  Gene Name: lectin, galactoside-binding, soluble, 1
  ENSP ID: ENSP00000388296
MACGLVASNLNLKPGECLRVRGEVAPDAKSEFFQQASC

SEQ ID NO: 45197 - protein, 69 aa, Homo sapiens
  Payload ID: 9211
  Gene Symbol: LGALS1
  Gene Name: lectin, galactoside-binding, soluble, 1
  ENSP ID: ENSP00000404414
MACASPWLGQRMPGGNNPTPTPSHPRTLRAVEALSSNPAGPGLVCAGSGRQQPESQTWRVPSSARRGGS

SEQ ID NO: 45198 - protein, 327 aa, Homo sapiens
  Payload ID: 9212
  Gene Symbol: LGALS12
  Gene Name: lectin, galactoside-binding, soluble, 12
  Uniprot ID: Q96DT0
  ENSP ID: ENSP00000255684
MSQPSGGRAPGTRIYSWSCPTVMSPGEKLDPIPDSFILQPPVFHPVVPYVTTIFGGLHAGKMVMLQGVVPLDAHRFQVDFQCGCSLCPRPDIAFHFNPRFHTTKPHVICNTLHGGRWQREARWPHLALRRGSSFLILFLFGNEEVKVSVNGQHFLHFRYRLPLSHVDTLGIFGDILVEAVGFLNINPFVEGSREYPAGHEVPCSHALPQGLSPGQVIIVRGLVLQEPKHFTVSLRDQAAHAPVTLRASFADRTLAWISRWGQKKLISAPFLFYPQRFFEVLLLFQEGGLKLALNGQGLGATSMNQQALEQLRELRISGSVQLYCVHS

SEQ ID NO: 45199 - protein, 337 aa, Homo sapiens
  Payload ID: 9212
  Gene Symbol: LGALS12
  Gene Name: lectin, galactoside-binding, soluble, 12
  Uniprot ID: Q96DT0
  ENSP ID: ENSP00000339374
MSQPSGGRAPGTRIYSWSCPTVMSPGEKLDPIPDSFILQPPVFHPVVPYVTTIFGGLHAGKMVMLQGVVPLDAHSRFQVDFQCGCSLCPRPDIAFHFNPRFHTTKPHVICNTLHGGRWQREARWPHLALRRGSSFLILFLFGNEEVKVSVNGQHFLHFRYRLPLSHVDTLGIFGDILVEAVGFLNINPFVEGSREYPAGHPFLLMSPRLEVPCSHALPQGLSPGQVIIVRGLVLQEPKHFTVSLRDQAAHAPVTLRASFADRTLAWISRWGQKKLISAPFLFYPQRFFEVLLLFQEGGLKLALNGQGLGATSMNQQALEQLRELRISGSVQLYCVHS

SEQ ID NO: 45200 - protein, 336 aa, Homo sapiens
  Payload ID: 9212
  Gene Symbol: LGALS12
  Gene Name: lectin, galactoside-binding, soluble, 12
  Uniprot ID: Q96DT0
  ENSP ID: ENSP00000378116
MSQPSGGRAPGTRIYSWSCPTVMSPGEKLDPIPDSFILQPPVFHPVVPYVTTIFGGLHAGKMVMLQGVVPLDAHRFQVDFQCGCSLCPRPDIAFHFNPRFHTTKPHVICNTLHGGRWQREARWPHLALRRGSSFLILFLFGNEEVKVSVNGQHFLHFRYRLPLSHVDTLGIFGDILVEAVGFLNINPFVEGSREYPAGHPFLLMSPRLEVPCSHALPQGLSPGQVIIVRGLVLQEPKHFTVSLRDQAAHAPVTLRASFADRTLAWISRWGQKKLISAPFLFYPQRFFEVLLLFQEGGLKLALNGQGLGATSMNQQALEQLRELRISGSVQLYCVHS

SEQ ID NO: 45201 - protein, 275 aa, Homo sapiens
  Payload ID: 9212
  Gene Symbol: LGALS12
  Gene Name: lectin, galactoside-binding, soluble, 12
  Uniprot ID: Q96DT0
  ENSP ID: ENSP00000394659
MVMLQGVVPLDAHRFQVDFQCGCSLCPRPDIAFHFNPRFHTTKPHVICNTLHGGRWQREARWPHLALRRGSSFLILFLFGNEEVKVSVNGQHFLHFRYRLPLSHVDTLGIFGDILVEAVGFLNINPFVEGSREYPAGHPFLLMSPRLEVPCSHALPQGLSPGQVIIVRGLVLQEPKHFTVSLRDQAAHAPVTLRASFADRTLAWISRWGQKKLISAPFLFYPQRFFEVLLLFQEGGLKLALNGQGLGATSMNQQALEQLRELRISGSVQLYCVHS

SEQ ID NO: 45202 - protein, 266 aa, Homo sapiens
  Payload ID: 9212
  Gene Symbol: LGALS12
  Gene Name: lectin, galactoside-binding, soluble, 12
  Uniprot ID: Q96DT0
  ENSP ID: ENSP00000399093
MVMLQGVVPLDAHRFQVDFQCGCSLCPRPDIAFHFNPRFHTTKPHVICNTLHGGRWQREARWPHLALRRGSSFLILFLFGNEEVKVSVNGQHFLHFRYRLPLSHVDTLGIFGDILVEAVGFLNINPFVEGSREYPAGHEVPCSHALPQGLSPGQVIIVRGLVLQEPKHFTVSLRDQAAHAPVTLRASFADRTLAWISRWGQKKLISAPFLFYPQRFFEVLLLFQEGGLKLALNGQGLGATSMNQQALEQLRELRISGSVQLYCVHS

SEQ ID NO: 45203 - protein, 139 aa, Homo sapiens
  Payload ID: 9213
  Gene Symbol: LGALS13
  Gene Name: lectin, galactoside-binding, soluble, 13
  Uniprot ID: Q9UHV8
  ENSP ID: ENSP00000221797
MSSLPVPYKLPVSLSVGSCVIIKGTPIHSFINDPQLQVDFYTDMDEDSDIAFRFRVHFGNHVVMNRREFGIWMLEETTDYVPFEDGKQFELCIYVHYNEYEIKVNGIRIYGFVHRIPPSFVKMVQVSRDISLTSVCVCN

SEQ ID NO: 45204 - protein, 83 aa, Homo sapiens
  Payload ID: 9213
  Gene Symbol: LGALS13
  Gene Name: lectin, galactoside-binding, soluble, 13
  ENSP ID: ENSP00000470928
MSSLPLQVDFYTDMDEDSDIAFRFRVHFGNHVVMNRREFGIWMLEETTDYVPFEDGKQFELCIYVHYNEYEIKVNGIRIYGFV

SEQ ID NO: 45205 - protein, 141 aa, Homo sapiens
  Payload ID: 9213
  Gene Symbol: LGALS13
  Gene Name: lectin, galactoside-binding, soluble, 13
  ENSP ID: ENSP00000483444
MSSLPVPYKLPVSLSVGSCVIIKGTPIHSFINDPQLQVDFYTDMDEDSDIAFRFRVHFGNHVVMNRREFGIWMLEETTDYVPFEDGKQFELCIYVHYNEYEIKVNGIRIYGFVHRIPPSFVKMVQVSRDISLTSVCVCNGR

SEQ ID NO: 45206 - protein, 168 aa, Homo sapiens
  Payload ID: 9214
  Gene Symbol: LGALS14
  Gene Name: lectin, galactoside-binding, soluble, 14
  Uniprot ID: Q8TCE9
  ENSP ID: ENSP00000353893
MSLTHRLHLCKYWGCAVSNVCRFWEGRPLPLMIVVPYTLPVSLPVGSCVIITGTPILTFVKDPQLEVNFYTGMDEDSDIAFQFRLHFGHPAIMNSCVFGIWRYEEKCYYLPFEDGKPFELCIYVRHKEYKVMVNGQRIYNFAHRFPPASVKMLQVFRDISLTRVLISD

SEQ ID NO: 45207 - protein, 139 aa, Homo sapiens
  Payload ID: 9214
  Gene Symbol: LGALS14
  Gene Name: lectin, galactoside-binding, soluble, 14
  Uniprot ID: Q8TCE9
  ENSP ID: ENSP00000375905
MSSLPVPYTLPVSLPVGSCVIITGTPILTFVKDPQLEVNFYTGMDEDSDIAFQFRLHFGHPAIMNSCVFGIWRYEEKCYYLPFEDGKPFELCIYVRHKEYKVMVNGQRIYNFAHRFPPASVKMLQVFRDISLTRVLISD

SEQ ID NO: 45208 - protein, 123 aa, Homo sapiens
  Payload ID: 9214
  Gene Symbol: LGALS14
  Gene Name: lectin, galactoside-binding, soluble, 14
  ENSP ID: ENSP00000471660
  MOD_RES (1)..(1): Any amino acid
XEELPRRREQCHHYPKDPQLEVNFYTGMDEDSDIAFQFRLHFGHPAIMNSCVFGIWRYEEKCYYLPFEDGKPFELCIYVRHKEYKVMVNGQRIYNFAHRFPPASVKMLQVFRDISLTRVLISD

SEQ ID NO: 45209 - protein, 142 aa, Homo sapiens
  Payload ID: 9215
  Gene Symbol: LGALS16
  Gene Name: lectin, galactoside-binding, soluble, 16
  Uniprot ID: A8MUM7
  ENSP ID: ENSP00000375904
MSFLTVPYKLPVSLSVGSCVIIKGTLIDSSINEPQLQVDFYTEMNEDSEIAFHLRVHLGRRVVMNSREFGIWMLEENLHYVPFEDGKPFDLRIYVCHNEYEVKVNGEYIYAFVHRIPPSYVKMIQVWRDVSLDSVLVNNGRR

SEQ ID NO: 45210 - protein, 60 aa, Homo sapiens
  Payload ID: 9215
  Gene Symbol: LGALS16
  Gene Name: lectin, galactoside-binding, soluble, 16
  ENSP ID: ENSP00000471564
MSFLTEGRLHLTLHLSLILNTLAGAIQTACVFVCWFLRDNQRDTDRLFYQRTTAAGGFLH

SEQ ID NO: 45211 - protein, 132 aa, Homo sapiens
  Payload ID: 9216
  Gene Symbol: LGALS2
  Gene Name: lectin, galactoside-binding, soluble, 2
  Uniprot ID: P05162
  ENSP ID: ENSP00000215886
MTGELEVKNMDMKPGSTLKITGSIADGTDGFVINLGQGTDKLNLHFNPRFSESTIVCNSLDGSNWGQEQREDHLCFSPGSEVKFTVTFESDKFKVKLPDGHELTFPNRLGHSHLSYLSVRGGFNMSSFKLKE

SEQ ID NO: 45212 - protein, 29 aa, Homo sapiens
  Payload ID: 9216
  Gene Symbol: LGALS2
  Gene Name: lectin, galactoside-binding, soluble, 2
  ENSP ID: ENSP00000407351
MTGELEVKNMDMKPGSTLKITGSIADGTD

SEQ ID NO: 45213 - protein, 250 aa, Homo sapiens [sequence omitted]

SEQ ID NO: 45214 - protein, 233 aa, Homo sapiens
  Payload ID: 9217
  Gene Symbol: LGALS3
  Gene Name: lectin, galactoside-binding, soluble, 3
  ENSP ID: ENSP00000451381
MADNFSLHDALSGSGNPNPQGWPGAWGNQPAGAGGYPGASYPGAYPGQAPPGAYPGQAPPGAYPGAPGAYPGAPAPGVYPGPPSGPGAYPSSGQPSATGAYPATGPYGAPAGPLIVPYNLPLPGGVVPRMLITILGTVKPNANRIALDFQRGNDVAFHFNPRFNENNRRVIVCNTKLDNNWGREERQSVFPFESGKPFKSLALSPGWSTVARSWLTTTSASWVQAMLLPQPPK

SEQ ID NO: 45215 - protein, 88 aa, Homo sapiens
  Payload ID: 9217
  Gene Symbol: LGALS3
  Gene Name: lectin, galactoside-binding, soluble, 3
  ENSP ID: ENSP00000451526
MADNFSLHDALSGSGNPNPQGWPGAWGNQPAGAGGYPGASYPGAYPGQAPPGAYPGQAPPGAYPGAPGAYPGAPAPGVYPGPPSGPGA

SEQ ID NO: 45216 - protein, 585 aa, Homo sapiens
  Payload ID: 9218
  Gene Symbol: LGALS3BP
  Gene Name: lectin, galactoside-binding, soluble, 3 binding protein
  Uniprot ID: Q08380
  ENSP ID: ENSP00000262776
MTPPRLFWVWLLVAGTQGVNDGDMRLADGGATNQGRVEIFYRGQWGTVCDNLWDLTDASVVCRALGFENATQALGRAAFGQGSGPIMLDEVQCTGTEASLADCKSLGWLKSNCRHERDAGVVCTNETRSTHTLDLSRELSEALGQIFDSQRGCDLSISVNVQGEDALGFCGHTVILTANLEAQALWKEPGSNVTMSVDAECVPMVRDLLRYFYSRRIDITLSSVKCFHKLASAYGARQLQGYCASLFAILLPQDPSFQMPLDLYAYAVATGDALLEKLCLQFLAWNFEALTQAEAWPSVPTDLLQLLLPRSDLAVPSELALLKAVDTWSWGERASHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTDFEGWKAAIPSALDTNSSKSTSSFPCPAGHFNGFRTVIRPFYLTNSSGVD

SEQ ID NO: 45217 - protein, 205 aa, Homo sapiens
  Payload ID: 9218
  Gene Symbol: LGALS3BP
  Gene Name: lectin, galactoside-binding, soluble, 3 binding protein
  ENSP ID: ENSP00000465120
MTPPRLFWVWLLVAGTQGVNDGDMRLADGGATNQGRVEIFYRGQWGTVCDNLWDLTDASVVCRALGFENATQALGRAAFGQGSGPIMLDEVQCTGTEASLADCKSLGWLKSNCRHERDAGVVCTNGTSTPEGLTSPCRQSSASTSWPLPMGPGSCRATAQASLPSSSPRTPRSRCPWTCMPMQWPQGTPCWRSSAYSSWPGTSRP

SEQ ID NO: 45218 - protein, 144 aa, Homo sapiens
  Payload ID: 9218
  Gene Symbol: LGALS3BP
  Gene Name: lectin, galactoside-binding, soluble, 3 binding protein
  ENSP ID: ENSP00000465380
MTPPRLFWVWLLVAGTQGSGPIMLDEVQCTGTEASLADCKSLGWLKSNCRHERDAGVVCTNETRSTHTLDLSRELSEALGQIFDSQRGCDLSISVNVQGEDALGFCGHTVILTANLEAQALWKEPGSNVTMSVDAECVPMVRDL

SEQ ID NO: 45219 - protein, 210 aa, Homo sapiens
  Payload ID: 9218
  Gene Symbol: LGALS3BP
  Gene Name: lectin, galactoside-binding, soluble, 3 binding protein
  ENSP ID: ENSP00000465729
MTPPRLFWVWLLVAGTQGVNDGDMRLADGGATNQGRVEIFYRGQWGTVCDNLWDLTDASVVCRALGFENATQALGRAAFGQGSGPIMLDEVQCTGTEASLADCKSLGWLKSNCRHERDAGVVCTNETRSTHTLDLSRELSEALGQIFDSQRGCDLSISVNVQGEDALGFCGHTVILTANLEAQALWKEPGSNVTMSVDAECVPMVRDLLR

SEQ ID NO: 45220 - protein, 18 aa, Homo sapiens
  Payload ID: 9218
  Gene Symbol: LGALS3BP
  Gene Name: lectin, galactoside-binding, soluble, 3 binding protein
  ENSP ID: ENSP00000465982
MTPPRLFWVWLLVAGTQA

SEQ ID NO: 45221 - protein, 62 aa, Homo sapiens
  Payload ID: 9218
  Gene Symbol: LGALS3BP
  Gene Name: lectin, galactoside-binding, soluble, 3 binding protein
  ENSP ID: ENSP00000466318
MTPPRLFWVWLLVAGTQGELSPWEIPKAEVWKAGAPWGCSELQGDILPGARGPAVSQIFSPA

SEQ ID NO: 45222 - protein, 41 aa, Homo sapiens
  Payload ID: 9218
  Gene Symbol: LGALS3BP
  Gene Name: lectin, galactoside-binding, soluble, 3 binding protein
  ENSP ID: ENSP00000466333
MTPPRLFWVWLLVAGTQAPGIPSDDDLEVPGGSPGFRRERW

SEQ ID NO: 45223 - protein, 113 aa, Homo sapiens
  Payload ID: 9218
  Gene Symbol: LGALS3BP
  Gene Name: lectin, galactoside-binding, soluble, 3 binding protein
  ENSP ID: ENSP00000466850
MTPPRLFWVWLLVAGTQGVNDGDMRLADGGATNQGRVEIFYRGQWGTVCDNLWDLTDASVVCRALGFENATQALGRAAFGQGRACCLTGRLQVPGLAEEQLQARERRWCGLHQ

SEQ ID NO: 45224 - protein, 259 aa, Homo sapiens
  Payload ID: 9218
  Gene Symbol: LGALS3BP
  Gene Name: lectin, galactoside-binding, soluble, 3 binding protein
  ENSP ID: ENSP00000467211
MTPPRLFWVWLLVAGTQGVNDGDMRLADGGATNQGRVEIFYRGQWGTVCDNLWDLTDASVVCRALGFENATQALGRAAFGQGSGPIMLDEVQCTGTEASLADCKSLGWLKSNCRHERDAGVVCTNETRSTHTLDLSRELSEALGQIFDSQRGCDLSISVNVQGEDALGFCGHTVILTANLEAQALWKEPGSNVTMSVDAECVPMVRDLLRYFYSRRIDITLSSVKCFHKLASAYGARQLQGYCASLFAILLPQDPSFQM

SEQ ID NO: 45225 - protein, 62 aa, Homo sapiens; identical to SEQ ID NO: 45221
  Payload ID: 9218
  Gene Symbol: LGALS3BP
  Gene Name: lectin, galactoside-binding, soluble, 3 binding protein
  ENSP ID: ENSP00000467646

SEQ ID NO: 45226 - protein, 48 aa, Homo sapiens
  Payload ID: 9218
  Gene Symbol: LGALS3BP
  Gene Name: lectin, galactoside-binding, soluble, 3 binding protein
  ENSP ID: ENSP00000467976
MTPPRLFWVWLLVAGTQGVNDGDMRLADGGATNQGRVEIFYRGPWPDL

SEQ ID NO: 45227 - protein, 41 aa, Homo sapiens; identical to SEQ ID NO: 45222
  Payload ID: 9218
  Gene Symbol: LGALS3BP
  Gene Name: lectin, galactoside-binding, soluble, 3 binding protein
  ENSP ID: ENSP00000468131

SEQ ID NO: 45228 - protein, 131 aa, Homo sapiens
  Payload ID: 9218
  Gene Symbol: LGALS3BP
  Gene Name: lectin, galactoside-binding, soluble, 3 binding protein
  ENSP ID: ENSP00000468480
MTPPRLFWVWLLVAGTQGVNDGDMRLADGGATNQGRVEIFYRGQWGTVCDNLWDLTDASVVCRALGFENATQALGRAAFGQGSGPIMLDEVQCTGTEASLADCKSLGWLKSNCRHERDAGVVCTNGAFQSE

SEQ ID NO: 45229 - protein, 88 aa, Homo sapiens
  Payload ID: 9218
  Gene Symbol: LGALS3BP
  Gene Name: lectin, galactoside-binding, soluble, 3 binding protein
  ENSP ID: ENSP00000468586
MTPPRLFWVWLLVAGTQGVNDGDMRLADGGATNQGRVEIFYRGQWGTVCDNLWDLTDASVVCRALGFENATQALGRAAFGQGSGPIML

SEQ ID NO: 45230 - protein, 209 aa, Homo sapiens
  Payload ID: 9218
  Gene Symbol: LGALS3BP
  Gene Name: lectin, galactoside-binding, soluble, 3 binding protein
  ENSP ID: ENSP00000468774
MTPPRLFWVWLLVAGTQGVNDGDMRLADGGATNQGRVEIFYRGQWGTVCDNLWDLTDASVVCRALGFENATQALGRAAFGQGSGPIMLDEVQCTGTEASLADCKSLGWLKSNCRHERDAGVVCTNETRSTHTLDLSRELSEALGQIFDSQRGCDLSISVNVQGEDALGFCGHTVILTANLEAQALWKEPGSNVTMSVDAECVPMVRDLL

SEQ ID NO: 45231 - protein, 323 aa, Homo sapiens
  Payload ID: 9219
  Gene Symbol: LGALS4
  Gene Name: lectin, galactoside-binding, soluble, 4
  Uniprot ID: P56470
  ENSP ID: ENSP00000302100
MAYVPAPGYQPTYNPTLPYYQPIPGGLNVGMSVYIQGVASEHMKRFFVNFVVGQDPGSDVAFHFNPRFDGWDKVVFNTLQGGKWGSEERKRSMPFKKGAAFELVFIVLAEHYKVVVNGNPFYEYGHRLPLQMVTHLQVDGDLQLQSINFIGGQPLRPQGPPMMPPYPGPGHCHQQLNSLPTMEGPPTFNPPVPYFGRLQGGLTARRTIIIKGYVPPTGKSFAINFKVGSSGDIALHINPRMGNGTVVRNSLLNGSWGSEEKKITHNPFGPGQFFDLSIRCGLDRFKVYANGQHLFDFAHRLSAFQRVDTLEIQGDVTLSYVQI

SEQ ID NO: 45232 - protein, 218 aa, Homo sapiens
  Payload ID: 9219
  Gene Symbol: LGALS4
  Gene Name: lectin, galactoside-binding, soluble, 4
  ENSP ID: ENSP00000470387
  MOD_RES (1)..(1): Any amino acid
XPFKKGAAFELVFIVLAEHYKVVVNGNPFYEYGHRLPLQMVTHLQVDGDLQLQSINFIGGQPLRPQGPPMMPPYPTMEGPPTFNPPVPYFGRLQGGLTARRTIIIKGYVPPTGKSFAINFKVGSSGDIALHINPRMGNGTVVRNSLLNGSWGSEEKKITHNPFGPGQFFDLSIRCGLDRFKVYANGQHLFDFAHRLSAFQRVDTLEIQGDVTLSYVQI

SEQ ID NO: 45233 - protein, 38 aa, Homo sapiens
  Payload ID: 9219
  Gene Symbol: LGALS4
  Gene Name: lectin, galactoside-binding, soluble, 4
  ENSP ID: ENSP00000471757
NFNQSTSSEASPSGPRGVAAQGVLTQHLEKRRSLMGVS

SEQ ID NO: 45234 - protein, 31 aa, Homo sapiens
  Payload ID: 9219
  Gene Symbol: LGALS4
  Gene Name: lectin, galactoside-binding, soluble, 4
  ENSP ID: ENSP00000472990
MSVYIQGVASEHMKRFFVNFVVGQDPGSDVA

SEQ ID NO: 45235 - protein, 31 aa, Homo sapiens; identical to SEQ ID NO: 45234
  Payload ID: 9219
  Gene Symbol: LGALS4
  Gene Name: Lectin, galactoside-binding, soluble, 4
  ENSP ID: ENSP00000489031

SEQ ID NO: 45236 - protein, 38 aa, Homo sapiens; identical to SEQ ID NO: 45233
  Payload ID: 9219
  Gene Symbol: LGALS4
  Gene Name: Lectin, galactoside-binding, soluble, 4
  ENSP ID: ENSP00000489125

SEQ ID NO: 45237 - protein, 218 aa, Homo sapiens; identical to SEQ ID NO: 45232
  Payload ID: 9219
  Gene Symbol: LGALS4
  Gene Name: Lectin, galactoside-binding, soluble, 4
  ENSP ID: ENSP00000489325
  MOD_RES (1)..(1): Any amino acid

SEQ ID NO: 45238 - protein, 323 aa, Homo sapiens; identical to SEQ ID NO: 45231
  Payload ID: 9219
  Gene Symbol: LGALS4
  Gene Name: Lectin, galactoside-binding, soluble, 4
  ENSP ID: ENSP00000489411

SEQ ID NO: 45239 - protein, 136 aa, Homo sapiens
  Payload ID: 9220
  Gene Symbol: LGALS7
  Gene Name: lectin, galactoside-binding, soluble, 7
  Uniprot ID: P47929
  ENSP ID: ENSP00000367891
MSNVPHKSSLPEGIRPGTVLRIRGLVPPNASRFHVNLLCGEEQGSDAALHFNPRLDTSEVVFNSKEQGSWGREERGPGVPFQRGQPFEVLIIASDDGFKAVVGDAQYHHFRHRLPLARVRLVEVGGDVQLDSVRIF

SEQ ID NO: 45240 - protein, 35 aa, Homo sapiens
  Payload ID: 9220
  Gene Symbol: LGALS7
  Gene Name: lectin, galactoside-binding, soluble, 7
  ENSP ID: ENSP00000472380
MPRCISTPGWTRRRWSSTARSKAPGAARSAGRAFL

SEQ ID NO: 45241 - protein, 136 aa, Homo sapiens; identical to SEQ ID NO: 45239
  Payload ID: 9220
  Gene Symbol: LGALS7
  Gene Name: Lectin, galactoside-binding, soluble, 7
  ENSP ID: ENSP00000489395

SEQ ID NO: 45242 - protein, 136 aa, Homo sapiens; identical to SEQ ID NO: 45239
  Payload ID: 9221
  Gene Symbol: LGALS7B
  Gene Name: lectin, galactoside-binding, soluble, 7B
  Uniprot ID: P47929
  ENSP ID: ENSP00000313571

SEQ ID NO: 45243 - protein, 35 aa, Homo sapiens
  Payload ID: 9221
  Gene Symbol: LGALS7B
  Gene Name: Lectin, galactoside-binding, soluble, 7B
  ENSP ID: ENSP00000489179
MPPCISTPGWTRRRWSSTARSKAPGAARSAGRAFL

SEQ ID NO: 45244 - protein, 136 aa, Homo sapiens; identical to SEQ ID NO: 45239
  Payload ID: 9221
  Gene Symbol: LGALS7B
  Gene Name: Lectin, galactoside-binding, soluble, 7B
  ENSP ID: ENSP00000489582

SEQ ID NO: 45245 - protein, 175 aa, Homo sapiens
  Payload ID: 9222
  Gene Symbol: LGALS8
  Gene Name: lectin, galactoside-binding, soluble, 8
  ENSP ID: ENSP00000238181
MMLSLNNLQNIIYNPVIPFVGTIPDQLDPGTLIVIRGHVPSDADRFQVDLQNGSSMKPRADVAFHFNPRFKRAGCIVCNTLINEKWGREEITYDTPFKREKSFEIVIMVLKDKFQVPKSGTPQLRLPFAARLNTPMGPGRTVVVKGEVNANAKSFNVDLLAGKSKDIALHLNPRL

SEQ ID NO: 45246 - protein, 359 aa, Homo sapiens
  Payload ID: 9222
  Gene Symbol: LGALS8
  Gene Name: lectin, galactoside-binding, soluble, 8
  Uniprot ID: O00214
  ENSP ID: ENSP00000309576
MMLSLNNLQNIIYNPVIPFVGTIPDQLDPGTLIVIRGHVPSDADRFQVDLQNGSSMKPRADVAFHFNPRFKRAGCIVCNTLINEKWGREEITYDTPFKREKSFEIVIMVLKDKFQVAVNGKHTLLYGHRIGPEKIDTLGIYGKVNIHSIGFSFSSDLQSTQASSLELTEISRENVPKSGTPQLPSNRGGDISKIAPRTVYTKSKDSTVNHTLTCTKIPPMNYVSKRLPFAARLNTPMGPGRTVVVKGEVNANAKSFNVDLLAGKSKDIALHLNPRLNIKAFVRNSFLQESWGEEERNITSFPFSPGMYFEMIIYCDVREFKVAVNGVHSLEYKHRFKELSSIDTLEINGDIHLLEVRSW

SEQ ID NO: 45247 - protein, 317 aa, Homo sapiens
  Payload ID: 9222
  Gene Symbol: LGALS8
  Gene Name: lectin, galactoside-binding, soluble, 8
  Uniprot ID: O00214
  ENSP ID: ENSP00000342139
MMLSLNNLQNIIYNPVIPFVGTIPDQLDPGTLIVIRGHVPSDADRFQVDLQNGSSMKPRADVAFHFNPRFKRAGCIVCNTLINEKWGREEITYDTPFKREKSFEIVIMVLKDKFQVAVNGKHTLLYGHRIGPEKIDTLGIYGKVNIHSIGFSFSSDLQSTQASSLELTEISRENVPKSGTPQLRLPFAARLNTPMGPGRTVVVKGEVNANAKSFNVDLLAGKSKDIALHLNPRLNIKAFVRNSFLQESWGEEERNITSFPFSPGMYFEMIIYCDVREFKVAVNGVHSLEYKHRFKELSSIDTLEINGDIHLLEVRSW

SEQ ID NO: 45248 - protein, 317 aa, Homo sapiens; identical to SEQ ID NO: 45247
  Payload ID: 9222
  Gene Symbol: LGALS8
  Gene Name: lectin, galactoside-binding, soluble, 8
  Uniprot ID: O00214
  ENSP ID: ENSP00000355543

SEQ ID NO: 45249 - protein, 208 aa, Homo sapiens
  Payload ID: 9222
  Gene Symbol: LGALS8
  Gene Name: lectin, galactoside-binding, soluble, 8
  ENSP ID: ENSP00000385999
MMLSLNNLQNIIYNPVIPFVGTIPDQLDPGTLIVIRGHVPSDADRFQVDLQNGSSMKPRADVAFHFNPRFKRAGCIVCNTLINEKWGREEITYDTPFKREKSFEIVIMVLKDKFQVAVNGKHTLLYGHRIGPEKIDTLGIYGKVNIHSIGFSFSSDLQSTQASSLELTEISRENVPKSGTPQLPSNRGGDISKIAPRTVYTKSKDSTV

SEQ ID NO: 45250 - protein, 121 aa, Homo sapiens
  Payload ID: 9222
  Gene Symbol: LGALS8
  Gene Name: lectin, galactoside-binding, soluble, 8
  ENSP ID: ENSP00000398630
MMLSLNNLQNIIYNPVIPFVGTIPDQLDPGTLIVIRGHVPSDADRFQVDLQNGSSMKPRADVAFHFNPRFKRAGCIVCNTLINEKWGREEITYDTPFKREKSFEIVIMVLKDKFQDLQSTQ

SEQ ID NO: 45251 - protein, 167 aa, Homo sapiens
  Payload ID: 9222
  Gene Symbol: LGALS8
  Gene Name: lectin, galactoside-binding, soluble, 8
  ENSP ID: ENSP00000405504
MMLSLNNLQNIIYNPVIPFVGTIPDQLDPGTLIVIRGHVPSDADRFQVDLQNGSSMKPRADVAFHFNPRFKRAGCIVCNTLINEKWGREEITYDTPFKREKSFEIVIMVLKDKFQVAVNGKHTLLYGHRIGPEKIDTLGIYGKVNIHSIGFSFSSDLQSTQASSLEL

SEQ ID NO: 45252 - protein, 53 aa, Homo sapiens
  Payload ID: 9222
  Gene Symbol: LGALS8
  Gene Name: lectin, galactoside-binding, soluble, 8
  ENSP ID: ENSP00000407428
MMLSLNNLQNIIYNPIPGGSAEWQQHETSSRCGLSFQSSFQKGRLHCLQYFDK

SEQ ID NO: 45253 - protein, 359 aa, Homo sapiens; identical to SEQ ID NO: 45246
  Payload ID: 9222
  Gene Symbol: LGALS8
  Gene Name: lectin, galactoside-binding, soluble, 8
  Uniprot ID: O00214
  ENSP ID: ENSP00000408657

SEQ ID NO: 45254 - protein, 300 aa, Homo sapiens
  Payload ID: 9222
  Gene Symbol: LGALS8
  Gene Name: lectin, galactoside-binding, soluble, 8
  ENSP ID: ENSP00000410843
MMLSLNNLQNIIYNPVIPFVGTIPDQLDPGTLIVIRGHVPSDADRFQVDLQNGSSMKPRADVAFHFNPRFKRAGCIVCNTLINEKWGREEITYDTPFKREKSFEIVIMVLKDKFQVPKSGTPQLPSNRGGDISKIAPRTVYTKSKDSTVNHTLTCTKIPPMNYVSKRLPFAARLNTPMGPGRTVVVKGEVNANAKSFNVDLLAGKSKDIALHLNPRLNIKAFVRNSFLQESWGEEERNITSFPFSPGMYFEMIIYCDVREFKVAVNGVHSLEYKHRFKELSSIDTLEINGDIHLLEVRSW

SEQ ID NO: 45255 - protein, 53 aa, Homo sapiens
  Payload ID: 9222
  Gene Symbol: LGALS8
  Gene Name: lectin, galactoside-binding, soluble, 8
  ENSP ID: ENSP00000413278
MMLSLNNLQNIIYNPVIPFVGTIPDQLDPGTLIVIRGHVPSDADRWICRMAAA

SEQ ID NO: 45256 - protein, 359 aa, Homo sapiens; identical to SEQ ID NO: 45246
  Payload ID: 9222
  Gene Symbol: LGALS8
  Gene Name: lectin, galactoside-binding, soluble, 8
  Uniprot ID: O00214
  ENSP ID: ENSP00000431398

SEQ ID NO: 45257 - protein, 300 aa, Homo sapiens; identical to SEQ ID NO: 45254
  Payload ID: 9222
  Gene Symbol: LGALS8
  Gene Name: lectin, galactoside-binding, soluble, 8
  ENSP ID: ENSP00000431884

SEQ ID NO: 45258 - protein, 290 aa, Homo sapiens
  Payload ID: 9222
  Gene Symbol: LGALS8
  Gene Name: lectin, galactoside-binding, soluble, 8
  ENSP ID: ENSP00000434860
MMLSLNNLQNIIYNPVIPFVGTIPDQLDPGTLIVIRGHVPSDADRAGCIVCNTLINEKWGREEITYDTPFKREKSFEIVIMVLKDKFQVAVNGKHTLLYGHRIGPEKIDTLGIYGKVNIHSIGFSFSSDLQSTQASSLELTEISRENVPKSGTPQLRLPFAARLNTPMGPGRTVVVKGEVNANAKSFNVDLLAGKSKDIALHLNPRLNIKAFVRNSFLQESWGEEERNITSFPFSPGMYFEMIIYCDVREFKVAVNGVHSLEYKHRFKELSSIDTLEINGDIHLLEVRSW

SEQ ID NO: 45259 - protein, 359 aa, Homo sapiens; identical to SEQ ID NO: 45246
  Payload ID: 9222
  Gene Symbol: LGALS8
  Gene Name: lectin, galactoside-binding, soluble, 8
  Uniprot ID: O00214
  ENSP ID: ENSP00000435460

SEQ ID NO: 45260 - protein, 106 aa, Homo sapiens
  Payload ID: 9222
  Gene Symbol: LGALS8
  Gene Name: lectin, galactoside-binding, soluble, 8
  ENSP ID: ENSP00000435632
MMLSLNNLQNIIYNPVIPFVGTIPDQLDPGTLIVIRGHVPSDADRFQVDLQNGSSMKPRADVAFHFNPRFKRAGCIVCNTLINEKWGREEITYDTPFKREKSFEIV

SEQ ID NO: 45261 - protein, 43 aa, Homo sapiens
  Payload ID: 9222
  Gene Symbol: LGALS8
  Gene Name: lectin, galactoside-binding, soluble, 8
  ENSP ID: ENSP00000437007
MMLSLNNLQNIIYNPVIPFVGTIPDQLDPGTLIVIRGHVPSDA

SEQ ID NO: 45262 - protein, 317 aa, Homo sapiens; identical to SEQ ID NO: 45247
  Payload ID: 9222
  Gene Symbol: LGALS8
  Gene Name: lectin, galactoside-binding, soluble, 8
  Uniprot ID: O00214
  ENSP ID: ENSP00000437040

SEQ ID NO: 45263 - protein, 323 aa, Homo sapiens
  Payload ID: 9223
  Gene Symbol: LGALS9
  Gene Name: lectin, galactoside-binding, soluble, 9
  Uniprot ID: O00182
  ENSP ID: ENSP00000306228
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 45264 - protein, 246 aa, Homo sapiens
  Payload ID: 9223
  Gene Symbol: LGALS9
  Gene Name: lectin, galactoside-binding, soluble, 9
  Uniprot ID: O00182
  ENSP ID: ENSP00000318214
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQPPGVWPANPAPITQTVIHTVQSAPGQMFSTPAIPPMMYPHPAYPMPFITTILGGLYPSKSILLSGTVLPSAQRCGSCVKLTASRWPWMVSTCLNTTIA

SEQ ID NO: 45265 - protein, 355 aa, Homo sapiens
  Payload ID: 9223
  Gene Symbol: LGALS9
  Gene Name: lectin, galactoside-binding, soluble, 9
  Uniprot ID: O00182
  ENSP ID: ENSP00000378856
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQNPRTVPVQPAFSTVPFSQPVCFPPRPRGRRQKPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 45266 - protein, 175 aa, Homo sapiens
  Payload ID: 9223
  Gene Symbol: LGALS9
  Gene Name: lectin, galactoside-binding, soluble, 9
  ENSP ID: ENSP00000462359
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQPMPFITTILGGLYPSKSILLSGTVLPS

SEQ ID NO: 45267 - protein, 137 aa, Homo sapiens
  Payload ID: 9223
  Gene Symbol: LGALS9
  Gene Name: lectin, galactoside-binding, soluble, 9
  ENSP ID: ENSP00000462382
  MOD_RES (1)..(1): Any amino acid
XFDLCFLVQSSDFKVMVNGILFVQYFHRVPFHRVDTISVNGSVQLSYISFQTQTVIHTVQSAPGQMFSTPAIPPMMYPHPAYPMPFITTILGGLYPSKSILLSGTVLPSAQRCGSCVKLTASRWPWMVSTCLNTTIA

SEQ ID NO: 45268 - protein, 75 aa, Homo sapiens
  Payload ID: 9223
  Gene Symbol: LGALS9
  Gene Name: lectin, galactoside-binding, soluble, 9
  ENSP ID: ENSP00000462668
MAFSGSQAPYLSPAVPFSGTIQGGLQDGLQITVNGTVLSSSGTRWRVRGVQHEAERKLGARGEEDTHAFPEGDAL

SEQ ID NO: 45269 - protein, 75 aa, Homo sapiens; identical to SEQ ID NO: 45268
  Payload ID: 9223
  Gene Symbol: LGALS9
  Gene Name: lectin, galactoside-binding, soluble, 9
  ENSP ID: ENSP00000463125

SEQ ID NO: 45270 - protein, 125 aa, Homo sapiens
  Payload ID: 9223
  Gene Symbol: LGALS9
  Gene Name: lectin, galactoside-binding, soluble, 9
  ENSP ID: ENSP00000464581
PVQPAFSTVPFSQPVCFPPRPRGRRQKTQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSE

SEQ ID NO: 45271 - protein, 115 aa, Homo sapiens
  Payload ID: 9223
  Gene Symbol: LGALS9
  Gene Name: lectin, galactoside-binding, soluble, 9
  ENSP ID: ENSP00000467505
MPFQKGMPFDLCFLVQSSDFKVMVNGILFVQYFHRVPFHRVDTISVNGSVQLSYISFQNPRTVPVQPAFSTVPFSQPVCFPPRPRGRRQKPPGVWPANPAPITQTVIHTVQSAPG

SEQ ID NO: 45272 - protein, 355 aa, Homo sapiens
  Payload ID: 9224
  Gene Symbol: LGALS9B
  Gene Name: lectin, galactoside-binding, soluble, 9B
  Uniprot ID: Q3B8N2
  ENSP ID: ENSP00000315564
MAFSGSQAPYLSPAVPFSGTIQGGLQDGFQITVNGAVLSSSGTRFAVDFQTGFSGNDIAFHFNPRFEDGGYVVCNTRQKGRWGPEERKMHMPFQKGMPFDLCFLVQSSDFKVMVNGSLFVQYFHRVPFHRVDTISVNGSVQLSYISFQNPRTVPVQPAFSTVPFSQPVCFPPRPRGRRQKPPSVRPANPAPITQTVIHTVQSASGQMFSTPAIPPMMYPHPAYPMPFITTIPGGLYPSKSIILSGTVLPSAQRFHINLCSGSHIAFHMNPRFDENAVVRNTQINNSWGSEERSLPRKMPFVRGQSFSVWILCEAHCLKVAVDGQHVFEYYHRLRNLPTINKLEVGGDIQLTHVQT

SEQ ID NO: 45273 - protein, 356 aa, Homo sapiens
  Payload ID: 9224
  Gene Symbol: LGALS9B
  Gene Name: lectin, galactoside-binding, soluble, 9B
  Uniprot ID: Q3B8N2
  ENSP ID: ENSP00000388841
MAFSGSQAPYLSPAVPFSGTIQGGLQDGFQITVNGAVLSSSGTRFAVDFQTGFSGNDIAFHFNPRFEDGGYVVCNTRQKGRWGPEERKMHMPFQKGMPFDLCFLVQSSDFKVMVNGSLFVQYFHRVPFHRVDTISVNGSVQLSYISFQNPRTVPVQPAFSTVPFSQPVCFPPRPRGRRQKPPSVRPANPAPITQTVIHTVQSASGQMFSQTPAIPPMMYPHPAYPMPFITTIPGGLYPSKSIILSGTVLPSAQRFHINLCSGSHIAFHMNPRFDENAVVRNTQINNSWGSEERSLPRKMPFVRGQSFSVWILCEAHCLKVAVDGQHVFEYYHRLRNLPTINKLEVGGDIQLTHVQT

SEQ ID NO: 45274 - protein, 51 aa, Homo sapiens
  Payload ID: 9224
  Gene Symbol: LGALS9B
  Gene Name: lectin, galactoside-binding, soluble, 9B
  ENSP ID: ENSP00000464309
ERKMHMPFQKGMPFDLCFLVQSSDFKEHGWSWKPLQEQKTKHRKFSLISRS

SEQ ID NO: 45275 - protein, 35 aa, Homo sapiens
  Payload ID: 9224
  Gene Symbol: LGALS9B
  Gene Name: lectin, galactoside-binding, soluble, 9B
  ENSP ID: ENSP00000464627
MAFSGSQAPYLSPVCCGLSDGLQWKRHCLPLQPSV

SEQ ID NO: 45276 - protein, 356 aa, Homo sapiens
  Payload ID: 9225
  Gene Symbol: LGALS9C
  Gene Name: lectin, galactoside-binding, soluble, 9C
  Uniprot ID: Q6DKI2
  ENSP ID: ENSP00000329932
MAFSGCQAPYLSPAVPFSGTIQGGLQDGFQITVNGAVLSCSGTRFAVDFQTGFSGNDIAFHFNPRFEDGGYVVCNTRQKGTWGPEERKMHMPFQKGMPFDLCFLVQSSDFKVMVNGSLFVQYFHRVPFHRVDTISVNGSVQLSYISFQNPRAVPVQPAFSTVPFSQPVCFPPRPRGRRQKPPSVRPANPAPITQTVIHTVQSASGQMFSQTPAIPPMMYPHPAYPMPFITTIPGGLYPSKSIILSGTVLPSAQRFHINLCSGSHIAFHMNPRFDENAVVRNTQINNSWGSEERSLPRKMPFVRGQSFSVWILCEAHCLKVAVDGQHVFEYYHRLRNLPTINKLEVGGDIQLTHVQT

SEQ ID NO: 45277 - protein, 75 aa, Homo sapiens
  Payload ID: 9225
  Gene Symbol: LGALS9C
  Gene Name: lectin, galactoside-binding, soluble, 9C
  ENSP ID: ENSP00000461967
MAFSGCQAPYLSPAVPFSGTIQGGLQDGFQITVNGAVLSCSGTRRRVCGVQHEAERNMGARGEEDAHALPEGDAL

SEQ ID NO: 45278 - protein, 53 aa, Homo sapiens
  Payload ID: 9225
  Gene Symbol: LGALS9C
  Gene Name: lectin, galactoside-binding, soluble, 9C
  ENSP ID: ENSP00000462660
PEERKMHMPFQKGMPFDLCFLVQSSDFKEHGWSWKPLQEQKTKHRKFSLISRS

SEQ ID NO: 45279 - protein, 323 aa, Homo sapiens
  Payload ID: 9225
  Gene Symbol: LGALS9C
  Gene Name: lectin, galactoside-binding, soluble, 9C
  ENSP ID: ENSP00000462708
MAFSGCQAPYLSPAVPFSGTIQGGLQDGFQITVNGAVLSCSGTRFAVDFQTGFSGNDIAFHFNPRFEDGGYVVCNTRQKGTWGPEERKMHMPFQKGMPFDLCFLVQSSDFKVMVNGSLFVQYFHRVPFHRVDTISVNGSVQLSYISFQPPSVRPANPAPITQTVIHTVQSASGQMFSTPAIPPMMYPHPAYPMPFITTIPGGLYPSKSIILSGTVLPSAQRFHINLCSGSHIAFHMNPRFDENAVVRNTQINNSWGSEERSLPRKMPFVRGQSFSVWILCEAHCLKVAVDGQHVFEYYHRLRNLPTINKLEVGGDIQLTHVQT

SEQ ID NO: 45280 - protein, 234 aa, Homo sapiens
  Payload ID: 9225
  Gene Symbol: LGALS9C
  Gene Name: lectin, galactoside-binding, soluble, 9C
  ENSP ID: ENSP00000462760
MAFSGCQAPYLSPAVPFSGTIQGGLQDGFQITVNGAVLSCSGTRFAVDFQTGFSGNDIAFHFNPRFEDGGYVVCNTRQKGTWGPEERKMHMPFQKGMPFDLCFLVQSSDFKVMVNGSLFVQYFHRVPFHRVDTISVNGSVQLSYISFQTQTVIHTVQSASGQMFSTPAIPPMMYPHPAYPMPFITTIPGGLYPSKSIILSGTVLPSAQRCGSCVKLTASRWPWMVSTCLNTTIA

SEQ ID NO: 45281 - protein, 75 aa, Homo sapiens; identical to SEQ ID NO: 45277
  Payload ID: 9225
  Gene Symbol: LGALS9C
  Gene Name: lectin, galactoside-binding, soluble, 9C
  ENSP ID: ENSP00000462967

SEQ ID NO: 45282 - protein, 35 aa, Homo sapiens
  Payload ID: 9225
  Gene Symbol: LGALS9C
  Gene Name: lectin, galactoside-binding, soluble, 9C
  ENSP ID: ENSP00000463209
MAFSGCQAPYLSPVCCGLSDGLQWKRHCLPLQPSV

SEQ ID NO: 45283 - protein, 246 aa, Homo sapiens
  Payload ID: 9225
  Gene Symbol: LGALS9C
  Gene Name: lectin, galactoside-binding, soluble, 9C
  ENSP ID: ENSP00000464108
MAFSGCQAPYLSPAVPFSGTIQGGLQDGFQITVNGAVLSCSGTRFAVDFQTGFSGNDIAFHFNPRFEDGGYVVCNTRQKGTWGPEERKMHMPFQKGMPFDLCFLVQSSDFKVMVNGSLFVQYFHRVPFHRVDTISVNGSVQLSYISFQPPSVRPANPAPITQTVIHTVQSASGQMFSTPAIPPMMYPHPAYPMPFITTIPGGLYPSKSIILSGTVLPSAQRCGSCVKLTASRWPWMVSTCLNTTIA

SEQ ID NO: 45284 - protein, 175 aa, Homo sapiens
  Payload ID: 9225
  Gene Symbol: LGALS9C
  Gene Name: lectin, galactoside-binding, soluble, 9C
  ENSP ID: ENSP00000464682
MAFSGCQAPYLSPAVPFSGTIQGGLQDGFQITVNGAVLSCSGTRFAVDFQTGFSGNDIAFHFNPRFEDGGYVVCNTRQKGTWGPEERKMHMPFQKGMPFDLCFLVQSSDFKVMVNGSLFVQYFHRVPFHRVDTISVNGSVQLSYISFQPMPFITTIPGGLYPSKSIILSGTVLPS

SEQ ID NO: 45285 - protein, 172 aa, Homo sapiens
  Payload ID: 9226
  Gene Symbol: LGALSL
  Gene Name: lectin, galactoside-binding-like
  Uniprot ID: Q3ZCW2
  ENSP ID: ENSP00000238875
MAGSVADSDAVVKLDDGHLNNSLSSPVQADVYFPRLIVPFCGHIKGGMRPGKKVLVMGIVDLNPESFAISLTCGDSEDPPADVAIELKAVFTDRQLLRNSCISGERGEEQSAIPYFPFIPDQPFRVEILCEHPRFRVFVDGHQLFDFYHRIQTLSAIDTIKINGDLQITKLG

SEQ ID NO: 45286 - protein, 100 aa, Homo sapiens
  Payload ID: 9226
  Gene Symbol: LGALSL
  Gene Name: lectin, galactoside-binding-like
  ENSP ID: ENSP00000386242
MAGSVADSDAVVKLDDGHLNNSLSSPVQADVYFPRLIVPFCGHIKGGMRPGKKVLVMGIVDLNPERWKFFVSTHVSECLWMDTNFLIFTIAFKRYLQLTP

SEQ ID NO: 45287 - protein, 77 aa, Homo sapiens
  Payload ID: 9226
  Gene Symbol: LGALSL
  Gene Name: lectin, galactoside-binding-like
  ENSP ID: ENSP00000407486
MAGSVADSDAVVKLDDGHLNNSLSSPVQADVYFPRLIVPFCGHIKGGMRPGKKVLVMGIVDLNPESGMIFFSALQSA

SEQ ID NO: 45288 - protein, 125 aa, Homo sapiens
  Payload ID: 9226
  Gene Symbol: LGALSL
  Gene Name: lectin, galactoside-binding-like
  ENSP ID: ENSP00000475643
MAGSVADSDAVVKLDDGHLNNSLSSPVQADVYFPRLIVPFCGHIKGGMRPGKKVLVMGIVDLNPESFAISLTCGDSEDPPADVAIELKAVFTDRQLLRNSCISGERGEEQSAIPYFPFIPDQPFR

SEQ ID NO: 45289 - protein, 53 aa, Homo sapiens
  Payload ID: 9226
  Gene Symbol: LGALSL
  Gene Name: lectin, galactoside-binding-like
  ENSP ID: ENSP00000476226
MAGSVADSDAVVLCNQLDLWGLRRPSCRCGNRTQSCVHRSAATQKFLYIWGEG

SEQ ID NO: 45290 - protein, 356 aa, Homo sapiens
  Payload ID: 9227
  Gene Symbol: LMAN2
  Gene Name: lectin, mannose-binding 2
  Uniprot ID: Q12907
  ENSP ID: ENSP00000303366
MAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDLSDNHDIISMKLFQLMVEHTPDEESIDWTKIEPSVNFLKSPKDNVDDPTGNFRSGPLTGWRVFLLLLCALLGIVVCAVVGAVVFQKRQERNKRFY

SEQ ID NO: 45291 - protein, 325 aa, Homo sapiens
  Payload ID: 9227
  Gene Symbol: LMAN2
  Gene Name: lectin, mannose-binding 2
  ENSP ID: ENSP00000423998
MAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDLSDNHDIISMKLFQLMVEHTPDEESIDWTKIEPSVNFLKSPKAPPFLLPQTTWTTPRGTSAAGP

SEQ ID NO: 45292 - protein, 203 aa, Homo sapiens
  Payload ID: 9227
  Gene Symbol: LMAN2
  Gene Name: lectin, mannose-binding 2
  ENSP ID: ENSP00000424132
MAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTEHRLDQDRAQRQLPQVAQRQRGRPHGELPQRAP

SEQ ID NO: 45293 - protein, 288 aa, Homo sapiens
  Payload ID: 9227
  Gene Symbol: LMAN2
  Gene Name: lectin, mannose-binding 2
  ENSP ID: ENSP00000425229
MAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDLSDNHDIISMKLFQLMVEHTPDEESIDWTKIEPS

SEQ ID NO: 45294 - protein, 191 aa, Homo sapiens
  Payload ID: 9227
  Gene Symbol: LMAN2
  Gene Name: lectin, mannose-binding 2
  ENSP ID: ENSP00000427377
MPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDL

SEQ ID NO: 45295 - protein, 348 aa, Homo sapiens
  Payload ID: 9228
  Gene Symbol: LMAN2L
  Gene Name: lectin, mannose-binding 2-like
  Uniprot ID: Q9H0V9
  ENSP ID: ENSP00000264963
MAATLGPLGSWQQWRRCLSARDGSRMLLLLLLLGSGQGPQQVGAGQTFEYLKREHSLSKPYQGVGTGSSSLWNLMGNAMVMTQYIRLTPDMQSKQGALWNRVPCFLRDWELQVHFKIHGQGKKNLHGDGLAIWYTKDRMQPGPVFGNMDKFVGLGVFVDTYPNEEKQQERVFPYISAMVNNGSLSYDHERDGRPTELGGCTAIVRNLHYDTFLVIRYVKRHLTIMMDIDGKHEWRDCIEVPGVRLPRGYYFGTSSITGDLSDNHDVISLKLFELTVERTPEEEKLHRDVFLPSVDNMKLPEMTAPLPPLSGLALFLIVFFSLVFSVFAIVIGIILYNKWQEQSRKRFY

SEQ ID NO: 45296 - protein, 359 aa, Homo sapiens
  Payload ID: 9228
  Gene Symbol: LMAN2L
  Gene Name: lectin, mannose-binding 2-like
  Uniprot ID: Q9H0V9
  ENSP ID: ENSP00000366280
MAATLGPLGSWQQWRRCLSARDGSRMLLLLLLLGSGQGPQQVGAGQTFEYLKREHSLSKPYQGVGTGSSSLWNLMGNAMVMTQYIRLTPDMQSKQGALWNRVPCFLRDWELQVHFKIHGQGKKNLHGDGLAIWYTKDRMQPGPVFGNMDKFVGLGVFVDTYPNEEKQQEAQKRRYSPGVQRVFPYISAMVNNGSLSYDHERDGRPTELGGCTAIVRNLHYDTFLVIRYVKRHLTIMMDIDGKHEWRDCIEVPGVRLPRGYYFGTSSITGDLSDNHDVISLKLFELTVERTPEEEKLHRDVFLPSVDNMKLPEMTAPLPPLSGLALFLIVFFSLVFSVFAIVIGIILYNKWQEQSRKRFY

SEQ ID NO: 45297 - protein, 123 aa, Homo sapiens
  Payload ID: 9228
  Gene Symbol: LMAN2L
  Gene Name: lectin, mannose-binding 2-like
  ENSP ID: ENSP00000387717
MAATLGPLGSWQQWRRCLSARDGSRMLLLLLLLGSGQGPQQVGAGQTFEYLKREHSLSKPYQAMFPERLGVAGALQNPWTRKEESAWGWLGNLVHKGSDAARACVWKHGQICGAGSICRHLPQ

SEQ ID NO: 45298 - protein, 123 aa, Homo sapiens; identical to SEQ ID NO: 45297
  Payload ID: 9228
  Gene Symbol: LMAN2L
  Gene Name: lectin, mannose-binding 2-like
  ENSP ID: ENSP00000390197

SEQ ID NO: 45299 - protein, 111 aa, Homo sapiens
  Payload ID: 9228
  Gene Symbol: LMAN2L
  Gene Name: lectin, mannose-binding 2-like
  ENSP ID: ENSP00000403283
MAATLGPLGSWQQWRRCLSARDGSRMLLLLLLLGSGQGPQQVGAGQTFEYLKREHSLSKPYQAMFPERLGVAGALQNPWTRKEESAWGWLGNLVHKGSDAASGYSPTSQPW

SEQ ID NO: 45300 - protein, 107 aa, Homo sapiens
  Payload ID: 9228
  Gene Symbol: LMAN2L
  Gene Name: lectin, mannose-binding 2-like
  ENSP ID: ENSP00000413533
MAATLGPLGSWQQWRRCLSARDGSRMLLLLLLLGSGQGPQQVGAGQTFEYLKREHSLSKPYQGVGTGSSSLWNLMGNAMVMTQYIRLTPDMQSKQGALWNRVLHCLP

SEQ ID NO: 45301 - protein, 169 aa, Homo sapiens
  Payload ID: 9228
  Gene Symbol: LMAN2L
  Gene Name: lectin, mannose-binding 2-like
  ENSP ID: ENSP00000417037
MAATLGPLGSWQQWRRCLSARDGSRMLLLLLLLGSGQGPQQVGAGQTFEYLKREHSLSKPYQGVGTGSSSLWNLMGNAMVMTQYIRLTPDMQSKQGALWNRVPCFLRDWELQVHFKIHGQGKKNLHGDGLAIWYTKDRMQPGPEEAIFSRSPAGIPLHLSHGEQRLPQL

SEQ ID NO: 45302 - protein, 510 aa, Homo sapiens
  Payload ID: 9229
  Gene Symbol: LMAN1
  Gene Name: lectin, mannose-binding, 1
  Uniprot ID: P49257
  ENSP ID: ENSP00000251047
MAGSRQRGLRARVRPLFCALLLSLGRFVRGDGVGGDPAVALPHRRFEYKYSFKGPHLVQSDGTVPFWAHAGNAIPSSDQIRVAPSLKSQRGSVWTKTKAAFENWEVEVTFRVTGRGRIGADGLAIWYAENQGLEGPVFGSADLWNGVGIFFDSFDNDGKKNNPAIVIIGNNGQIHYDHQNDGASQALASCQRDFRNKPYPVRAKITYYQNTLTVMINNGFTPDKNDYEFCAKVENMIIPAQGHFGISAATGGLADDHDVLSFLTFQLTEPGKEPPTPDKEISEKEKEKYQEEFEHFQQELDKKKEEFQKGHPDLQGQPAEEIFESVGDRELRQVFEGQNRIHLEIKQLNRQLDMILDEQRRYVSSLTEEISKRGAGMPGQHGQITQQELDTVVKTQHEILRQVNEMKNSMSETVRLVSGMQHPGSAGGVYETTQHFIDIKEHLHIVKRDIDNLVQRNMPSNEKPKCPELPPFPSCLSTVHFIIFVVVQTVLFIGYIMYRSQQEAAAKKFF

SEQ ID NO: 45303 - protein, 526 aa, Homo sapiens
  Payload ID: 9230
  Gene Symbol: LMAN1L
  Gene Name: lectin, mannose-binding, 1 like
  Uniprot ID: Q9HAT1
  ENSP ID: ENSP00000310431
MPAVSGPGPLFCLLLLLLDPHSPETGCPPLRRFEYKLSFKGPRLALPGAGIPFWSHHGDAILGLEEVRLTPSMRNRSGAVWSRASVPFSAWEVEVQMRVTGLGRRGAQGMAVWYTRGRGHVGSVLGGLASWDGIGIFFDSPAEDTQDSPAIRVLASDGHIPSEQPGDGASQGLGSCHWDFRNRPHPFRARITYWGQRLRMSLNSGLTPSDPGEFCVDVGPLLLVPGGFFGVSAATGTLADDHDVLSFLTFSLSEPSPEVPPQPFLEMQQLRLARQLEGLWARLGLGTREDVTPKSDSEAQGEGERLFDLEETLGRHRRILQALRGLSKQLAQAERQWKKQLGPPGQARPDGGWALDASCQIPSTPGRGGHLSMSLNKDSAKVGALLHGQWTLLQALQEMRDAAVRMAAEAQVSYLPVGIEHHFLELDHILGLLQEELRGPAKAAAKAPRPPGQPPRASSCLQPGIFLFYLLIQTVGFFGYVHFRQELNKSLQECLSTGSLPLGPAPHTPRALGILRRQPLPASMPA

SEQ ID NO: 45304 - protein, 514 aa, Homo sapiens
  Payload ID: 9230
  Gene Symbol: LMAN1L
  Gene Name: lectin, mannose-binding, 1 like
  Uniprot ID: Q9HAT1
  ENSP ID: ENSP00000369031
MPAVSGPGPLFCLLLLLLDPHSPETGCPPLRRFEYKLSFKGPRLALPGAGIPFWSHHGDAILGLEEVRLTPSMRNRSGAVWSRASVPFSAWEVEVQMRVTGLGRRGAQGMAVWYTRGRGHVGSVLGGLASWDGIGIFFDSPAEDTQDSPAIRVLASDGHIPSEQPGDGASQGLGSCHWDFRNRPHPFRARITYWGQRLRMSLNSGLTPSDPGEFCVDVGPLLLVPGGFFGVSAATGTLAGEDPTGQVPPQPFLEMQQLRLARQLEGLWARLGLGTREDVTPKSDSEAQGEGERLFDLEETLGRHRRILQALRGLSKQLAQAERQWKKQLGPPGQARPDGGWALDASCQIPSTPGRGGHLSMSLNKDSAKVGALLHGQWTLLQALQEMRDAAVRMAAEAQVSYLPVGIEHHFLELDHILGLLQEELRGPAKAAAKAPRPPGQPPRASSCLQPGIFLFYLLIQTVGFFGYVHFRQELNKSLQECLSTGSLPLGPAPHTPRALGILRRQPLPASMPA

SEQ ID NO: 45305 - protein, 123 aa, Homo sapiens
  Payload ID: 9230
  Gene Symbol: LMAN1L
  Gene Name: lectin, mannose-binding, 1 like
  ENSP ID: ENSP00000454716
LQALRGLSKQLAQAERQWKKQLGPPGQARPDGGWALDASCQIPSTPGRGGHLSMSLNKDSAKVGALLHGQWTLLQALQEMRQELNKSLQECLSTGSLPLGPAPHTPRALGILRRQPLPASMPA

SEQ ID NO: 45306 - protein, 109 aa, Homo sapiens
  Payload ID: 9230
  Gene Symbol: LMAN1L
  Gene Name: lectin, mannose-binding, 1 like
  ENSP ID: ENSP00000456650
MRTGGYLEGSILIPDAILGLEEVRLTPSMRNRSGAVWSRASVPFSAWEVEVQMRVTGLGRRGAQGMAVWYTRGRGHVGSVLGGLASWDGIGIFFDSPAEDTQDSPAIRV

SEQ ID NO: 45307 - protein, 366 aa, Homo sapiens
  Payload ID: 9231
  Gene Symbol: LEFTY1
  Gene Name: left-right determination factor 1
  Uniprot ID: O75610
  ENSP ID: ENSP00000272134
MQPLWLCWALWVLPLASPGAALTGEQLLGSLLRQLQLKEVPTLDRADMEELVIPTHVRAQYVALLQRSHGDRSRGKRFSQSFREVAGRFLALEASTHLLVFGMEQRLPPNSELVQAVLRLFQEPVPKAALHRHGRLSPRSARARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLGDYGAQGDCDPEAPMTEGTRCCRQEMYIDLQGMKWAENWVLEPPGFLAYECVGTCRQPPEALAFKWPFLGPRQCIASETDSLPMIVSIKEGGRTRPQVVSLPNMRVQKCSCASDGALVPRRLQP

SEQ ID NO: 45308 - protein, 64 aa, Homo sapiens
  Payload ID: 9231
  Gene Symbol: LEFTY1
  Gene Name: left-right determination factor 1
  ENSP ID: ENSP00000479837
MEQRLPPNSELVQAVLRLFQEPVPKAALHRHGRLSPRSARARVTVEWLRVRDDGSNRTSLIDSR

SEQ ID NO: 45309 - protein, 366 aa, Homo sapiens
  Payload ID: 9232
  Gene Symbol: LEFTY2
  Gene Name: left-right determination factor 2
  Uniprot ID: O00292
  ENSP ID: ENSP00000355785
MWPLWLCWALWVLPLAGPGAALTEEQLLGSLLRQLQLSEVPVLDRADMEKLVIPAHVRAQYVVLLRRSHGDRSRGKRFSQSFREVAGRFLASEASTHLLVFGMEQRLPPNSELVQAVLRLFQEPVPKAALHRHGRLSPRSAQARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLRDYGAQGDCDPEAPMTEGTRCCRQEMYIDLQGMKWAKNWVLEPPGFLAYECVGTCQQPPEALAFNWPFLGPRQCIASETASLPMIVSIKEGGRTRPQVVSLPNMRVQKCSCASDGALVPRRLQP

SEQ ID NO: 45310 - protein, 332 aa, Homo sapiens
  Payload ID: 9232
  Gene Symbol: LEFTY2
  Gene Name: left-right determination factor 2
  Uniprot ID: O00292
  ENSP ID: ENSP00000388009
MWPLWLCWALWVLPLAGPGAALTEEQLLGSLLRQLQLSEVPVLDRADMEKLVIPAHVRAQYVVLLRRSHGDRSRGKRFSQSFREVAGRFLASEAALHRHGRLSPRSAQARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLRDYGAQGDCDPEAPMTEGTRCCRQEMYIDLQGMKWAKNWVLEPPGFLAYECVGTCQQPPEALAFNWPFLGPRQCIASETASLPMIVSIKEGGRTRPQVVSLPNMRVQKCSCASDGALVPRRLQP

SEQ ID NO: 45311 - protein, 372 aa, Homo sapiens
  Payload ID: 9232
  Gene Symbol: LEFTY2
  Gene Name: left-right determination factor 2
  ENSP ID: ENSP00000484300
MWPLWLCWALWVLPLAGPGAALTEEQLLGSLLRQLQLSEVPVLDRADMEKLVIPAHVRAQYVVLLRRSHGDRSRGKRFSQSFREVAGRFLASEASTHLLVFGMEQRLPPNSELVQAVLRLFQEPVPKAALHRHGRLSPRSAQARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLRDYGAQGDCDPEAPMTEGTRCCRQEMYIDLQGMKWAKNWVLEPPGFLAYECVGTCQQPPEALAFNWPFLGPRQCIASETASLPMIVSIKEGGRTRPQVVSLPNMRVQKCSCASDGALVPRRLQHRAWCIH

SEQ ID NO: 45312 - protein, 433 aa, Homo sapiens
  Payload ID: 9233
  Gene Symbol: LGMN
  Gene Name: legumain
  Uniprot ID: Q99538
  ENSP ID: ENSP00000334052
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDARHLIEKSVRKIVSLLAASEAEVEQLLSERAPLTGHSCYPEALLHFRTHCFNWHSPTYEYALRHLYVLVNLCEKPYPLHRIKLSMDHVCLGHY

SEQ ID NO: 45313 - protein, 433 aa, Homo sapiens; identical to SEQ ID NO: 45312
  Payload ID: 9233
  Gene Symbol: LGMN
  Gene Name: legumain
  Uniprot ID: Q99538
  ENSP ID: ENSP00000376911

SEQ ID NO: 45314 - protein, 48 aa, Homo sapiens
  Payload ID: 9233
  Gene Symbol: LGMN
  Gene Name: legumain
  ENSP ID: ENSP00000450483
MVWKVAVFLSVALGIGAVPIDDPEDGGKHWVVIVAGSNGWYNYRHQEL

SEQ ID NO: 45315 - protein, 19 aa, Homo sapiens
  Payload ID: 9233
  Gene Symbol: LGMN
  Gene Name: legumain
  ENSP ID: ENSP00000450619
MVWKVAVFLSVALGIGAVP

SEQ ID NO: 45316 - protein, 78 aa, Homo sapiens
  Payload ID: 9233
  Gene Symbol: LGMN
  Gene Name: legumain
  ENSP ID: ENSP00000450677
MVWKVAVFLSVALGIGAVPIDDPEDGGKHWVVIVAGSNGWYNYRHQADACHAYQIIHRNGIPDEQIVVMMYDDIAYSE

SEQ ID NO: 45317 - protein, 135 aa, Homo sapiens
  Payload ID: 9233
  Gene Symbol: LGMN
  Gene Name: legumain
  ENSP ID: ENSP00000450854
MVWKVAVFLSVALGIGAVPIDDPEDGGKHWVVIVAGSNGWYNYRHQADACHAYQIIHRNGIPDEQIVVMINPTPGIVINRPNGTDVYQGVPKDYTGEDVTPQNFLAVLRGDAEAVKGIGSGKVLKSGPQDHVFIY

SEQ ID NO: 45318 - protein, 117 aa, Homo sapiens
  Payload ID: 9233
  Gene Symbol: LGMN
  Gene Name: legumain
  ENSP ID: ENSP00000451507
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEWPPGSRVHLLH

SEQ ID NO: 45319 - protein, 223 aa, Homo sapiens
  Payload ID: 9233
  Gene Symbol: LGMN
  Gene Name: legumain
  ENSP ID: ENSP00000451746
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINGRWLGRRPRPGLASRLLRHR

SEQ ID NO: 45320 - protein, 57 aa, Homo sapiens
  Payload ID: 9233
  Gene Symbol: LGMN
  Gene Name: legumain
  ENSP ID: ENSP00000451797
MVWKVAVFLSVALGIGAVPIDDPEDGGKHWVVIVAGSNGWYNYRHQADACHAYQIIH

SEQ ID NO: 45321 - protein, 91 aa, Homo sapiens
  Payload ID: 9233
  Gene Symbol: LGMN
  Gene Name: legumain
  ENSP ID: ENSP00000451854
  MOD_RES (1)..(1): Any amino acid
XPTPGIVINRPNGTDVYQGVPKDYTGEDVTPQNFLAVLRGGVRSLRCSGPPGEPPLQGSLQDLLHKMTCSLLPASPVFSEKLQIRVGKALY

SEQ ID NO: 45322 - protein, 372 aa, Homo sapiens
  Payload ID: 9233
  Gene Symbol: LGMN
  Gene Name: legumain
  Uniprot ID: Q99538
  ENSP ID: ENSP00000451861
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDDKIVHGPRVPWSLLKSCLLEAFPSVSAPPTVC

SEQ ID NO: 45323 - protein, 78 aa, Homo sapiens; identical to SEQ ID NO: 45316
  Payload ID: 9233
  Gene Symbol: LGMN
  Gene Name: legumain
  ENSP ID: ENSP00000451916

SEQ ID NO: 45324 - protein, 57 aa, Homo sapiens; identical to SEQ ID NO: 45320
  Payload ID: 9233
  Gene Symbol: LGMN
  Gene Name: legumain
  ENSP ID: ENSP00000452268

SEQ ID NO: 45325 - protein, 376 aa, Homo sapiens
  Payload ID: 9233
  Gene Symbol: LGMN
  Gene Name: legumain
  Uniprot ID: Q99538
  ENSP ID: ENSP00000452572
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDYEYALRHLYVLVNLCEKPYPLHRIKLSMDHVCLGHY

SEQ ID NO: 45326 - protein, 600 aa, Homo sapiens
  Payload ID: 9234
  Gene Symbol: LMOD1
  Gene Name: leiomodin 1 (smooth muscle)
  Uniprot ID: P29536
  ENSP ID: ENSP00000356257
MSRVAKYRRQVSEDPDIDSLLETLSPEEMEELEKELDVVDPDGSVPVGLRQRNQTEKQSTGVYNREAMLNFCEKETKKLMQREMSMDESKQVETKTDAKNGEERGRDASKKALGPRRDSDLGKEPKRGGLKKSFSRDRDEAGGKSGEKPKEEKIIRGIDKGRVRAAVDKKEAGKDGRGEERAVATKKEEEKKGSDRNTGLSRDKDKKREEMKEVAKKEDDEKVKGERRNTDTRKEGEKMKRAGGNTDMKKEDEKVKRGTGNTDTKKDDEKVKKNEPLHEKEAKDDSKTKTPEKQTPSGPTKPSEGPAKVEEEAAPSIFDEPLERVKNNDPEMTEVNVNNSDCITNEILVRFTEALEFNTVVKLFALANTRADDHVAFAIAIMLKANKTITSLNLDSNHITGKGILAIFRALLQNNTLTELRFHNQRHICGGKTEMEIAKLLKENTTLLKLGYHFELAGPRMTVTNLLSRNMDKQRQKRLQEQRQAQEAKGEKKDLLEVPKAGAVAKGSPKPSPQPSPKPSPKNSPKKGGAPAAPPPPPPPLAPPLIMENLKNSLSPATQRKMGDKVLPAQEKNSRDQLLAAIRSSNLKQLKKVEVPKLLQ

SEQ ID NO: 45327 - protein, 269 aa, Homo sapiens
  Payload ID: 9234
  Gene Symbol: LMOD1
  Gene Name: leiomodin 1 (smooth muscle)
  ENSP ID: ENSP00000480209
MEELEKELDVVDPDGSVPVGLRQRNQTEKQSTGVYNREAMLNFCEKETKKLMQREMSMDESKQVETKTDAKNGEERGRDASKKALGPRRDSDLGKEPKRGGLKKSFSRDRDEAGGKSGEKPKEEKIIRGIDKGRVRAAVDKKEAGKDGRGEERAVATKKEEEKKGSDRNTGLSRDKDKKREEMKEVAKKEDDEKVKGGAPAAPPPPPPPLAPPLIMENLKNSLSPATQRKMGDKVLPAQEKNSRDQLLAAIRSSNLKQLKKVEVPKLLQ

SEQ ID NO: 45328 - protein, 159 aa, Homo sapiens
  Payload ID: 9235
  Gene Symbol: LMOD2
  Gene Name: leiomodin 2 (cardiac)
  ENSP ID: ENSP00000398975
MSTFGYRRGLSKYESIDEDELLASLSAEELKELERELEDIEPDRNLPVGLRQKSLTEKTPTGTFSREALMAYWEKESQKLLEKERLGECGKVKKQPNSILKEIKNSLRSVQEKKMEDSSRPSTPQRSAHENLMEAIRGSSIKQLKRVSNQRTDIGAQIK

SEQ ID NO: 45329 - protein, 547 aa, Homo sapiens
  Payload ID: 9235
  Gene Symbol: LMOD2
  Gene Name: leiomodin 2 (cardiac)
  Uniprot ID: Q6P5Q4
  ENSP ID: ENSP00000411932
MSTFGYRRGLSKYESIDEDELLASLSAEELKELERELEDIEPDRNLPVGLRQKSLTEKTPTGTFSREALMAYWEKESQKLLEKERLGECGKVAEDKEESEEELIFTESNSEVSEEVYTEEEEEESQEEEEEEDSDEEERTIETAKGINGTVNYDSVNSDNSKPKIFKSQIENINLTNGSNGRNTESPAAIHPCGNPTVIEDALDKIKSNDPDTTEVNLNNIENITTQTLTRFAEALKDNTVVKTFSLANTHADDSAAMAIAEMLKVNEHITNVNVESNFITGKGILAIMRALQHNTVLTELRFHNQRHIMGSQVEMEIVKLLKENTTLLRLGYHFELPGPRMSMTSILTRNMDKQRQKRLQEQKQQEGYDGGPNLRTKVWQRGTPSSSPYVSPRHSPWSSPKLPKKVQTVRSRPLSPVATPPPPPPPPPPPPPSSQRLPPPPPPPPPPLPEKKLITRNIAEVIKQQESAQRALQNGQKKKKGKKVKKQPNSILKEIKNSLRSVQEKKMEDSSRPSTPQRSAHENLMEAIRGSSIKQLKRVEVPEALR

SEQ ID NO: 45330 - protein, 560 aa, Homo sapiens
  Payload ID: 9236
  Gene Symbol: LMOD3
  Gene Name: leiomodin 3 (fetal)
  Uniprot ID: Q0VAK6
  ENSP ID: ENSP00000414670
MSEHSRNSDQEELLDEEINEDEILANLSAEELKELQSEMEVMAPDPSLPVGMIQKDQTDKPPTGNFNHKSLVDYMYWEKASRRMLEEERVPVTFVKSEEKTQEEHEEIEKRNKNMAQYLKEKLNNEIVANKRESKGSSNIQETDEEDEEEEDDDDDDEGEDDGEESEETNREEEGKAKEQIRNCENNCQQVTDKAFKEQRDRPEAQEQSEKKISKLDPKKLALDTSFLKVSTRPSGNQTDLDGSLRRVRKNDPDMKELNLNNIENIPKEMLLDFVNAMKKNKHIKTFSLANVGADENVAFALANMLRENRSITTLNIESNFITGKGIVAIMRCLQFNETLTELRFHNQRHMLGHHAEMEIARLLKANNTLLKMGYHFELPGPRMVVTNLLTRNQDKQRQKRQEEQKQQQLKEQKKLIAMLENGLGLPPGMWELLGGPKPDSRMQEFFQPPPPRPPNPQNVPFSQRSEMMKKPSQAPKYRTDPDSFRVVKLKRIQRKSRMPEAREPPEKTNLKDVIKTLKPVPRNRPPPLVEITPRDQLLNDIRHSSVAYLKPVQLPKELA

SEQ ID NO: 45331 - protein, 560 aa, Homo sapiens; identical to SEQ ID NO: 45330
  Payload ID: 9236
  Gene Symbol: LMOD3
  Gene Name: leiomodin 3 (fetal)
  Uniprot ID: Q0VAK6
  ENSP ID: ENSP00000417210

SEQ ID NO: 45332 - protein, 560 aa, Homo sapiens; identical to SEQ ID NO: 45330
  Payload ID: 9236
  Gene Symbol: LMOD3
  Gene Name: leiomodin 3 (fetal)
  Uniprot ID: Q0VAK6
  ENSP ID: ENSP00000418645

SEQ ID NO: 45333 - protein, 603 aa, Homo sapiens
  Payload ID: 9237
  Gene Symbol: LMLN
  Gene Name: leishmanolysin-like (metallopeptidase M8 family)
  ENSP ID: ENSP00000328611
MGRRSGLLGLRPGPEPVALERVINKVHLKANHVVKRDVDEHLRIKTVYDKSVEELLPEKKNLVKNKLFPQAISYLEKTFQVRRPAGTILLSRQCATNQYLRKENDPHRYCTGECAAHTKCGPVIVPEEHLQQCRVYRGGKWPHGAVGVPDQEGISDADFVLYVGALATERCSHENIISYAAYCQQEANMDRPIAGYANLCPNMISTQPQEFVGMLSTVKHEVIHALGFSAGLFAFYHDKDGNPLTSRFADGLPPFNYSLGLYQWSDKVVRKVERLWDVRDNKIVRHTVYLLVTPRVVEEARKHFDCPVLEGMELENQGGVGTELNHWEKRLLENEAMTGSHTQNRVLSRITLALMEDTGRQMLSPYCDTLRSNPLQLTCRQDQRAVAVCNLQKFPKPLPQEYQYFDELSGIPAEDLPYYGGSVEIADYCPFSQEFSWHLSGEYQRSSDCRILENQPEIFKNYGAEKYGPHSVCLIQKSAFVMEKCERKLSYPDWGSGCYQVSCSPQGLKVWVQDTSYLCSRAGQVLPVSIQMNGWIHDGNLLCPSCWDFCELCPPETDPPATNLTRALPLDLCSCSSSLVVTLWLLLGNLFPLLAGFLLCIWH

SEQ ID NO: 45334 - protein, 655 aa, Homo sapiens
  Payload ID: 9237
  Gene Symbol: LMLN
  Gene Name: leishmanolysin-like (metallopeptidase M8 family)
  Uniprot ID: Q96KR4
  ENSP ID: ENSP00000328829
MVTTLGPKMAAEWGGGVGYSGSGPGRSRWRWSGSVWVRSVLLLLGGLRASATSTPVSLGSSPPCRHHVPSDTEVINKVHLKANHVVKRDVDEHLRIKTVYDKSVEELLPEKKNLVKNKLFPQAISYLEKTFQVRRPAGTILLSRQCATNQYLRKENDPHRYCTGECAAHTKCGPVIVPEEHLQQCRVYRGGKWPHGAVGVPDQEGISDADFVLYVGALATERCSHENIISYAAYCQQEANMDRPIAGYANLCPNMISTQPQEFVGMLSTVKHEVIHALGFSAGLFAFYHDKDGNPLTSRFADGLPPFNYSLGLYQWSDKVVRKVERLWDVRDNKIVRHTVYLLVTPRVVEEARKHFDCPVLEGMELENQGGVGTELNHWEKRLLENEAMTGSHTQNRVLSRITLALMEDTGRQMLSPYCDTLRSNPLQLTCRQDQRAVAVCNLQKFPKPLPQEYQYFDELSGIPAEDLPYYGGSVEIADYCPFSQEFSWHLSGEYQRSSDCRILENQPEIFKNYGAEKYGPHSVCLIQKSAFVMEKCERKLSYPDWGSGCYQVSCSPQGLKVWVQDTSYLCSRAGQVLPVSIQMNGWIHDGNLLCPSCWDFCELCPPETDPPATNLTRALPLDLCSCSSSLVVTLWLLLGNLFPLLAGFLLCIWH

SEQ ID NO: 45335 - protein, 151 aa, Homo sapiens
  Payload ID: 9237
  Gene Symbol: LMLN
  Gene Name: leishmanolysin-like (metallopeptidase M8 family)
  ENSP ID: ENSP00000390872
MVINKVHLKANHVVKRDVDEHLRIKTVYDKSVEELLPEKKNLVKNKLFPQAISYLEKTFQVRRPAGTILLSRQCATNQYLRKENDPHRYCTGECAAHTKCGPVIVPEEHLQQCRVYRGGKWPHGAVGVPDQEGISDADFVLYVGALATERC

SEQ ID NO: 45336 - protein, 692 aa, Homo sapiens
  Payload ID: 9237
  Gene Symbol: LMLN
  Gene Name: leishmanolysin-like (metallopeptidase M8 family)
  Uniprot ID: Q96KR4
  ENSP ID: ENSP00000410926
MVTTLGPKMAAEWGGGVGYSGSGPGRSRWRWSGSVWVRSVLLLLGGLRASATSTPVSLGSSPPCRHHVPSDTEVINKVHLKANHVVKRDVDEHLRIKTVYDKSVEELLPEKKNLVKNKLFPQAISYLEKTFQVRRPAGTILLSRQCATNQYLRKENDPHRYCTGECAAHTKCGPVIVPEEHLQQCRVYRGGKWPHGAVGVPDQEGISDADFVLYVGALATERCSHENIISYAAYCQQEANMDRPIAGYANLCPNMISTQPQEFVGMLSTVKHEVIHALGFSAGLFAFYHDKDGNPLTSRFADGLPPFNYSLGLYQWSDKVVRKVERLWDVRDNKIVRHTVYLLVTPRVVEEARKHFDCPVLEGMELENQGGVGTELNHWEKRLLENEAMTGSHTQNRVLSRITLALMEDTGWYKANYSMAEKLDWGRGMGCDFVRKSCKFWIDQQRQKRQMLSPYCDTLRSNPLQLTCRQDQRAVAVCNLQKFPKPLPQEYQYFDELSGIPAEDLPYYGGSVEIADYCPFSQEFSWHLSGEYQRSSDCRILENQPEIFKNYGAEKYGPHSVCLIQKSAFVMEKCERKLSYPDWGSGCYQVSCSPQGLKVWVQDTSYLCSRAGQVLPVSIQMNGWIHDGNLLCPSCWDFCELCPPETDPPATNLTRALPLDLCSCSSSLVVTLWLLLGNLFPLLAGFLLCIWH

SEQ ID NO: 45337 - protein, 640 aa, Homo sapiens
  Payload ID: 9237
  Gene Symbol: LMLN
  Gene Name: leishmanolysin-like (metallopeptidase M8 family)
  Uniprot ID: Q96KR4
  ENSP ID: ENSP00000418324
MGRRSGLLGLRPGPEPVALERVINKVHLKANHVVKRDVDEHLRIKTVYDKSVEELLPEKKNLVKNKLFPQAISYLEKTFQVRRPAGTILLSRQCATNQYLRKENDPHRYCTGECAAHTKCGPVIVPEEHLQQCRVYRGGKWPHGAVGVPDQEGISDADFVLYVGALATERCSHENIISYAAYCQQEANMDRPIAGYANLCPNMISTQPQEFVGMLSTVKHEVIHALGFSAGLFAFYHDKDGNPLTSRFADGLPPFNYSLGLYQWSDKVVRKVERLWDVRDNKIVRHTVYLLVTPRVVEEARKHFDCPVLEGMELENQGGVGTELNHWEKRLLENEAMTGSHTQNRVLSRITLALMEDTGWYKANYSMAEKLDWGRGMGCDFVRKSCKFWIDQQRQKRQMLSPYCDTLRSNPLQLTCRQDQRAVAVCNLQKFPKPLPQEYQYFDELSGIPAEDLPYYGGSVEIADYCPFSQEFSWHLSGEYQRSSDCRILENQPEIFKNYGAEKYGPHSVCLIQKSAFVMEKCERKLSYPDWGSGCYQVSCSPQGLKVWVQDTSYLCSRAGQVLPVSIQMNGWIHDGNLLCPSCWDFCELCPPETDPPATNLTRALPLDLCSCSSSLVVTLWLLLGNLFPLLAGFLLCIWH

SEQ ID NO: 45338 - protein, 67 aa, Homo sapiens
  Payload ID: 9238
  Gene Symbol: LEMD1
  Gene Name: LEM domain containing 1
  Uniprot ID: Q68G75
  ENSP ID: ENSP00000356117
MVDVKCLSDCKLQNQLEKLGFSPGPILRGLQEHQAPESHMGLSPKRETTARKTRLSRAGEKKVSQWA

SEQ ID NO: 45339 - protein, 181 aa, Homo sapiens
  Payload ID: 9238
  Gene Symbol: LEMD1
  Gene Name: LEM domain containing 1
  Uniprot ID: Q68G75
  ENSP ID: ENSP00000356119
MVDVKCLSDCKLQNQLEKLGFSPGPILPSTRKLYEKKLVQLLVSPPCAPPVMNGPRELDGAQDSDDSEELNIILQGNIILSTEKSKKLKKWPEASTTKRKAVDTYCLDYKPSKGRRWAARAPSTRITYGTITKERDYCAEDQTIESWREEGFPVGLKLAVLGIFIIVVFVYLTVENKSLFG

SEQ ID NO: 45340 - protein, 140 aa, Homo sapiens
  Payload ID: 9238
  Gene Symbol: LEMD1
  Gene Name: LEM domain containing 1
  Uniprot ID: Q68G75
  ENSP ID: ENSP00000356120
MVDVKCLSDCKLQNQLEKLGFSPGPILQLNIILQGNIILSTEKSKKLKKWPEASTTKRKAVDTYCLDYKPSKGRRWAARAPSTRITYGTITKERDYCAEDQTIESWREEGFPVGLKLAVLGIFIIVVFVYLTVENKSLFG

SEQ ID NO: 45341 - protein, 181 aa, Homo sapiens; identical to SEQ ID NO: 45339
  Payload ID: 9238
  Gene Symbol: LEMD1
  Gene Name: LEM domain containing 1
  Uniprot ID: Q68G75
  ENSP ID: ENSP00000356121

SEQ ID NO: 45342 - protein, 108 aa, Homo sapiens
  Payload ID: 9238
  Gene Symbol: LEMD1
  Gene Name: LEM domain containing 1
  Uniprot ID: Q68G75
  ENSP ID: ENSP00000356122
MVDVKCLSDCKLQNQLEKLGFSPGPILPSTRKLYEKKLVQLLVSPPCAPPVMNGPRELDGAQDSDDSEGGLQEHQAPESHMGLSPKRETTARKTRLSRAGEKKVSQWA

SEQ ID NO: 45343 - protein, 108 aa, Homo sapiens; identical to SEQ ID NO: 45342
  Payload ID: 9238
  Gene Symbol: LEMD1
  Gene Name: LEM domain containing 1
  Uniprot ID: Q68G75
  ENSP ID: ENSP00000375801

SEQ ID NO: 45344 - protein, 67 aa, Homo sapiens; identical to SEQ ID NO: 45338
  Payload ID: 9238
  Gene Symbol: LEMD1
  Gene Name: LEM domain containing 1
  Uniprot ID: Q68G75
  ENSP ID: ENSP00000479306

SEQ ID NO: 45345 - protein, 503 aa, Homo sapiens
  Payload ID: 9239
  Gene Symbol: LEMD2
  Gene Name: LEM domain containing 2
  Uniprot ID: Q8NC56
  ENSP ID: ENSP00000293760
MAGLSDLELRRELQALGFQPGPITDTTRDVYRNKLRRLRGEARLRDEERLREEARPRGEERLREEARLREDAPLRARPAAASPRAEPWLSQPASGSAYATPGAYGDIRPSAASWVGSRGLAYPARPAQLRRRASVRGSSEEDEDARTPDRATQGPGLAARRWWAASPAPARLPSSLLGPDPRPGLRATRAGPAGAARARPEVGRRLERWLSRLLLWASLGLLLVFLGILWVKMGKPSAPQEAEDNMKLLPVDCERKTDEFCQAKQKAALLELLHELYNFLAIQAGNFECGNPENLKSKCIPVMEAQEYIANVTSSSSAKFEAALTWILSSNKDVGIWLKGEDQSELVTTVDKVVCLESAHPRMGVGCRLSRALLTAVTNVLIFFWCLAFLWGLLILLKYRWRKLEEEEQAMYEMVKKIIDVVQDHYVDWEQDMERYPYVGILHVRDSLIPPQSRRRMKRVWDRAVEFLASNESRIQTESHRVAGEDMLVWRWTKPSSFSDSER

SEQ ID NO: 45346 - protein, 114 aa, Homo sapiens
  Payload ID: 9239
  Gene Symbol: LEMD2
  Gene Name: LEM domain containing 2
  ENSP ID: ENSP00000398733
MAGLSDLELRRELQALGFQPGPITDTTRDVYRNKLRRLRGEARLRDEERLREEARPRGEERLREEARLREDAPLRARPAAASPRAEPWLSQPASGSAYATPGAYGDIRPSAASW

SEQ ID NO: 45347 - protein, 280 aa, Homo sapiens
  Payload ID: 9239
  Gene Symbol: LEMD2
  Gene Name: LEM domain containing 2
  ENSP ID: ENSP00000408524
  MOD_RES (1)..(1): Any amino acid
XAYATPGAYGDIRPSAASWVGSRGLAYPARPAQLRRRASVRGSSEEDEDARTPDRATQGPGLAARRWWAASPAPARLPSSLLGPDPRPGLRATRAGPAGAARARPEVGRRLERWLSRLLLWASLGLLLVFLGILWVKMGKPSAPQEAEDNSNFECGNPENLKSKCIPVMEAQEYIANVTSSSSAKFEAALTWILSSNKDVGIWLKGEDQSELVTTVDKVVCLESAHPRMGVGCRLSRALLTAVTNVLIFFWCLAFLWGLLILLKYRWRKLEEEEQAMYEM

SEQ ID NO: 45348 - protein, 102 aa, Homo sapiens
  Payload ID: 9239
  Gene Symbol: LEMD2
  Gene Name: LEM domain containing 2
  ENSP ID: ENSP00000421112
  MOD_RES (1)..(1): Any amino acid
XVCLESAHPRMGVGCRLSRALLTAVTNVLIFFWCLAFLWGLLILLKYRWRKLEEEEQAMYEMVKKIIDVVQDHYVDWEQDMERYPYVGILHVRDSLIPPQSR

SEQ ID NO: 45349 - protein, 201 aa, Homo sapiens
  Payload ID: 9239
  Gene Symbol: LEMD2
  Gene Name: LEM domain containing 2
  Uniprot ID: Q8NC56
  ENSP ID: ENSP00000421704
MEAQEYIANVTSSSSAKFEAALTWILSSNKDVGIWLKGEDQSELVTTVDKVVCLESAHPRMGVGCRLSRALLTAVTNVLIFFWCLAFLWGLLILLKYRWRKLEEEEQAMYEMVKKIIDVVQDHYVDWEQDMERYPYVGILHVRDSLIPPQSRRRMKRVWDRAVEFLASNESRIQTESHRVAGEDMLVWRWTKPSSFSDSER

SEQ ID NO: 45350 - protein, 53 aa, Homo sapiens
  Payload ID: 9239
  Gene Symbol: LEMD2
  Gene Name: LEM domain containing 2
  ENSP ID: ENSP00000423619
MEAQEYIANVTSSSSAKFEAALTWILSSNKDVGIWLKGEDQSELVTTVDKVVC

SEQ ID NO: 45351 - protein, 85 aa, Homo sapiens
  Payload ID: 9239
  Gene Symbol: LEMD2
  Gene Name: LEM domain containing 2
  ENSP ID: ENSP00000423715
IIDVVQDHYVDWEQDMERYPYVGILHVRDSLIPPQSRRMKRVWDRAVEFLASNESRIQTESHRVAGEDMLVWRWTKPSSFSDSER

SEQ ID NO: 45352 - protein, 503 aa, Homo sapiens; identical to SEQ ID NO: 45345
  Payload ID: 9239
  Gene Symbol: LEMD2
  Gene Name: LEM domain containing 2
  Uniprot ID: Q8NC56
  ENSP ID: ENSP00000478539

SEQ ID NO: 45353 - protein, 911 aa, Homo sapiens
  Payload ID: 9240
  Gene Symbol: LEMD3
  Gene Name: LEM domain containing 3
  Uniprot ID: Q9Y2U8
  ENSP ID: ENSP00000308369
MAAAAASAPQQLSDEELFSQLRRYGLSPGPVTESTRPVYLKKLKKLREEEQQQHRSGGRGNKTRNSNNNNTAAATVAAAGPAAAAAAGMGVRPVSGDLSYLRTPGGLCRISASGPESLLGGPGGASAAPAAGSKVLLGFSSDESDVEASPRDQAGGGGRKDRASLQYRGLKAPPAPLAASEVTNSNSAERRKPHSWWGARRPAGPELQTPPGKDGAVEDEEGEGEDGEERDPETEEPLWASRTVNGSRLVPYSCRENYSDSEEEDDDDVASSRQVLKDDSLSRHRPRRTHSKPLPPLTAKSAGGRLETSVQGGGGLAMNDRAAAAGSLDRSRNLEEAAAAEQGGGCDQVDSSPVPRYRVNAKKLTPLLPPPLTDMDSTLDSSTGSLLKTNNHIGGGAFSVDSPRIYSNSLPPSAAVAASSSLRINHANHTGSNHTYLKNTYNKPKLSEPEEELLQQFKREEVSPTGSFSAHYLSMFLLTAACLFFLILGLTYLGMRGTGVSEDGELSIENPFGETFGKIQESEKTLMMNTLYKLHDRLAQLAGDHECGSSSQRTLSVQEAAAYLKDLGPEYEGIFNTSLQWILENGKDVGIRCVGFGPEEELTNITDVQFLQSTRPLMSFWCRFRRAFVTVTHRLLLLCLGVVMVCVVLRYMKYRWTKEEEETRQMYDMVVKIIDVLRSHNEACQENKDLQPYMPIPHVRDSLIQPHDRKKMKKVWDRAVDFLAANESRVRTETRRIGGADFLVWRWIQPSASCDKILVIPSKVWQGQAFHLDRRNSPPNSLTPCLKIRNMFDPVMEIGDQWHLAIQEAILEKCSDNDGIVHIAVDKNSREGCVYVKCLSPEYAGKAFKALHGSWFDGKLVTVKYLRLDRYHHRFPQALTSNTPLKPSNKHMNSMSHLRLRTGLTNSQGSS

SEQ ID NO: 45354 - protein, 1503 aa, Homo sapiens
  Payload ID: 9241
  Gene Symbol: LMTK2
  Gene Name: lemur tyrosine kinase 2
  Uniprot ID: Q8IWU2
  ENSP ID: ENSP00000297293
MPGPPALRRRLLLLLLVLLIAGSAGAAPLPQTGAGEAPPAAEVSSSFVILCVCSLIILIVLIANCVSCCKDPEIDFKEFEDNFDDEIDFTPPAEDTPSVQSPAEVFTLSVPNISLPAPSQFQPSVEGLKSQVARHSLNYIQEIGNGWFGKVLLGEIYTGTSVARVIVKELKASANPKEQDTFLKNGEPYYILQHPNILQCVGQCVEAIPYLLVFEFCDLGDLKAYLRSEQEHMRGDSQTMLLQRMACEVAAGLAAMHKLHFLHSDLALRNCFLTSDLNVKVGDYGIGFSRYKEDYIETDDKKVFPLRWTAPELVTSFQDRLLTADQTKYSNIWSLGVTLWELFDNAAQPYSNLSNLDVLNQVIRERDTKLPKPQLEQPYSDRWYEVLQFCWLSPEKRPAAEDVHRLLTYLRLQSQRDSEVDFEQQWNALKPNTNSRDSSNNAAFPILDHFARDRLGREMEEVLTVTETSQGLSFEYVWEAAKHDHFDERSRGHLDEGLSYTSIFYPVEVFESSLSDPGPGKQDDSGQDVPLRVPGVVPVFDAHNLSVGSDYYIQLEEKSGSNLELDYPPALLTTDMDNPERTGPELSQLTALRSVELEESSTDEDFFQSSTDPKDSSLPGDLHVTSGPESPFNNIFNDVDKSEDLPSHQKIFDLMELNGVQADFKPATLSSSLDNPKESVITGHFEKEKPRKIFDSEPLCLSDNLMHQDNFDPLNVQELSENFLFLQEKNLLKGSLSSKEHINDLQTELKNAGFTEAMLETSCRNSLDTELQFAENKPGLSLLQENVSTKGDDTDVMLTGDTLSTSLQSSPEVQVPPTSFETEETPRRVPPDSLPTQGETQPTCLDVIVPEDCLHQDISPDAVTVPVEILSTDARTHSLDNRSQDSPGESEETLRLTESDSVLADDILASRVSVGSSLPELGQELHNKPFSEDHHSHRRLEKNLEAVETLNQLNSKDAAKEAGLVSALSSDSTSQDSLLEDSLSAPFPASEPSLETPDSLESVDVHEALLDSLGSHTPQKLVPPDKPADSGYETENLESPEWTLHPAPEGTADSEPATTGDGGHSGLPPNPVIVISDAGDGHRGTEVTPETFTAGSQGSYRDSAYFSDNDSEPEKRSEEVPGTSPSALVLVQEQPLPEPVLPEQSPAAQDSCLEARKSQPDESCLSALHNSSDLELRATPEPAQTGVPQQVHPTEDEASSPWSVLNAELSSGDDFETQDDRPCTLASTGTNTNELLAYTNSALDKSLSSHSEGPKLKEPDIEGKYLGKLGVSGMLDLSEDGMDADEEDENSDDSDEDLRAFNLHSLSSESEDETEHPVPIILSNEDGRHLRSLLKPTAANAPDPLPEDWKKEKKAVTFFDDVTVYLFDQETPTKELGPCGGEACGPDLSGPAPASGSPYLSRCINSESSTDEEGGGFEWDDDFSPDPFMSKTTSNLLSSKPSLQTSKYFSPPPPARSTEQSWPHSAPYSRFSISPANIASFSLTHLTDSDIEQGGSSEDGEKD

SEQ ID NO: 45355 - protein, 1489 aa, Homo sapiens
  Payload ID: 9242
  Gene Symbol: LMTK3
  Gene Name: lemur tyrosine kinase 3
  ENSP ID: ENSP00000270238
MRQVLWLCNVCVTARETRHHLHLPAILDKMPAPGALILLAAVSASGCLASPAHPDGFALGRAPLAPPYAVVLISCSGLLAFIFLLLTCLCCKRGDVGFKEFENPEGEDCSGEYTPPAEETSSSQSLPDVYILPLAEVSLPMPAPQPSHSDMTTPLGLSRQHLSYLQEIGSGWFGKVILGEIFSDYTPAQVVVKELRASAGPLEQRKFISEAQPYRSLQHPNVLQCLGLCVETLPFLLIMEFCQLGDLKRYLRAQRPPEGLSPELPPRDLRTLQRMGLEIARGLAHLHSHNYVHSDLALRNCLLTSDLTVRIGDYGLAHSNYKEDYYLTPERLWIPLRWAAPELLGELHGTFMVVDQSRESNIWSLGVTLWELFEFGAQPYRHLSDEEVLAFVVRQQHVKLARPRLKLPYADYWYDILQSCWRPPAQRPSASDLQLQLTYLLSERPPRPPPPPPPPRDGPFPWPWPPAHSAPRPGTLSSPFPLLDGFPGADPDDVLTVTESSRGLNLECLWEKARRGAGRGGGAPAWQPASAPPAPHANPSNPFYEALSTPSVLPVISARSPSVSSEYYIRLEEHGSPPEPLFPNDWDPLDPGVPAPQAPQAPSEVPQLVSETWASPLFPAPRPFPAQSSASGSFLLSGWDPEGRGAGETLAGDPAEVLGERGTAPWVEEEEEEEEGSSPGEDSSSLGGGPSRRGPLPCPLCSREGACSCLPLERGDAVAGWGGHPALGCPHPPEDDSSLRAERGSLADLPMAPPASAPPEFLDPLMGAAAPQYPGRGPPPAPPPPPPPPRAPADPAASPDPPSAVASPGSGLSSPGPKPGDSGYETETPFSPEGAFPGGGAAEEEGVPRPRAPPEPPDPGAPRPPPDPGPLPLPGPREKPTFVVQVSTEQLLMSLREDVTRNLLGEKGATARETGPRKAGRGPGNREKVPGLNRDPTVLGNGKQAPSLSLPVNGVTVLENGDQRAPGIEEKAAENGALGSPEREEKVLENGELTPPRREEKALENGELRSPEAGEKVLVNGGLTPPKSEDKVSENGGLRFPRNTERPPETGPWRAPGPWEKTPESWGPAPTIGEPAPETSLERAPAPSAVVSSRNGGETAPGPLGPAPKNGTLEPGTERRAPETGGAPRAPGAGRLDLGSGGRAPVGTGTAPGGGPGSGVDAKAGWVDNTRPQPPPPPLPPPPEAQPRRLEPAPPRARPEVAPEGEPGAPDSRAGGDTALSGDGDPPKPERKGPEMPRLFLDLGPPQGNSEQIKARLSRLSLALPPLTLTPFPGPGPRRPPWEGADAGAAGGEAGGAGAPGPAEEDGEDEDEDEEEDEEAAAPGAAAGPRGPGRARAAPVPVVVSSADADAARPLRGLLKSPRGADEPEDSELERKRKMVSFHGDVTVYLFDQETPTNELSVQAPPEGDTDPSTPPAPPTPPHPATPGDGFPSNDSGFGGSFEWAEDFPLLPPPGPPLCFSRFSVSPALETPGPPARAPDARPAGPVEN

SEQ ID NO: 45356 - protein, 1460 aa, Homo sapiens
  Payload ID: 9242
  Gene Symbol: LMTK3
  Gene Name: lemur tyrosine kinase 3
  Uniprot ID: Q96Q04
  ENSP ID: ENSP00000472020
MPAPGALILLAAVSASGCLASPAHPDGFALGRAPLAPPYAVVLISCSGLLAFIFLLLTCLCCKRGDVGFKEFENPEGEDCSGEYTPPAEETSSSQSLPDVYILPLAEVSLPMPAPQPSHSDMTTPLGLSRQHLSYLQEIGSGWFGKVILGEIFSDYTPAQVVVKELRASAGPLEQRKFISEAQPYRSLQHPNVLQCLGLCVETLPFLLIMEFCQLGDLKRYLRAQRPPEGLSPELPPRDLRTLQRMGLEIARGLAHLHSHNYVHSDLALRNCLLTSDLTVRIGDYGLAHSNYKEDYYLTPERLWIPLRWAAPELLGELHGTFMVVDQSRESNIWSLGVTLWELFEFGAQPYRHLSDEEVLAFVVRQQHVKLARPRLKLPYADYWYDILQSCWRPPAQRPSASDLQLQLTYLLSERPPRPPPPPPPPRDGPFPWPWPPAHSAPRPGTLSSPFPLLDGFPGADPDDVLTVTESSRGLNLECLWEKARRGAGRGGGAPAWQPASAPPAPHANPSNPFYEALSTPSVLPVISARSPSVSSEYYIRLEEHGSPPEPLFPNDWDPLDPGVPAPQAPQAPSEVPQLVSETWASPLFPAPRPFPAQSSASGSFLLSGWDPEGRGAGETLAGDPAEVLGERGTAPWVEEEEEEEEGSSPGEDSSSLGGGPSRRGPLPCPLCSREGACSCLPLERGDAVAGWGGHPALGCPHPPEDDSSLRAERGSLADLPMAPPASAPPEFLDPLMGAAAPQYPGRGPPPAPPPPPPPPRAPADPAASPDPPSAVASPGSGLSSPGPKPGDSGYETETPFSPEGAFPGGGAAEEEGVPRPRAPPEPPDPGAPRPPPDPGPLPLPGPREKPTFVVQVSTEQLLMSLREDVTRNLLGEKGATARETGPRKAGRGPGNREKVPGLNRDPTVLGNGKQAPSLSLPVNGVTVLENGDQRAPGIEEKAAENGALGSPEREEKVLENGELTPPRREEKALENGELRSPEAGEKVLVNGGLTPPKSEDKVSENGGLRFPRNTERPPETGPWRAPGPWEKTPESWGPAPTIGEPAPETSLERAPAPSAVVSSRNGGETAPGPLGPAPKNGTLEPGTERRAPETGGAPRAPGAGRLDLGSGGRAPVGTGTAPGGGPGSGVDAKAGWVDNTRPQPPPPPLPPPPEAQPRRLEPAPPRARPEVAPEGEPGAPDSRAGGDTALSGDGDPPKPERKGPEMPRLFLDLGPPQGNSEQIKARLSRLSLALPPLTLTPFPGPGPRRPPWEGADAGAAGGEAGGAGAPGPAEEDGEDEDEDEEEDEEAAAPGAAAGPRGPGRARAAPVPVVVSSADADAARPLRGLLKSPRGADEPEDSELERKRKMVSFHGDVTVYLFDQETPTNELSVQAPPEGDTDPSTPPAPPTPPHPATPGDGFPSNDSGFGGSFEWAEDFPLLPPPGPPLCFSRFSVSPALETPGPPARAPDARPAGPVEN

SEQ ID NO: 45357 - protein, 509 aa, Homo sapiens
  Payload ID: 9243
  Gene Symbol: LGSN
  Gene Name: lengsin, lens protein with glutamine synthetase domain
  Uniprot ID: Q5TDP6
  ENSP ID: ENSP00000359691
MNNEEDLLQEDSTRDEGNETEANSMNTLRRTRKKVTKPYVCSTEVGETDMSNSNDCMRDSSQILTPPQLSSRMKHIRQAMAKNRLQFVRFEATDLHGVSRSKTIPAHFFQEKVSHGVCMPRGYLEVIPNPKDNEMNNIRATCFNSDIVLMPELSTFRVLPWADRTARVICDTFTVTGEPLLTSPRYIAKRQLSHLQASGFSLLSAFIYDFCIFGVPEILNSKIISFPALTFLNNHDQPFMQELVDGLYHTGANVESFSSSTRPGQMEISFLPEFGISSADNAFTLRTGVKEVARKYNYIASFFIETGFCDSGILSHSLWDVDRKKNMFCSTSGTEQLTITGKKWLAGLLKHSAALSCLMAPSVSCRKRYSKDRKDLKKSVPTTWGYNDNSCIFNIKCHGEKGTRIENKLGSATANPYLVLAATVAAGLDGLHSSNEVLAGPDESTDFYQVEPSEIPLKLEDALVALEEDQCLRQALGETFIRYFVAMKKYELENEEIAAERNKFLEYFI

SEQ ID NO: 45358 - protein, 208 aa, Homo sapiens
  Payload ID: 9243
  Gene Symbol: LGSN
  Gene Name: lengsin, lens protein with glutamine synthetase domain
  Uniprot ID: Q5TDP6
  ENSP ID: ENSP00000359692
MNNEEDLLQEDSTRDEGNETEANSMNTLRRTRKKVTKPYVCSTEVGETDMSNSNDCMRDSSQILTPPQLSSRMKHIRQAMAKNRLQFVRFEATDLHGVSRSKTIPAHFFQEKVSHGVCMPRGYLEVIPNPKDNEMNNIRATCFNSDIVLMPELSTFRVLPWADRTARVICDTFTVTVSGMSIGRKTCSAALLELSSSRSLGKNGWQDS

SEQ ID NO: 45359 - protein, 191 aa, Homo sapiens
  Payload ID: 9243
  Gene Symbol: LGSN
  Gene Name: lengsin, lens protein with glutamine synthetase domain
  ENSP ID: ENSP00000431246
MNNEEDLLQEDSTRDEGNETEANSMNTLRRTRKKVTKPYVCSTEVGETDMSNSNDCMRDSSQILTPPQLSSRMKHIRQAMAKNRLQFVRFEATDLHGVSRSKTIPAHFFQEKVSHGVCMPRGYLEVIPNPKDNEMNNIRATCFNSDIVLMPELSTFRVLPWADRTARVICDTFTVTAPEKLMNFKVIMSSR

SEQ ID NO: 45360 - protein, 118 aa, Homo sapiens
  Payload ID: 9243
  Gene Symbol: LGSN
  Gene Name: lengsin, lens protein with glutamine synthetase domain
  Uniprot ID: Q5TDP6
  ENSP ID: ENSP00000479173
MNNEEDLLQEDSTRDEGNETEANSMNTLRRTRKKVTKPYVCSTEVGETDMSNSNERIRNQMVCHKLGNTSKPIMGPGSAESHLSYDDKDSQDETTVIKPLPPRTTTNVPGGEFNPNSE

SEQ ID NO: 45361 - protein, 61 aa, Homo sapiens
  Payload ID: 9244
  Gene Symbol: LENEP
  Gene Name: lens epithelial protein
  Uniprot ID: Q9Y5L5
  ENSP ID: ENSP00000357412
MQPRTQPLAQTLPFFLGGAPRDTGLRVPVIKMGTGWEGFQRTLKEVAYILLCCWCIKELLD

SEQ ID NO: 45362 - protein, 61 aa, Homo sapiens; identical to SEQ ID NO: 45361
  Payload ID: 9244
  Gene Symbol: LENEP
  Gene Name: lens epithelial protein
  Uniprot ID: Q9Y5L5
  ENSP ID: ENSP00000376278

SEQ ID NO: 45363 - protein, 215 aa, Homo sapiens
  Payload ID: 9245
  Gene Symbol: LIM2
  Gene Name: lens intrinsic membrane protein 2, 19kDa
  Uniprot ID: P55344
  ENSP ID: ENSP00000221973
MYSFMGGGLFCAWVGTILLVVAMATDHWMQYRLSGSFAHQGLWRYCLGNKCYLQTDSIGEPPGQGPGRAWGKSRADLGAQGHLYSRWRTLRLKEGKGATQAYWNATRAFMILSALCAISGIIMGIMAFAHQPTFSRISRPFSAGIMFFSSTLFVVLALAIYTGVTVSFLGRRFGDWRFSWSYILGWVAVLMTFFAGIFYMCAYRVHECRRLSTPR

SEQ ID NO: 45364 - protein, 173 aa, Homo sapiens
  Payload ID: 9245
  Gene Symbol: LIM2
  Gene Name: lens intrinsic membrane protein 2, 19kDa
  Uniprot ID: P55344
  ENSP ID: ENSP00000472090
MYSFMGGGLFCAWVGTILLVVAMATDHWMQYRLSGSFAHQGLWRYCLGNKCYLQTDSIAYWNATRAFMILSALCAISGIIMGIMAFAHQPTFSRISRPFSAGIMFFSSTLFVVLALAIYTGVTVSFLGRRFGDWRFSWSYILGWVAVLMTFFAGIFYMCAYRVHECRRLSTPR

SEQ ID NO: 45365 - protein, 666 aa, Homo sapiens
  Payload ID: 9246
  Gene Symbol: LEO1
  Gene Name: LEO1 homolog, Paf1/RNA polymerase II complex component
  Uniprot ID: Q8WVC0
  ENSP ID: ENSP00000299601
MADMEDLFGSDADSEAERKDSDSGSDSDSDQENAASGSNASGSESDQDERGDSGQPSNKELFGDDSEDEGASHHSGSDNHSERSDNRSEASERSDHEDNDPSDVDQHSGSEAPNDDEDEGHRSDGGSHHSEAEGSEKAHSDDEKWGREDKSDQSDDEKIQNSDDEERAQGSDEDKLQNSDDDEKMQNTDDEERPQLSDDERQQLSEEEKANSDDERPVASDNDDEKQNSDDEEQPQLSDEEKMQNSDDERPQASDEEHRHSDDEEEQDHKSESARGSDSEDEVLRMKRKNAIASDSEADSDTEVPKDNSGTMDLFGGADDISSGSDGEDKPPTPGQPVDENGLPQDQQEEEPIPETRIEVEIPKVNTDLGNDLYFVKLPNFLSVEPRPFDPQYYEDEFEDEEMLDEEGRTRLKLKVENTIRWRIRRDEEGNEIKESNARIVKWSDGSMSLHLGNEVFDVYKAPLQGDHNHLFIRQGTGLQGQAVFKTKLTFRPHSTDSATHRKMTLSLADRCSKTQKIRILPMAGRDPECQRTEMIKKEEERLRASIRRESQQRRMREKQHQRGLSASYLEPDRYDEEEEGEESISLAAIKNRYKGGIREERARIYSSDSDEGSEEDKAQRLLKAKKLTSDEEGEPSGKRKAEDDDKANKKHKKYVISDEEEEDDD

SEQ ID NO: 45366 - protein, 606 aa, Homo sapiens
  Payload ID: 9246
  Gene Symbol: LEO1
  Gene Name: LEO1 homolog, Paf1/RNA polymerase II complex component
  Uniprot ID: Q8WVC0
  ENSP ID: ENSP00000314610
MADMEDLFGSDADSEAERKDSDSGSDSDSDQENAASGSNASGSESDQDERGDSGQPSNKELFGDDSEDEGASHHSGSDNHSERSDNRSEASERSDHEDNDPSDVDQHSGSEAPNDDEDEGHRSDGGSHHSEAEGSEKAHSDDEKWGREDKSDQSDDEKIQNSDDEERAQGSDEDKLQNSDDDEKMQNTDDEERPQLSDDERQQLSEEEKANSDDERPVASDNDDEKQNSDDEEQPQLSDEEKMQNSDDERPQASDEEHRHSDDEEEQDHKSESARGSDSEDEVLRMKRKNAIASDSEADSDTEVPKDNSGTMDLFGGADDISSGSDGEDKPPTPGQPVDENGLPQDQQEEEPIPETRIEVEIPKVNTDLGNDLYFVKLPNFLSVEPSMSLHLGNEVFDVYKAPLQGDHNHLFIRQGTGLQGQAVFKTKLTFRPHSTDSATHRKMTLSLADRCSKTQKIRILPMAGRDPECQRTEMIKKEEERLRASIRRESQQRRMREKQHQRGLSASYLEPDRYDEEEEGEESISLAAIKNRYKGGIREERARIYSSDSDEGSEEDKAQRLLKAKKLTSDEEGEPSGKRKAEDDDKANKKHKKYVISDEEEEDDD

SEQ ID NO: 45367 - protein, 167 aa, Homo sapiens
  Payload ID: 9247
  Gene Symbol: LEP
  Gene Name: leptin
  Uniprot ID: P41159
  ENSP ID: ENSP00000312652
MHWGTLCGFLWLWPYLFYVQAVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 45368 - protein, 1165 aa, Homo sapiens
  Payload ID: 9248
  Gene Symbol: LEPR
  Gene Name: leptin receptor
  Uniprot ID: P48357
  ENSP ID: ENSP00000330393
MICQKFCVVLLHWEFIYVITAFNLSYPITPWRFKLSCMPPNSTYDYFLLPAGLSKNTSNSNGHYETAVEPKFNSSGTHFSNLSKTTFHCCFRSEQDRNCSLCADNIEGKTFVSTVNSLVFQQIDANWNIQCWLKGDLKLFICYVESLFKNLFRNYNYKVHLLYVLPEVLEDSPLVPQKGSFQMVHCNCSVHECCECLVPVPTAKLNDTLLMCLKITSGGVIFQSPLMSVQPINMVKPDPPLGLHMEITDDGNLKISWSSPPLVPFPLQYQVKYSENSTTVIREADKIVSATSLLVDSILPGSSYEVQVRGKRLDGPGIWSDWSTPRVFTTQDVIYFPPKILTSVGSNVSFHCIYKKENKIVPSKEIVWWMNLAEKIPQSQYDVVSDHVSKVTFFNLNETKPRGKFTYDAVYCCNEHECHHRYAELYVIDVNINISCETDGYLTKMTCRWSTSTIQSLAESTLQLRYHRSSLYCSDIPSIHPISEPKDCYLQSDGFYECIFQPIFLLSGYTMWIRINHSLGSLDSPPTCVLPDSVVKPLPPSSVKAEITINIGLLKISWEKPVFPENNLQFQIRYGLSGKEVQWKMYEVYDAKSKSVSLPVPDLCAVYAVQVRCKRLDGLGYWSNWSNPAYTVVMDIKVPMRGPEFWRIINGDTMKKEKNVTLLWKPLMKNDSLCSVQRYVINHHTSCNGTWSEDVGNHTKFTFLWTEQAHTVTVLAINSIGASVANFNLTFSWPMSKVNIVQSLSAYPLNSSCVIVSWILSPSDYKLMYFIIEWKNLNEDGEIKWLRISSSVKKYYIHDHFIPIEKYQFSLYPIFMEGVGKPKIINSFTQDDIEKHQSDAGLYVIVPVIISSSILLLGTLLISHQRMKKLFWEDVPNPKNCSWAQGLNFQKPETFEHLFIKHTASVTCGPLLLEPETISEDISVDTSWKNKDEMMPTTVVSLLSTTDLEKGSVCISDQFNSVNFSEAEGTEVTYEDESQRQPFVKYATLISNSKPSETGEEQGLINSSVTKCFSSKNSPLKDSFSNSSWEIEAQAFFILSDQHPNIISPHLTFSEGLDELLKLEGNFPEENNDKKSIYYLGVTSIKKRESGVLLTDKSRVSCPFPAPCLFTDIRVLQDSCSHFVENNINLGTSSKKTFASYMPQFQTCSTQTHKIMENKMCDLTV

SEQ ID NO: 45369 - protein, 906 aa, Homo sapiens
  Payload ID: 9248
  Gene Symbol: LEPR
  Gene Name: leptin receptor
  Uniprot ID: P48357
  ENSP ID: ENSP00000340884
MICQKFCVVLLHWEFIYVITAFNLSYPITPWRFKLSCMPPNSTYDYFLLPAGLSKNTSNSNGHYETAVEPKFNSSGTHFSNLSKTTFHCCFRSEQDRNCSLCADNIEGKTFVSTVNSLVFQQIDANWNIQCWLKGDLKLFICYVESLFKNLFRNYNYKVHLLYVLPEVLEDSPLVPQKGSFQMVHCNCSVHECCECLVPVPTAKLNDTLLMCLKITSGGVIFQSPLMSVQPINMVKPDPPLGLHMEITDDGNLKISWSSPPLVPFPLQYQVKYSENSTTVIREADKIVSATSLLVDSILPGSSYEVQVRGKRLDGPGIWSDWSTPRVFTTQDVIYFPPKILTSVGSNVSFHCIYKKENKIVPSKEIVWWMNLAEKIPQSQYDVVSDHVSKVTFFNLNETKPRGKFTYDAVYCCNEHECHHRYAELYVIDVNINISCETDGYLTKMTCRWSTSTIQSLAESTLQLRYHRSSLYCSDIPSIHPISEPKDCYLQSDGFYECIFQPIFLLSGYTMWIRINHSLGSLDSPPTCVLPDSVVKPLPPSSVKAEITINIGLLKISWEKPVFPENNLQFQIRYGLSGKEVQWKMYEVYDAKSKSVSLPVPDLCAVYAVQVRCKRLDGLGYWSNWSNPAYTVVMDIKVPMRGPEFWRIINGDTMKKEKNVTLLWKPLMKNDSLCSVQRYVINHHTSCNGTWSEDVGNHTKFTFLWTEQAHTVTVLAINSIGASVANFNLTFSWPMSKVNIVQSLSAYPLNSSCVIVSWILSPSDYKLMYFIIEWKNLNEDGEIKWLRISSSVKKYYIHDHFIPIEKYQFSLYPIFMEGVGKPKIINSFTQDDIEKHQSDAGLYVIVPVIISSSILLLGTLLISHQRMKKLFWEDVPNPKNCSWAQGLNFQKKMPGTKELLGGGWLT

SEQ ID NO: 45370 - protein, 906 aa, Homo sapiens; identical to SEQ ID NO: 45369
  Payload ID: 9248
  Gene Symbol: LEPR
  Gene Name: leptin receptor
  Uniprot ID: P48357
  ENSP ID: ENSP00000360097

SEQ ID NO: 45371 - protein, 958 aa, Homo sapiens
  Payload ID: 9248
  Gene Symbol: LEPR
  Gene Name: leptin receptor
  Uniprot ID: P48357
  ENSP ID: ENSP00000360098
MICQKFCVVLLHWEFIYVITAFNLSYPITPWRFKLSCMPPNSTYDYFLLPAGLSKNTSNSNGHYETAVEPKFNSSGTHFSNLSKTTFHCCFRSEQDRNCSLCADNIEGKTFVSTVNSLVFQQIDANWNIQCWLKGDLKLFICYVESLFKNLFRNYNYKVHLLYVLPEVLEDSPLVPQKGSFQMVHCNCSVHECCECLVPVPTAKLNDTLLMCLKITSGGVIFQSPLMSVQPINMVKPDPPLGLHMEITDDGNLKISWSSPPLVPFPLQYQVKYSENSTTVIREADKIVSATSLLVDSILPGSSYEVQVRGKRLDGPGIWSDWSTPRVFTTQDVIYFPPKILTSVGSNVSFHCIYKKENKIVPSKEIVWWMNLAEKIPQSQYDVVSDHVSKVTFFNLNETKPRGKFTYDAVYCCNEHECHHRYAELYVIDVNINISCETDGYLTKMTCRWSTSTIQSLAESTLQLRYHRSSLYCSDIPSIHPISEPKDCYLQSDGFYECIFQPIFLLSGYTMWIRINHSLGSLDSPPTCVLPDSVVKPLPPSSVKAEITINIGLLKISWEKPVFPENNLQFQIRYGLSGKEVQWKMYEVYDAKSKSVSLPVPDLCAVYAVQVRCKRLDGLGYWSNWSNPAYTVVMDIKVPMRGPEFWRIINGDTMKKEKNVTLLWKPLMKNDSLCSVQRYVINHHTSCNGTWSEDVGNHTKFTFLWTEQAHTVTVLAINSIGASVANFNLTFSWPMSKVNIVQSLSAYPLNSSCVIVSWILSPSDYKLMYFIIEWKNLNEDGEIKWLRISSSVKKYYIHDHFIPIEKYQFSLYPIFMEGVGKPKIINSFTQDDIEKHQSDAGLYVIVPVIISSSILLLGTLLISHQRMKKLFWEDVPNPKNCSWAQGLNFQKMLEGSMFVKSHHHSLISSTQGHKHCGRPQGPLHRKTRDLCSLVYLLTLPPLLSYDPAKSPSVRNTQE

SEQ ID NO: 45372 - protein, 896 aa, Homo sapiens
  Payload ID: 9248
  Gene Symbol: LEPR
  Gene Name: leptin receptor
  Uniprot ID: P48357
  ENSP ID: ENSP00000360099
MICQKFCVVLLHWEFIYVITAFNLSYPITPWRFKLSCMPPNSTYDYFLLPAGLSKNTSNSNGHYETAVEPKFNSSGTHFSNLSKTTFHCCFRSEQDRNCSLCADNIEGKTFVSTVNSLVFQQIDANWNIQCWLKGDLKLFICYVESLFKNLFRNYNYKVHLLYVLPEVLEDSPLVPQKGSFQMVHCNCSVHECCECLVPVPTAKLNDTLLMCLKITSGGVIFQSPLMSVQPINMVKPDPPLGLHMEITDDGNLKISWSSPPLVPFPLQYQVKYSENSTTVIREADKIVSATSLLVDSILPGSSYEVQVRGKRLDGPGIWSDWSTPRVFTTQDVIYFPPKILTSVGSNVSFHCIYKKENKIVPSKEIVWWMNLAEKIPQSQYDVVSDHVSKVTFFNLNETKPRGKFTYDAVYCCNEHECHHRYAELYVIDVNINISCETDGYLTKMTCRWSTSTIQSLAESTLQLRYHRSSLYCSDIPSIHPISEPKDCYLQSDGFYECIFQPIFLLSGYTMWIRINHSLGSLDSPPTCVLPDSVVKPLPPSSVKAEITINIGLLKISWEKPVFPENNLQFQIRYGLSGKEVQWKMYEVYDAKSKSVSLPVPDLCAVYAVQVRCKRLDGLGYWSNWSNPAYTVVMDIKVPMRGPEFWRIINGDTMKKEKNVTLLWKPLMKNDSLCSVQRYVINHHTSCNGTWSEDVGNHTKFTFLWTEQAHTVTVLAINSIGASVANFNLTFSWPMSKVNIVQSLSAYPLNSSCVIVSWILSPSDYKLMYFIIEWKNLNEDGEIKWLRISSSVKKYYIHDHFIPIEKYQFSLYPIFMEGVGKPKIINSFTQDDIEKHQSDAGLYVIVPVIISSSILLLGTLLISHQRMKKLFWEDVPNPKNCSWAQGLNFQKRTDIL

SEQ ID NO: 45373 - protein, 232 aa, Homo sapiens
  Payload ID: 9248
  Gene Symbol: LEPR
  Gene Name: leptin receptor
  ENSP ID: ENSP00000384025
MMPTTVVSLLSTTDLEKGSVCISDQFNSVNFSEAEGTEVTYEDESQRQPFVKYATLISNSKPSETGEEQGLINSSVTKCFSSKNSPLKDSFSNSSWEIEAQAFFILSDQHPNIISPHLTFSEGLDELLKLEGNFPEENNDKKSIYYLGVTSIKKRESGVLLTDKSRVSCPFPAPCLFTDIRVLQDSCSHFVENNINLGTSSKKTFASYMPQFQTCSTQTHKIMENKMCDLTV

SEQ ID NO: 45374 - protein, 896 aa, Homo sapiens; identical to SEQ ID NO: 45372
  Payload ID: 9248
  Gene Symbol: LEPR
  Gene Name: leptin receptor
  Uniprot ID: P48357
  ENSP ID: ENSP00000483390

SEQ ID NO: 45375 - protein, 131 aa, Homo sapiens
  Payload ID: 9249
  Gene Symbol: LEPROT
  Gene Name: leptin receptor overlapping transcript
  Uniprot ID: O15243
  ENSP ID: ENSP00000360104
MAGVKALVALSFSGAIGLTFLMLGCALEDYGVYWPLFVLIFHAISPIPHFIAKRVTYDSDATSSACRELAYFFTTGIVVSAFGFPVILARVAVIKWGACGLVLAGNAVIFLTIQGFFLIFGRGDDFSWEQW

SEQ ID NO: 45376 - protein, 140 aa, Homo sapiens
  Payload ID: 9249
  Gene Symbol: LEPROT
  Gene Name: leptin receptor overlapping transcript
  ENSP ID: ENSP00000483521
MRDGKGFLQGFLYFALVALSFSGAIGLTFLMLGCALEDYGVYWPLFVLIFHAISPIPHFIAKRVTYDSDATSSACRELAYFFTTGIVVSAFGFPVILARVAVIKWGACGLVLAGNAVIFLTIQGFFLIFGRGDDFSWEQW

SEQ ID NO: 45377 - protein, 131 aa, Homo sapiens
  Payload ID: 9250
  Gene Symbol: LEPROTL1
  Gene Name: leptin receptor overlapping transcript-like 1
  Uniprot ID: O95214
  ENSP ID: ENSP00000314625
MAGIKALISLSFGGAIGLMFLMLGCALPIYNKYWPLFVLFFYILSPIPYCIARRLVDDTDAMSNACKELAIFLTTGIVVSAFGLPIVFARAHLIEWGACALVLTGNTVIFATILGFFLVFGSNDDFSWQQW

SEQ ID NO: 45378 - protein, 144 aa, Homo sapiens
  Payload ID: 9250
  Gene Symbol: LEPROTL1
  Gene Name: leptin receptor overlapping transcript-like 1
  ENSP ID: ENSP00000412803
MAGIKALISLSFGGAIGLMFLMLGCALPIYNKYWPLFVLFFYILSPIPYCIARRLVDDTDAMSNACKELAIFLTTGIVVSAFGLPIVFARAHLGPDVCIGDISLLSRALTKLRPKARCVEEGVVQDPVGVVDGAPTLLQQDGNS

SEQ ID NO: 45379 - protein, 154 aa, Homo sapiens
  Payload ID: 9250
  Gene Symbol: LEPROTL1
  Gene Name: leptin receptor overlapping transcript-like 1
  ENSP ID: ENSP00000428196
MKWLAVSEESRRDLDGHTRFAGVCIRERALISLSFGGAIGLMFLMLGCALPIYNKYWPLFVLFFYILSPIPYCIARRLVDDTDAMSNACKELAIFLTTGIVVSAFGLPIVFARAHLIEWGACALVLTGNTVIFATILGFFLVFGSNDDFSWQQW

SEQ ID NO: 45380 - protein, 169 aa, Homo sapiens
  Payload ID: 9250
  Gene Symbol: LEPROTL1
  Gene Name: leptin receptor overlapping transcript-like 1
  Uniprot ID: O95214
  ENSP ID: ENSP00000428281
MAGIKALISLSFGGAIGLMFLMLGCALPIYNKYWPLFVLFFYILSPIPYCIARRLVDDTDAMSNACKELAIFLTTGIVVSAFGLPIVFARAHLMGRLPFFSKMGTAESEGRETLTQQLPLPAAAMRRLLPASRVSTQPVLRLADSAESLLGRPALWALGFLLCPPSQAQ

SEQ ID NO: 45381 - protein, 136 aa, Homo sapiens
  Payload ID: 9250
  Gene Symbol: LEPROTL1
  Gene Name: leptin receptor overlapping transcript-like 1
  ENSP ID: ENSP00000429155
  MOD_RES (1)..(1): Any amino acid
XLMLGCALPIYNKYWPLFVLFFYILSPIPYCIARRLVDDTDAMSNACKELAIFLTTGIVVSAFGLPIVFARAHLMESCSVAQPGVQWRDLTSLQALPPGFTPFSCLSLPSSWDYRCPPPRPADIFCVFSGDEVSPC

SEQ ID NO: 45382 - protein, 106 aa, Homo sapiens
  Payload ID: 9250
  Gene Symbol: LEPROTL1
  Gene Name: leptin receptor overlapping transcript-like 1
  ENSP ID: ENSP00000429398
MAGIKALISLSFGGAIGLMFLMLGCALPIYNKYWPLFVLFFYILSPIPYCIARRLVDDTDAMSNACKELAIFLTTGIVVSAFGLPIVFARAHLCEDCSWSSCMCRK

SEQ ID NO: 45383 - protein, 162 aa, Homo sapiens
  Payload ID: 9250
  Gene Symbol: LEPROTL1
  Gene Name: leptin receptor overlapping transcript-like 1
  ENSP ID: ENSP00000429656
MAGIKALISLSFGGAIGLMFLMLGCALPIYNKYWPLFVLFFYILSPIPYCIARRLVDDTDAMSNACKELAIFLTTGIVVSAFGLPIVFARAHLQKQNTVHHGKDTVVRITEQPERGETPDLHSQHDVGNDQLGVGPGEGSIEQPHRPGSDKLIGKGVNQVVS

SEQ ID NO: 45384 - protein, 70 aa, Homo sapiens
  Payload ID: 9250
  Gene Symbol: LEPROTL1
  Gene Name: leptin receptor overlapping transcript-like 1
  ENSP ID: ENSP00000430702
MSNACKELAIFLTTGIVVSAFGLPIVFARAHLIEWGACALVLTGNTVIFATILGFFLVFGSNDDFSWQQW

SEQ ID NO: 45385 - protein, 1064 aa, Homo sapiens
  Payload ID: 9251
  Gene Symbol: LLGL1
  Gene Name: lethal giant larvae homolog 1 (Drosophila)
  Uniprot ID: Q15334
  ENSP ID: ENSP00000321537
MMKFRFRRQGADPQREKLKQELFAFNKTVEHGFPNQPSALAFDPELRIMAIGTRSGAVKIYGAPGVEFTGLHRDAATVTQMHFLTGQGRLLSLLDDSSLHLWEIVHHNGCAHLEEALSFQLPSRPGFDGASAPLSLTRVTVVLLVAASDIAALGTEGSSVFFLDVTTLTLLEGQTLAPGEVLRSVPDDYRCGKALGPVESLQGHLRDPTKILIGYSRGLLVIWNQASQCVDHIFLGNQQLESLCWGRDSSTVVSSHSDGSYAVWSVDAGSFPTLQPTVATTPYGPFPCKAINKILWRNCESGGHFIIFSGGMPRASYGDRHCVSVLRAETLVTLDFTSRIIDFFTVHSTRPEDEFDDPQALAVLLEEELVVLDLQTPGWPAVPAPYLAPLHSSAITCSAHVASVPAKLWARIVSAGEQQSPQPVSSALSWPITGGRNLAQEPSQRGLLLTGHEDGTVRFWDASGVALRPLYKLSTAGLFQTDCEHADSLAQAAEDDWPPFRKVGCFDPYSDDPRLGVQKVALCKYTAQMVVAGTAGQVLVLELSDVPVEQAVSVAIIDLLQDREGFTWKGHERLSPRTGPLPWPAGFQPRVLVQCLPPAAVTAVTLHTEWSLVAFGTSHGFGLFDYQRKSPVLARCTLHPNDSLAMEGPLSRVKSLKKSLRQSFRRIRKSRVSGKKRAANASSKLQEANAQLAEQACPHDVEMTPVQRRIEPRSADDSLSGVVRCLYFADTFLRDGAHHGPTMWAGTNSGSVFAYALEVPAAAVGGEKRPEQAVEAVLGKEVQLMHRAPVVAIAVLDGRGRPLPEPYEASRDLAQAPDMQGGHAVLIASEEQFKVFTLPKVSAKTKFKLTAHEGCRVRKVALATFASVACEDYAETCLACLTNLGDVHVFSVPGLRPQVHYSCIRKEDISGIASCVFTRHGQGFYLISPSEFERFSLSARNITEPLCSLDINWPRDATQASYRIRESPKLSQANGTPSILLAPQSLDGSPDPAHSMGPDTPEPPEAALSPMSIDSATSADTTLDTTGDVTVEDVKDFLGSSEESEKNLRNLAEDEAHACAILIK

SEQ ID NO: 45386 - protein, 1056 aa, Homo sapiens
  Payload ID: 9251
  Gene Symbol: LLGL1
  Gene Name: lethal giant larvae homolog 1 (Drosophila)
  ENSP ID: ENSP00000480006
MMKFRFRRQGADPQREKLKQELFAFNKTVEHGFPNQPSALAFDPELRIMAIGTRSGAVKIYGAPGVEFTGLHRDAATVTQMHFLTGQGRLLSLLDDSSLHLWEIVHHNGCAHLEEALSFQLPSRPGFDGASAPLSLTRVTVVLLVAASDIAALGTEGSSVFFLDVTTLTLLEGQTLAPGEVLRSVPDDYRCGKALGPVESLQGHLRDPTKILIGYSRGLLVIWNQASQCVDHIFLGNQQLESLCWGRDSSTVVSSHSDGSYAVWSVDAGSFPTLQPTVATTPYGPFPCKAINKILWRNCESGGHFIIFSGGMPRASYGDRHCVSVLRAETLVTLDFTSRIIDFFTVHSTRPEDEFDDPQALAVLLEEELVVLDLQTPGWPAVPAPYLAPLHSSAITCSAHVASVPAKLWARIVSAGEQQSPQPVSSALSWPITGGRNLAQEPSQRGLLLTGHEDGTVRFWDASGVALRPLYKLSTAGLFQTDCEHADSLAQAAEDDWPPFRKVGCFDPYSDDPRLGVQKVALCKYTAQMVVAGTAGQVLVLELSDVPVEQAVSVAIIDLLQDREGFTWKGHERLSPRTGPLPWPAGFQPRVLVQCLPPAAVTAVTLHTEWSLVAFGTSHGFGLLDPVFPRCTLHPNDSLAMEGPLSRVKSLKKSLRQSFRRIRKSRVSGKKRAANASSKLQEANAQLAEQACPHDVEMTPVQRRIEPRSADDSLSGVVRCLYFADTFLRDGAHHGPTMWAGTNSGSVFAYALEVPAAAVGGEKRPEQAVEAVLGKEVQLMHRAPVVAIAVLDGRGRPLPEPYEASRDLAQAPDMQGGHAVLIASEEQFKVFTLPKVSAKTKFKLTAHEGCRVRKVALATFASVACEDYAETCLACLTNLGDVHVFSVPGLRPQVHYSCIRKEDISGIASCVFTRHGQGFYLISPSEFERFSLSARNITEPLCSLDINWPRDATQASYRIRESPKLSQANGTPSILLAPQSLDGSPDPAHSMGPDTPEPPEAALSPMSIDSATSADTTLDTTGDVTVEDVKDFLGSSEESEKNLRNLAEDEAHACAI

SEQ ID NO: 45387 - protein, 1015 aa, Homo sapiens
  Payload ID: 9252
  Gene Symbol: LLGL2
  Gene Name: lethal giant larvae homolog 2 (Drosophila)
  Uniprot ID: Q6P1M3
  ENSP ID: ENSP00000167462
MRRFLRPGHDPVRERLKRDLFQFNKTVEHGFPHQPSALGYSPSLRILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTESGNVFVVQLPAFRALEDRTISSDAVLQRLPEEARHRRVFEMVEALQEHPRDPNQILIGYSRGLVVIWDLQGSRVLYHFLSSQQLENIWWQRDGRLLVSCHSDGSYCQWPVSSEAQQPEPLRSLVPYGPFPCKAITRILWLTTRQGLPFTIFQGGMPRASYGDRHCISVIHDGQQTAFDFTSRVIGFTVLTEADPAATFDDPYALVVLAEEELVVIDLQTAGWPPVQLPYLASLHCSAITCSHHVSNIPLKLWERIIAAGSRQNAHFSTMEWPIDGGTSLTPAPPQRDLLLTGHEDGTVRFWDASGVCLRLLYKLSTVRVFLTDTDPNENFSAQGEDEWPPLRKVGSFDPYSDDPRLGIQKIFLCKYSGYLAVAGTAGQVLVLELNDEAAEQAVEQVEADLLQDQEGYRWKGHERLAARSGPVRFEPGFQPFVLVQCQPPAVVTSLALHSEWRLVAFGTSHGFGLFDHQQRRQVFVKCTLHPSDQLALEGPLSRVKSLKKSLRQSFRRMRRSRVSSRKRHPAGPPGEAQEGSAKAERPGLQNMELAPVQRKIEARSAEDSFTGFVRTLYFADTYLKDSSRHCPSLWAGTNGGTIYAFSLRVPPAERRMDEPVRAEQAKEIQLMHRAPVVGILVLDGHSVPLPEPLEVAHDLSKSPDMQGSHQLLVVSEEQFKVFTLPKVSAKLKLKLTALEGSRVRRVSVAHFGSRRAEDYGEHHLAVLTNLGDIQVVSLPLLKPQVRYSCIRREDVSGIASCVFTKYGQGFYLISPSEFERFSLSTKWLVEPRCLVDSAETKNHRPGNGAGPKKAPSRARNSGTQSDGEEKQPGLVMERALLSDERAATGVHIEPPWGAASAMAEQSEWLSVQAAR

SEQ ID NO: 45388 - protein, 356 aa, Homo sapiens
  Payload ID: 9252
  Gene Symbol: LLGL2
  Gene Name: lethal giant larvae homolog 2 (Drosophila)
  Uniprot ID: Q6P1M3
  ENSP ID: ENSP00000364375
MRRFLRPGHDPVRERLKRDLFQFNKTVEHGFPHQPSALGYSPSLRILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTESGNVFVVQLPAFRALEDRTISSDAVLQRLPEEARHRRVFEMVEALQEHPRDPNQILIGYSRGLVVIWDLQGSRVLYHFLSSQQLENIWWQRDGRLLVSCHSDGSYCQWPVSSEAQQPEPLRSLVPYGPFPCKAITRILWLTTRQGLPFTIFQGGMPRASYGDRHCISVIHDGQQTAFDFTSRVIGFTVLTEADPAASRRASGVGAQG

SEQ ID NO: 45389 - protein, 1020 aa, Homo sapiens
  Payload ID: 9252
  Gene Symbol: LLGL2
  Gene Name: lethal giant larvae homolog 2 (Drosophila)
  Uniprot ID: Q6P1M3
  ENSP ID: ENSP00000376333
MRRFLRPGHDPVRERLKRDLFQFNKTVEHGFPHQPSALGYSPSLRILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTESGNVFVVQLPAFRALEDRTISSDAVLQRLPEEARHRRVFEMVEALQEHPRDPNQILIGYSRGLVVIWDLQGSRVLYHFLSSQQLENIWWQRDGRLLVSCHSDGSYCQWPVSSEAQQPEPLRSLVPYGPFPCKAITRILWLTTRQGLPFTIFQGGMPRASYGDRHCISVIHDGQQTAFDFTSRVIGFTVLTEADPAATFDDPYALVVLAEEELVVIDLQTAGWPPVQLPYLASLHCSAITCSHHVSNIPLKLWERIIAAGSRQNAHFSTMEWPIDGGTSLTPAPPQRDLLLTGHEDGTVRFWDASGVCLRLLYKLSTVRVFLTDTDPNENFSAQGEDEWPPLRKVGSFDPYSDDPRLGIQKIFLCKYSGYLAVAGTAGQVLVLELNDEAAEQAVEQVEADLLQDQEGYRWKGHERLAARSGPVRFEPGFQPFVLVQCQPPAVVTSLALHSEWRLVAFGTSHGFGLFDHQQRRQVFVKCTLHPSDQLALEGPLSRVKSLKKSLRQSFRRMRRSRVSSRKRHPAGPPGEAQEGSAKAERPGLQNMELAPVQRKIEARSAEDSFTGFVRTLYFADTYLKDSSRHCPSLWAGTNGGTIYAFSLRVPPAERRMDEPVRAEQAKEIQLMHRAPVVGILVLDGHSVPLPEPLEVAHDLSKSPDMQGSHQLLVVSEEQFKVFTLPKVSAKLKLKLTALEGSRVRRVSVAHFGSRRAEDYGEHHLAVLTNLGDIQVVSLPLLKPQVRYSCIRREDVSGIASCVFTKYGQGFYLISPSEFERFSLSTKWLVEPRCLVDSAETKNHRPGNGAGPKKAPSRARNSGTQSDGEEKQPGLVMERALLSDERVLKEIQSTLEGDRGSGNWRSHRAAVGCSLSNGGAE

SEQ ID NO: 45390 - protein, 39 aa, Homo sapiens
  Payload ID: 9252
  Gene Symbol: LLGL2
  Gene Name: lethal giant larvae homolog 2 (Drosophila)
  ENSP ID: ENSP00000461953
MRRFLRPGHDPVRERLKRDLFQFNKTVEHGFPHQPSALG

SEQ ID NO: 45391 - protein, 62 aa, Homo sapiens
  Payload ID: 9252
  Gene Symbol: LLGL2
  Gene Name: lethal giant larvae homolog 2 (Drosophila)
  ENSP ID: ENSP00000462439
LVDSAETKNHRPGNGAGPKKAPSRARNSGTQSDGEALGPGLPHPDLSKERESQAEEGPGGAP

SEQ ID NO: 45392 - protein, 105 aa, Homo sapiens
  Payload ID: 9252
  Gene Symbol: LLGL2
  Gene Name: lethal giant larvae homolog 2 (Drosophila)
  ENSP ID: ENSP00000463150
  MOD_RES (1)..(1): Any amino acid
XRDLLLTGWVLPTGTRTARCGSGMPRVSACGCSTNSALCACSSPTRTPTRTSVPRARTSGPHSARWAPLTPTVMTPGWASRRSSSASTAATWLWQARQGRCWYWN

SEQ ID NO: 45393 - protein, 139 aa, Homo sapiens
  Payload ID: 9252
  Gene Symbol: LLGL2
  Gene Name: lethal giant larvae homolog 2 (Drosophila)
  ENSP ID: ENSP00000463390
MRRFLRPGHDPVRERLKRDLFQFNKTVEHGFPHQPSALGYSPSLRILAIGTRSGAIKLYGAPGVEFMGLHQENNAVTQIHLLPGQCQLVTLLDDNSLHLWSLKVKGGASELQEDESFTLRGPPGAAPSATQITVVLPHS

SEQ ID NO: 45394 - protein, 86 aa, Homo sapiens
  Payload ID: 9252
  Gene Symbol: LLGL2
  Gene Name: lethal giant larvae homolog 2 (Drosophila)
  ENSP ID: ENSP00000463501
  MOD_RES (1)..(1): Any amino acid
XTRILWLTTRQGLPFTIFQGGMPRASYGDRHCISVIHDGQQTAFDFTSRVIGFTVLTEADPAATVGADHCRRQPAERTLLHHGVAN

SEQ ID NO: 45395 - protein, 103 aa, Homo sapiens
  Payload ID: 9252
  Gene Symbol: LLGL2
  Gene Name: lethal giant larvae homolog 2 (Drosophila)
  ENSP ID: ENSP00000463721
MRRFLRPGHDPVRERLKRDLFQFNKTVEHGFPHQPSALGYSPSLRILAIGTRSGAIKLYGAPGVEFMGLHQENNAVTQIHLLPGQCQLVTLLDDNSLHLWSLK

SEQ ID NO: 45396 - protein, 1019 aa, Homo sapiens
  Payload ID: 9252
  Gene Symbol: LLGL2
  Gene Name: lethal giant larvae homolog 2 (Drosophila)
  ENSP ID: ENSP00000464397
MRRFLRPGHDPVRERLKRDLFQFNKTVEHGFPHQPSALGYSPSLRILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTESGNVFVVQLPAFRALEDRTISSDAVLQRLPEEARHRRVFEMVEALQEHPRDPNQILIGYSRGLVVIWDLQGSRVLYHFLSSQQLENIWWQRDGRLLVSCHSDGSYCQWPVSSEAQQPEPLRSLVPYGPFPCKAITRILWLTTRQGLPFTIFQGGMPRASYGDRHCISVIHDGQQTAFDFTSRVIGFTVLTEADPAATFDDPYALVVLAEEELVVIDLQTAGWPPVQLPYLASLHCSAITCSHHVSNIPLKLWERIIAAGSRQNAHFSTMEWPIDGGTSLTPAPPQRDLLLTGHEDGTVRFWDASGVCLRLLYKLSTVRVFLTDTDPNENFSAQGEDEWPPLRKVGSFDPYSDDPRLGIQKIFLCKYSGYLAVAGTAGQVLVLELNDEAAEQAVEQVEADLLQDQEGYRWKGHERLAARSGPVRFEPGFQPFVLVQCQPPAVVTSLALHSEWRLVAFGTSHGFGLFDHQQRRQVFVKCTLHPSDQLALEGPLSRVKSLKKSLRQSFRRMRRSRVSSRKRHPAGPPGEAQEGSAKAERPGLQNMELAPVQRKIEARSAEDSFTGFVRTLYFADTYLKDSSRHCPSLWAGTNGGTIYAFSLRVPPAERRMDEPVRAEQAKEIQLMHRAPVVGILVLDGHSVPLPEPLEVAHDLSKSPDMQGSHQLLVVSEEQFKVFTLPKVSAKLKLKLTALEGSRVRRVSVAHFGSRRAEDYGEHHLAVLTNLGDIQVVSLPLLKPQVRYSCIRREDVSGIASCVFTKYGQGFYLISPSEFERFSLSTKWLVEPRCLVDSAETKNHRPGNGAGPKKAPSRARNSGTQSDGEEKQPGLVMERALLSDERVLKEIQSTLEGDRGSGNWRSHRAAVGCSLSNGGE

SEQ ID NO: 45397 - protein, 105 aa, Homo sapiens
  Payload ID: 9252
  Gene Symbol: LLGL2
  Gene Name: lethal giant larvae homolog 2 (Drosophila)
  ENSP ID: ENSP00000464451
MRRFLRPGHDPVRERLKRDLFQFNKTVEHGFPHQPSALGYSPSLRILAIGTRSGAIKLYGAPGVEFMGLHQENNAVTQIHLLPGQCQLVTLLDDNSLHLWSLKVK

SEQ ID NO: 45398 - protein, 156 aa, Homo sapiens
  Payload ID: 9252
  Gene Symbol: LLGL2
  Gene Name: lethal giant larvae homolog 2 (Drosophila)
  ENSP ID: ENSP00000464483
MYFDRFDLDTIATTVLSIFGEAACPETVEHGFPHQPSALGYSPSLRILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTESGNVFV

SEQ ID NO: 45399 - protein, 150 aa, Homo sapiens
  Payload ID: 9252
  Gene Symbol: LLGL2
  Gene Name: lethal giant larvae homolog 2 (Drosophila)
  ENSP ID: ENSP00000464598
MRRFLRPGHDPVRERLKRDLFQFNKTVEHGFPHQPSALGYSPSLRILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTES

SEQ ID NO: 45400 - protein, 356 aa, Homo sapiens; identical to SEQ ID NO: 45388
  Payload ID: 9252
  Gene Symbol: LLGL2
  Gene Name: lethal giant larvae homolog 2 (Drosophila)
  Uniprot ID: Q6P1M3
  ENSP ID: ENSP00000464603

SEQ ID NO: 45401 - protein, 360 aa, Homo sapiens
  Payload ID: 9253
  Gene Symbol: LETMD1
  Gene Name: LETM1 domain containing 1
  Uniprot ID: Q6P1Q0
  ENSP ID: ENSP00000262055
MALSRVCWARSAVWGSAVTPGHFVTRRLQLGRSGLAWGAPRSSKLHLSPKADVKNLMSYVVTKTKAINGKYHRFLGRHFPRFYVLYTIFMKGLQMLWADAKKARRIKTNMWKHNIKFHQLPYREMEHLRQFRQDVTKCLFLGIISIPPFANYLVFLLMYLFPRQLLIRHFWTPKQQTDFLDIYHAFRKQSHPEIISYLEKVIPLISDAGLRWRLTDLCTKIQRGTHPAIHDILALRECFSNHPLGMNQLQALHVKALSRAMLLTSYLPPPLLRHRLKTHTTVIHQLDKALAKLGIGQLTAQEVKSACYLRGLNSTHIGEDRCRTWLGEWLQISCSLKEAELSLLLHNVVLLSTNYLGTRR

SEQ ID NO: 45402 - protein, 147 aa, Homo sapiens
  Payload ID: 9253
  Gene Symbol: LETMD1
  Gene Name: LETM1 domain containing 1
  ENSP ID: ENSP00000369478
MALSRVCWARSAVWGSAVTPGHFVTRRLQLGRSGLAWGAPRSSKLHLSPKADVKNLMSYVVTKTKAINGKYHRFLGRHFPRFYVLYTIFMKESLEPGHASHILPASSLVETSFEDSYNCDSPTGQGFGKAGDWPADCSGSKIGPFLF

SEQ ID NO: 45403 - protein, 373 aa, Homo sapiens
  Payload ID: 9253
  Gene Symbol: LETMD1
  Gene Name: LETM1 domain containing 1
  Uniprot ID: Q6P1Q0
  ENSP ID: ENSP00000389903
MALSRVCWARSAVWGSAVTPGHFVTRRLQLGRSGLAWGAPRSSKLHLSPKADVKNLMSYVVTKTKAINGKYHRFLGRHFPRFYVLYTIFMKGLQMLWADAKKARRIKTNMWKHNIKFHQLPYREMEHLRQVWARGRYPEVHGEFRQDVTKCLFLGIISIPPFANYLVFLLMYLFPRQLLIRHFWTPKQQTDFLDIYHAFRKQSHPEIISYLEKVIPLISDAGLRWRLTDLCTKIQRGTHPAIHDILALRECFSNHPLGMNQLQALHVKALSRAMLLTSYLPPPLLRHRLKTHTTVIHQLDKALAKLGIGQLTAQEVKSACYLRGLNSTHIGEDRCRTWLGEWLQISCSLKEAELSLLLHNVVLLSTNYLGTRR

SEQ ID NO: 45404 - protein, 110 aa, Homo sapiens
  Payload ID: 9253
  Gene Symbol: LETMD1
  Gene Name: LETM1 domain containing 1
  ENSP ID: ENSP00000446551
  MOD_RES (1)..(1): Any amino acid
XMSYVVTKTKAINGKYHRFLGRHFPRFYVLYTIFMKESLEPGHASHILPASSLVETSFEDSYNCDSPTGQGFGKAGDWPADCSGSKIEAELSLLLHNVVLLSTNYLGTRR

SEQ ID NO: 45405 - protein, 290 aa, Homo sapiens
  Payload ID: 9253
  Gene Symbol: LETMD1
  Gene Name: LETM1 domain containing 1
  ENSP ID: ENSP00000446862
MRLRTNATSSKLHLSPKADVKNLMSYVVTKTKAINGKYHRFLGRHFPRFYVLYTIFMKGLQMLWADAKKARRIKTNMWKHNIKFHQLPYREMEHLRQFRQDVTKCLFLGIISIPPFANYLVFLLMYLFPRQLLIRHFWTPKQQTDFLDIYHAFRKQSHPEIISYLEKVIPLISDAGLRWRLTDLCTKIQRGTHPAIHDILALRECFSNHPLGMNQLQALHVKALSRAMLLTSYLPPPLLRHRLKTHTTVIHQLDKALAKLGIGQLTAQEVKSACYLRGLNSTHIGEDRCR

SEQ ID NO: 45406 - protein, 98 aa, Homo sapiens
  Payload ID: 9253
  Gene Symbol: LETMD1
  Gene Name: LETM1 domain containing 1
  ENSP ID: ENSP00000446967
  MOD_RES (1)..(1): Any amino acid
XLALRECFSNHPLGMNQLQALHVKALSRAMLLTSYLPPPLLRHRLKTHTTVIHQLDKALAKLGIGQLTAQEVKSKLSCLSCCTTWSCSPPTTLGQGAE

SEQ ID NO: 45407 - protein, 155 aa, Homo sapiens
  Payload ID: 9253
  Gene Symbol: LETMD1
  Gene Name: LETM1 domain containing 1
  Uniprot ID: Q6P1Q0
  ENSP ID: ENSP00000447047
MALSRVCWARSAVWGSAVTPGHFVTRRLQLGRSGLAWGAPRSSKLHLSPKADVKNLMSYVVTKTKAINGKYHRFLGRHFPRFYVLYTIFMKESLEPGHASHILPASSLVETSFEDSYNCDSPTGQGFGKAGDWPADCSGSKIGLLSPWPEFYAYW

SEQ ID NO: 45408 - protein, 184 aa, Homo sapiens
  Payload ID: 9253
  Gene Symbol: LETMD1
  Gene Name: LETM1 domain containing 1
  ENSP ID: ENSP00000447166
MALSRVCWARSAVWGSAVTPGHFVTRRLQLGRSGLAWGAPRSSKLHLSPKADVKNLMSYVVTKTKAINGKYHRFLGRHFPRFYVLYTIFMKGLRWRLTDLCTKIQRGTHPAIHDILALRECFSNHPLGMNQLQALHVKALSRAMLLTSYLPPPLLRHRLKTHTTVIHQLDKALAKLGIGQLTAQ

SEQ ID NO: 45409 - protein, 236 aa, Homo sapiens
  Payload ID: 9253
  Gene Symbol: LETMD1
  Gene Name: LETM1 domain containing 1
  ENSP ID: ENSP00000447419
MALSRVCWARSAVWGSAVTPGHFVTRRLQLGRSGLAWGAPRSSKLHLSPKADVKNLMSYVVTKTKAINGKYHRFLGRHFPRFYVLYTIFMKGLQMLWADAKKARRIKTNMWKHNIKFHQLPYREMEHLRQKALSRAMLLTSYLPPPLLRHRLKTHTTVIHQLDKALAKLGIGQLTAQEVKSACYLRGLNSTHIGEDRCRTWLGEWLQISCSLKEAELSLLLHNVVLLSTNYLGTRR

SEQ ID NO: 45410 - protein, 43 aa, Homo sapiens
  Payload ID: 9253
  Gene Symbol: LETMD1
  Gene Name: LETM1 domain containing 1
  ENSP ID: ENSP00000447420
MALSRVCWARSAVWGSAVTPGHFVTRRLQLGRSGLAWGAPRKP

SEQ ID NO: 45411 - protein, 144 aa, Homo sapiens
  Payload ID: 9253
  Gene Symbol: LETMD1
  Gene Name: LETM1 domain containing 1
  ENSP ID: ENSP00000448110
MALSRVCWARSAVWGSAVTPGHFVTRRLQLGRSGLAWGAPRSSKLHLSPKADVKNLMSYVVTKTKAINGKYHRFLGRHFPRFYVLYTIFMKGLQMLWADAKKARRIKTNMWKHNIKFHQLPYREMEHLRQKALSRAMLLTSYLP

SEQ ID NO: 45412 - protein, 158 aa, Homo sapiens
  Payload ID: 9253
  Gene Symbol: LETMD1
  Gene Name: LETM1 domain containing 1
  ENSP ID: ENSP00000448222
MSYVVTKTKAINGKYHRFLGRHFPRFYVLYTIFMKVPPRRHQVSFPRYYFHSTFCQLPGLLANRGTHPAIHDILALRECFSNHPLGMNQLQALHVKALSRAMLLTSYLPPPLLRHRLKTHTTVIHQLDKALAKLGIGQLTAQEVKSACYLRGLNSTHI

SEQ ID NO: 45413 - protein, 138 aa, Homo sapiens
  Payload ID: 9253
  Gene Symbol: LETMD1
  Gene Name: LETM1 domain containing 1
  ENSP ID: ENSP00000448442
MALSRVCWARSAVWGSAVTPGHFVTRRLQLGRSGLAWGAPRSSKLHLSPKADVKNLMSYVVTKTKAINGKYHRFLGRHFPRFYVLYTIFMKVPPRRHQVSFPRYYFHSTFCQLPGLLANVPVSQATTDQAFLDPKTTN

SEQ ID NO: 45414 - protein, 99 aa, Homo sapiens
  Payload ID: 9253
  Gene Symbol: LETMD1
  Gene Name: LETM1 domain containing 1
  ENSP ID: ENSP00000448800
MALSRVCWARSAVWGSAVTPGHFVTRRLQLGRSGLAWGAPRSSKLHLSPKADVKNLMSYVVTKTKAINGKYHRFLGRHFPRFYVLYTIFMKGRIADVMG

SEQ ID NO: 45415 - protein, 43 aa, Homo sapiens
  Payload ID: 9253
  Gene Symbol: LETMD1
  Gene Name: LETM1 domain containing 1
  ENSP ID: ENSP00000449681
MSYVVTKTKAINGKYHRFLGRHFPRFYVLYTIFMKGRIADVMG

SEQ ID NO: 45416 - protein, 260 aa, Homo sapiens
  Payload ID: 9253
  Gene Symbol: LETMD1
  Gene Name: LETM1 domain containing 1
  ENSP ID: ENSP00000449896
MALSRVCWARSAVWGSAVTPGHFVTRRLQLGRSGLAWGAPRSSKLHLSPKADVKNLMSYVVTKTKAINGKYHRFLGRHFPRFYVLYTIFMKGIISIPPFANYLVFLLMYLFPRQLLIRHFWTPKQQTDFLDIYHAFRKQSHPEIISYLEKVIPLISDAGLRWRLTDLCTKIQRGTHPAIHDILALRECFSNHPLGMNQLQALHVKALSRAMLLTSYLPPPLLRHRLKTHTTVIHQLDKALAKLGIGQLTAQEVKSACYLR

SEQ ID NO: 45417 - protein, 135 aa, Homo sapiens
  Payload ID: 9253
  Gene Symbol: LETMD1
  Gene Name: LETM1 domain containing 1
  ENSP ID: ENSP00000450082
MALSRVCWARSAVWGSAVTPGHFVTRRLQLGRSGLAWGAPRLFDLPCRSSKLHLSPKADVKNLMSYVVTKTKAINGKYHRFLGRHFPRFYVLYTIFMKGLQMLWADAKKARRIKTNMWKHNIKFHQLPYREMEHL

SEQ ID NO: 45418 - protein, 304 aa, Homo sapiens
  Payload ID: 9253
  Gene Symbol: LETMD1
  Gene Name: LETM1 domain containing 1
  Uniprot ID: Q6P1Q0
  ENSP ID: ENSP00000450163
MSYVVTKTKAINGKYHRFLGRHFPRFYVLYTIFMKGLQMLWADAKKARRIKTNMWKHNIKFHQLPYREMEHLRQFRQDVTKCLFLGIISIPPFANYLVFLLMYLFPRQLLIRHFWTPKQQTDFLDIYHAFRKQSHPEIISYLEKVIPLISDAGLRWRLTDLCTKIQRGTHPAIHDILALRECFSNHPLGMNQLQALHVKALSRAMLLTSYLPPPLLRHRLKTHTTVIHQLDKALAKLGIGQLTAQEVKSACYLRGLNSTHIGEDRCRTWLGEWLQISCSLKEAELSLLLHNVVLLSTNYLGTRR

SEQ ID NO: 45419 - protein, 144 aa, Homo sapiens
  Payload ID: 9253
  Gene Symbol: LETMD1
  Gene Name: LETM1 domain containing 1
  ENSP ID: ENSP00000450251
  MOD_RES (1)..(1): Any amino acid
XHAFRKQSHPEIISYLEKVIPLISDAGLRWRLTDLCTKKALSRAMLLTSYLPPPLLRHRLKTHTTVIHQLDKALAKLGIGQLTAQEVKSACYLRGLNSTHIGEDRCRTWLGEWLQISCSLKEAELSLLLHNVVLLSTNYLGTRR

SEQ ID NO: 45420 - protein, 179 aa, Homo sapiens
  Payload ID: 9253
  Gene Symbol: LETMD1
  Gene Name: LETM1 domain containing 1
  ENSP ID: ENSP00000450275
MALSRVCWARSAVWGSAVTPGHFVTRRLQLGRSGLAWGAPRSSKLHLSPKADVKNLMSYVVTKTKAINGKYHRFLGRHFPRFYVLYTIFMKVPPRRHQVSFPRYYFHSTFCQLPGLLANIQRGTHPAIHDILALRECFSNHPLGMNQLQALHVKALSRAMLLTSYLPPPLLRHRLKTHT

SEQ ID NO: 45421 - protein, 243 aa, Homo sapiens
  Payload ID: 9253
  Gene Symbol: LETMD1
  Gene Name: LETM1 domain containing 1
  ENSP ID: ENSP00000450333
MALSRVCWARSAVWGSAVTPGHFVTRRLQLGRSGLAWGAPRYLFPRQLLIRHFWTPKQQTDFLDIYHAFRKQSHPEIISYLEKVIPLISDAGLRWRLTDLCTKIQRGTHPAIHDILALRECFSNHPLGMNQLQALHVKALSRAMLLTSYLPPPLLRHRLKTHTTVIHQLDKALAKLGIGQLTAQEVKSACYLRGLNSTHIGEDRCRTWLGEWLQISCSLKEAELSLLLHNVVLLSTNYLGTRR

SEQ ID NO: 45422 - protein, 41 aa, Homo sapiens
  Payload ID: 9253
  Gene Symbol: LETMD1
  Gene Name: LETM1 domain containing 1
  ENSP ID: ENSP00000450390
MALSRVCWARSAVWGSAVTPGHFVTRRLQLGRSGLAWGAPR

SEQ ID NO: 45423 - protein, 109 aa, Homo sapiens
  Payload ID: 9253
  Gene Symbol: LETMD1
  Gene Name: LETM1 domain containing 1
  ENSP ID: ENSP00000450391
MNQLQALHVKALSRAMLLTSYLPPPLLRHRLKTHTTVIHQLDKALAKLGIGQLTAQEVKSACYLRGLNSTHIGEDRCRTWLGEWLQISCSLKEAELSLLLHNVVLLSTN

SEQ ID NO: 45424 - protein, 519 aa, Homo sapiens
  Payload ID: 9254
  Gene Symbol: LAP3
  Gene Name: leucine aminopeptidase 3
  Uniprot ID: P28838
  ENSP ID: ENSP00000226299
MFLLPLPAAGRVVVRRLAVRRFGSRSLSTADMTKGLVLGIYSKEKEDDVPQFTSAGENFDKLLAGKLRETLNISGPPLKAGKTRTFYGLHQDFPSVVLVGLGKKAAGIDEQENWHEGKENIRAAVAAGCRQIQDLELSSVEVDPCGDAQAAAEGAVLGLYEYDDLKQKKKMAVSAKLYGSGDQEAWQKGVLFASGQNLARQLMETPANEMTPTRFAEIIEKNLKSASSKTEVHIRPKSWIEEQAMGSFLSVAKGSDEPPVFLEIHYKGSPNANEPPLVFVGKGITFDSGGISIKASANMDLMRADMGGAATICSAIVSAAKLNLPINIIGLAPLCENMPSGKANKPGDVVRAKNGKTIQVDNTDAEGRLILADALCYAHTFNPKVILNAATLTGAMDVALGSGATGVFTNSSWLWNKLFEASIETGDRVWRMPLFEHYTRQVVDCQLADVNNIGKYRSAGACTAAAFLKEFVTHPKWAHLDIAGVMTNKDEVPYLRKGMTGRPTRTLIEFLLRFSQDNA

SEQ ID NO: 45425 - protein, 119 aa, Homo sapiens
  Payload ID: 9254
  Gene Symbol: LAP3
  Gene Name: leucine aminopeptidase 3
  ENSP ID: ENSP00000423350
  MOD_RES (1)..(1): Any amino acid
XVVVRRLAVRRFGSRSLSTADMTKGLVLGIYSKEKEDDVPQFTSAGENFDKLLAGKLRETLNISGPPLKAGKTRTFYGLHQRGAGRFKTWSSRLWRWIPVETLRLLRRERCLVSMNTMT

SEQ ID NO: 45426 - protein, 208 aa, Homo sapiens
  Payload ID: 9254
  Gene Symbol: LAP3
  Gene Name: leucine aminopeptidase 3
  ENSP ID: ENSP00000424724
QKKKMAVSAKLYGSGDQEAWQKGVLFASGQNLARQLMETPANEMTPTRFAEIIEKNLKSASSKTEVHIRPKSWIEEQAMGSFLSVAKGSDEPPVFLEIHYKGSPNANEPPLVFVGKGITFDSGGISIKASANMDLMRADMGGAATICSAIVSAAKLNLPINIIGAMDVALGSGATGVFTNSSWLWNKLFEASIETGDRVWRMPLFEHY

SEQ ID NO: 45427 - protein, 488 aa, Homo sapiens
  Payload ID: 9254
  Gene Symbol: LAP3
  Gene Name: leucine aminopeptidase 3
  Uniprot ID: P28838
  ENSP ID: ENSP00000476028
MTKGLVLGIYSKEKEDDVPQFTSAGENFDKLLAGKLRETLNISGPPLKAGKTRTFYGLHQDFPSVVLVGLGKKAAGIDEQENWHEGKENIRAAVAAGCRQIQDLELSSVEVDPCGDAQAAAEGAVLGLYEYDDLKQKKKMAVSAKLYGSGDQEAWQKGVLFASGQNLARQLMETPANEMTPTRFAEIIEKNLKSASSKTEVHIRPKSWIEEQAMGSFLSVAKGSDEPPVFLEIHYKGSPNANEPPLVFVGKGITFDSGGISIKASANMDLMRADMGGAATICSAIVSAAKLNLPINIIGLAPLCENMPSGKANKPGDVVRAKNGKTIQVDNTDAEGRLILADALCYAHTFNPKVILNAATLTGAMDVALGSGATGVFTNSSWLWNKLFEASIETGDRVWRMPLFEHYTRQVVDCQLADVNNIGKYRSAGACTAAAFLKEFVTHPKWAHLDIAGVMTNKDEVPYLRKGMTGRPTRTLIEFLLRFSQDNA

SEQ ID NO: 45428 - protein, 519 aa, Homo sapiens; identical to SEQ ID NO: 45424
  Payload ID: 9254
  Gene Symbol: LAP3
  Gene Name: leucine aminopeptidase 3
  Uniprot ID: P28838
  ENSP ID: ENSP00000481000

SEQ ID NO: 45429 - protein, 101 aa, Homo sapiens
  Payload ID: 9255
  Gene Symbol: LCMT1
  Gene Name: leucine carboxyl methyltransferase 1
  ENSP ID: ENSP00000370349
MATRQRESSITSCCSTSSCDADDEGVRGTCEDASLCKRTAISSARQHSPPHCPTLGGKSFHLGHSDRLDSEVLLPRAHGNLLQSPGFAEWEEVCSKHWLLA

SEQ ID NO: 45430 - protein, 279 aa, Homo sapiens
  Payload ID: 9255
  Gene Symbol: LCMT1
  Gene Name: leucine carboxyl methyltransferase 1
  Uniprot ID: Q9UIC8
  ENSP ID: ENSP00000370353
MATRQRESSITSCCSTSSCDADDEGVRGTCEDASLCKRFAVSIGYWHDPYIQHFVRLSKERKAPEINRGYFARVHGVSQLIKAFLRKTECHCQIVNLGAGMDTTFWRLKDEDLLPSKYFEVDFPMIVTRKLHSIKLPTLLIAECVLVYMTPEQSANLLKWAANSFERAMFINYEQVNMGDRFGQIMIENLRRRQCDLAGVETCKSLESQKERLLSNGWETASAVDMMELYNRLPRAEVSRIESLEFLDEMELLEQLMRHYCLCWATKGGNELGLKEITY

SEQ ID NO: 45431 - protein, 334 aa, Homo sapiens
  Payload ID: 9255
  Gene Symbol: LCMT1
  Gene Name: leucine carboxyl methyltransferase 1
  Uniprot ID: Q9UIC8
  ENSP ID: ENSP00000382021
MATRQRESSITSCCSTSSCDADDEGVRGTCEDASLCKRFAVSIGYWHDPYIQHFVRLSKERKAPEINRGYFARVHGVSQLIKAFLRKTECHCQIVNLGAGMDTTFWRLKDEDLLPSKYFEVDFPMIVTRKLHSIKCKPPLSSPILELHSEDTLQMDGHILDSKRYAVIGADLRDLSELEEKLKKCNMNTQLPTLLIAECVLVYMTPEQSANLLKWAANSFERAMFINYEQVNMGDRFGQIMIENLRRRQCDLAGVETCKSLESQKERLLSNGWETASAVDMMELYNRLPRAEVSRIESLEFLDEMELLEQLMRHYCLCWATKGGNELGLKEITY

SEQ ID NO: 45432 - protein, 111 aa, Homo sapiens
  Payload ID: 9255
  Gene Symbol: LCMT1
  Gene Name: leucine carboxyl methyltransferase 1
  ENSP ID: ENSP00000457741
MATRQRESSITSCCSTSSCDADDEGVRGTCEDASLCKRFAVSIGYWHDPYIQHFVRLSKERKAPEINRGKIFCSSPWCQSAYKGISTEDRMSLSNCQPWGRHGYHLLEIKG

SEQ ID NO: 45433 - protein, 93 aa, Homo sapiens
  Payload ID: 9255
  Gene Symbol: LCMT1
  Gene Name: leucine carboxyl methyltransferase 1
  ENSP ID: ENSP00000459604
  MOD_RES (1)..(1): Any amino acid
XLPTLLIAECVLVYMTPEQSANLLKWAANSFERAMFINYEQVNMGDRFGQIMIENLRRRQCDLAGVETCKSLESQVREQGLGYPFGPLVNQDI

SEQ ID NO: 45434 - protein, 119 aa, Homo sapiens
  Payload ID: 9255
  Gene Symbol: LCMT1
  Gene Name: leucine carboxyl methyltransferase 1
  ENSP ID: ENSP00000459851
SSCDADDEGVRGTCEDASLCKRFAVSIGYWHDPYIQHFVRLSKERKAPEINRGYFARVHGVSQLIKAFLRKTECHCQIVNLGAGMDTTFWRLKDEDLLPSKYFEVDFPMIVTRKLHSIK

SEQ ID NO: 45435 - protein, 158 aa, Homo sapiens
  Payload ID: 9255
  Gene Symbol: LCMT1
  Gene Name: leucine carboxyl methyltransferase 1
  ENSP ID: ENSP00000461100
  MOD_RES (1)..(1): Any amino acid
XDLLPSKYFEVDFPMIVTRKLHSIKCKPPLSSPILELHSEDTLQMDGHILDSKRYAVIGADLRDLSELEEKLKKCNMNTQLPTLLIAECVLVYMTPEQSANLLKWAANSFERAMFINYEQVNMGDRFGQIMIENLRRRQCDLAGVETCKSLESQDRIT

SEQ ID NO: 45436 - protein, 138 aa, Homo sapiens
  Payload ID: 9255
  Gene Symbol: LCMT1
  Gene Name: leucine carboxyl methyltransferase 1
  ENSP ID: ENSP00000461754
  MOD_RES (1)..(1): Any amino acid
XRAMFINYEQVNMGDRFGQIMIENLRRRQCDLAGVETCKSLESQKERLLSNGWETASAVDMMELYNRLPRAEVSRAEGDNLLICRRLMPSQKPKPLALLEETCKLPERWAGLVRRSHPTLLRSLGHYSGRTCSSSCSC

SEQ ID NO: 45437 - protein, 686 aa, Homo sapiens
  Payload ID: 9256
  Gene Symbol: LCMT2
  Gene Name: leucine carboxyl methyltransferase 2
  Uniprot ID: O60294
  ENSP ID: ENSP00000307214
MGPRSRERRAGAVQNTNDSSALSKRSLAARGYVQDPFAALLVPGAARRAPLIHRGYYVRARAVRHCVRAFLEQIGAPQAALRAQILSLGAGFDSLYFRLKTAGRLARAAVWEVDFPDVARRKAERIGETPELCALTGPFERGEPASALCFESADYCILGLDLRQLQRVEEALGAAGLDAASPTLLLAEAVLTYLEPESAAALIAWAAQRFPNALFVVYEQMRPQDAFGQFMLQHFRQLNSPLHGLERFPDVEAQRRRFLQAGWTACGAVDMNEFYHCFLPAEERRRVENIEPFDEFEEWHLKCAHYFILAASRGDTLSHTLVFPSSEAFPRVNPASPSGVFPASVVSSEGQVPNLKRYGHASVFLSPDVILSAGGFGEQEGRHCRVSQFHLLSRDCDSEWKGSQIGSCGTGVQWDGRLYHTMTRLSESRVLVLGGRLSPVSPALGVLQLHFFKSEDNNTEDLKVTITKAGRKDDSTLCCWRHSTTEVSCQNQEYLFVYGGRSVVEPVLSDWHFLHVGTMAWVRIPVEGEVPEARHSHSACTWQGGALIAGGLGASEEPLNSVLFLRPISCGFLWESVDIQPPITPRYSHTAHVLNGKLLLVGGIWIHSSSFPGVTVINLTTGLSSEYQIDTTYVPWPLMLHNHTSILLPEEQQLLLLGGGGNCFSFGTYFNPHTVTLDLSSLSAGQ

SEQ ID NO: 45438 - protein, 39 aa, Homo sapiens
  Payload ID: 9256
  Gene Symbol: LCMT2
  Gene Name: leucine carboxyl methyltransferase 2
  ENSP ID: ENSP00000457403
MGPRSRERRAGAVQNTNDSSALSKRSLAARGRTPAGGKY

SEQ ID NO: 45439 - protein, 239 aa, Homo sapiens
  Payload ID: 9257
  Gene Symbol: LURAP1
  Gene Name: leucine rich adaptor protein 1
  Uniprot ID: Q96LR2
  ENSP ID: ENSP00000361048
MEGTVESQTPDLRDVEGKVGRKTPEGLLRGLRGECELGTSGALLLPGASSTGHDLGDKIMALKMELAYLRAIDVKILQQLVTLNEGIEAVRWLLEERGTLTSHCSSLTSSQYSLTGGSPGRSRRGSWDSLPDTSTTDRLDSVSIGSFLDTVAPSELDEQGPPGAPRSEMDWAKVIAGGERARTEVDVAATRLGSLRAVWKPPGERLQGGPPESPEDESAKLGFEAHWFWEQCQDDVTFL

SEQ ID NO: 45440 - protein, 228 aa, Homo sapiens
  Payload ID: 9258
  Gene Symbol: LURAP1L
  Gene Name: leucine rich adaptor protein 1-like
  Uniprot ID: Q8IV03
  ENSP ID: ENSP00000321026
MEDSPLPDLRDIELKLGRKVPESLVRSLRGEEPVPRERDRDPCGGSGGGGGGGGGCSSSSSYCSFPPSLSSSSSSSPTSGSPRGSHSSALERLETKLHLLRQEMVNLRATDVRLMRQLLVINESIESIKWMIEEKATITSRGSSLSGSLCSLLESQSTSLRGSYNSLHDGSDGLDGISVGSYLDTLADDVPGHQTPSDLDQFSDSSLIEDSQALHKRPKLDSEYYCFG

SEQ ID NO: 45441 - protein, 46 aa, Homo sapiens
  Payload ID: 9259
  Gene Symbol: LRCOL1
  Gene Name: leucine rich colipase-like 1
  ENSP ID: ENSP00000477635
MAGPGWTLLLLLLLLLLLGSMAGYGPQKKLNLSHKKLLRKPKFEGW

SEQ ID NO: 45442 - protein, 159 aa, Homo sapiens
  Payload ID: 9259
  Gene Symbol: LRCOL1
  Gene Name: leucine rich colipase-like 1
  Uniprot ID: A6NCL2
  ENSP ID: ENSP00000479730
MAGPGWTLLLLLLLLLLLGSMAGYGPQKKLNLSHKGIGEPCRRHEECQSNCCTINSLAPHTLCTPKTIFLQCLPWRKPNGYRCSHDSECQSSCCVRNNSPQELCTPQSVFLQCVPWRKPNGDFCSSHQECHSQCCIQLREYSPFRCIPRTGILAQCLPL

SEQ ID NO: 45443 - protein, 61 aa, Homo sapiens
  Payload ID: 9259
  Gene Symbol: LRCOL1
  Gene Name: leucine rich colipase-like 1
  ENSP ID: ENSP00000481713
MAGPGWTLLLLLLLLLLLGSMAGYGPQKKLNLSHKPRAPSTDLPEPRQSGFVPETSQETQV

SEQ ID NO: 45444 - protein, 139 aa, Homo sapiens
  Payload ID: 9259
  Gene Symbol: LRCOL1
  Gene Name: leucine rich colipase-like 1
  ENSP ID: ENSP00000482471
MAGPGWTLLLLLLLLLLLGSMAGYGPQKKLNLSHKGIGEPCRRHEECQSNCCTINSLAPHTLCTPKTIFLQCLPWRKVSPMGTDARTTQSARAAAASATTARRSCARPKASSCSVCPGASPTATSAAAIRSVTASAASS

SEQ ID NO: 45445 - protein, 784 aa, Homo sapiens
  Payload ID: 9260
  Gene Symbol: LRRFIP1
  Gene Name: leucine rich repeat (in FLII) interacting protein 1
  Uniprot ID: Q32MZ4
  ENSP ID: ENSP00000244815
MTSPAAAQSREIDCLSPEAQKLAEARLAAKRAARAEAREIRMKELERQQKEEDSERYSRRSRRNTSASDEDERMSVGSRGSLRVEERPEKDFTEKGSRNMPGLSAATLASLGGTSSRRGSGDTSISIDTEASIREIKDSLAEVEEKYKKAMVSNAQLDNEKTNFMYQVDTLKDMLLELEEQLAESRRQYEEKNKEFEREKHAHSILQFQFAEVKEALKQREEMLEKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLENDDLSAPGREPGHFNPESREDTRGGNEKGKSKEDCTMS

SEQ ID NO: 45446 - protein, 752 aa, Homo sapiens
  Payload ID: 9260
  Gene Symbol: LRRFIP1
  Gene Name: leucine rich repeat (in FLII) interacting protein 1
  Uniprot ID: Q32MZ4
  ENSP ID: ENSP00000289175
MTSPAAAQSREIDCLSPEAQKLAEARLAAKRAARAEAREIRMKELERQQKEVEERPEKDFTEKGSRNMPGLSAATLASLGGTSSRRGSGDTSISIDTEASIREIKDSLAEVEEKYKKAMVSNAQLDNEKTNFMYQVDTLKDMLLELEEQLAESRRQYEEKNKEFEREKHAHSILQFQFAEVKEALKQREEMLEKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLENDDLSAPGREPGHFNPESREDTRGGNEKGKSKEDCTMS

SEQ ID NO: 45447 - protein, 640 aa, Homo sapiens
  Payload ID: 9260
  Gene Symbol: LRRFIP1
  Gene Name: leucine rich repeat (in FLII) interacting protein 1
  Uniprot ID: Q32MZ4
  ENSP ID: ENSP00000310109
MDMGTQGSGRKRLPNRERLTAEDDALNQIAREAEARLAAKRAARAEAREIRMKELERQQKEIYQVQKKYYGLDTKWGDIEQWMEDSERYSRRSRRNTSASDEDERMSVGSRGSLRSQPDLEYGGPYAWTNGYDGELYGSQSLNRRSGRPSCLYSAARPSGSYRASVLDEGSFGGTRRGSTSGSRAPSEYSGHLNSSSRASSRASSARASPVVEERPEKDFTEKGSRNMPGLSAATLASLGGTSSRRGSGDTSISIDTEASIREIKELNELKDQIQDVEGKYMQGLKEMKDSLAEVEEKYKKAMVSNAQLDNEKTNFMYQVDTLKDMLLELEEQLAESRRQYEEKNKEFEREKHAHSILQFQFAEVKEALKQREEMLEEIRQLQQKQASSIREISDLQETIEWKDKKIGALERQKEFFDSVRSERDDLREEVVMLKEELKKHGIILNSEIATNGETSDTLNNVGYQGPTKMTKEELNALKSTGDGTLDIRLKKLVDERECLLEQIKKLKGQLEERQKIGKLDNLRSEDDVLENGTDMHVMDLQRDANRQISDLKFKLAKSEQEITALEQNVIRLESQVSRYKSAAENAEKIEDELKAEKRKLQRELRSALDKTEELEVSNGHLVKRLEKMKANRSALLSQQ

SEQ ID NO: 45448 - protein, 808 aa, Homo sapiens
  Payload ID: 9260
  Gene Symbol: LRRFIP1
  Gene Name: leucine rich repeat (in FLII) interacting protein 1
  Uniprot ID: Q32MZ4
  ENSP ID: ENSP00000375857
MTSPAAAQSREIDCLSPEAQKLAEARLAAKRAARAEAREIRMKELERQQKEEDSERYSRRSRRNTSASDEDERMSVGSRGSLRVEERPEKDFTEKGSRNMPGLSAATLASLGGTSSRRGSGDTSISIDTEASIREIKELNELKDQIQDVEGKYMQGLKEMKDSLAEVEEKYKKAMVSNAQLDNEKTNFMYQVDTLKDMLLELEEQLAESRRQYEEKNKEFEREKHAHSILQFQFAEVKEALKQREEMLEKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLENDDLSAPGREPGHFNPESREDTRGGNEKGKSKEDCTMS

SEQ ID NO: 45449 - protein, 149 aa, Homo sapiens
  Payload ID: 9260
  Gene Symbol: LRRFIP1
  Gene Name: leucine rich repeat (in FLII) interacting protein 1
  ENSP ID: ENSP00000409431
MTSPAAAQSREIDCLSPEAQKLAEARLAAKRAARAEAREIRMKELERQQKEEDSERYSRRSRRNTSASDEDERMSVGSRGSLRTNGYDGELYGSQSLNRRSGRVEERPEKDFTEKGSRNMPGLSAATLASLGGTSSRRGSGDTSISIDT

SEQ ID NO: 45450 - protein, 721 aa, Homo sapiens
  Payload ID: 9261
  Gene Symbol: LRRFIP2
  Gene Name: leucine rich repeat (in FLII) interacting protein 2
  Uniprot ID: Q9Y608
  ENSP ID: ENSP00000338727
MGTPASGRKRTPVKDRFSAEDEALSNIAREAEARLAAKRAARAEARDIRMRELERQQKEYSLHSFDRKWGQIQKWLEDSERARYSHRSSHHRPYLGVEDALSIRSVGSHRYDMFKDRSSRLSSLNHSYSHSHGMKKRSSDSHKDLLSGLYFDQRNYSSLRHSKPTSAYYTRQSSSLYSDPLATYKSDRASPTANSGLLRSASLASLYNGGLYNPYGPRTPSECSYYSSRISSARSSPGFTNDDTASIVSSDRASRGRRESVVSAADYFSRSNRRGSVVSEVDDISIPDLSSLDEKSDKQYAENYTRPSSRNSASATTPLSGNSSRRGSGDTSSLIDPDTSLSELRDIYDLKDQIQDVEGRYMQGLKELKESLSEVEEKYKKAMVSNAQLDNEKNNLIYQVDTLKDVIEEQEEQMAEFYRENEEKSKELERQKHMCSVLQHKMEELKEGLRQRDELIEEKQRMQQKIDTMTKEVFDLQETLLWKDKKIGALEKQKEYIACLRNERDMLREELADLQETVKTGEKHGLVIIPDGTPNGDVSHEPVAGAITVVSQEAAQVLESAGEGPLDVRLRKLAGEKEELLSQIRKLKLQLEEERQKCSRNDGTVGDLAGLQNGSDLQFIEMQRDANRQISEYKFKLSKAEQDITTLEQSISRLEGQVLRYKTAAENAEKVEDELKAEKRKLQRELRTALDKIEEMEMTNSHLAKRLEKMKANRTALLAQQ

SEQ ID NO: 45451 - protein, 400 aa, Homo sapiens
  Payload ID: 9261
  Gene Symbol: LRRFIP2
  Gene Name: leucine rich repeat (in FLII) interacting protein 2
  Uniprot ID: Q9Y608
  ENSP ID: ENSP00000346349
MGTPASGRKRTPVKDRFSAEDEALSNIAREAEARLAAKRAARAEARDIRMRELERQQKELDEKSDKQYAENYTRPSSRNSASATTPLSGNSSRRGSGDTSSLIDPDTSLSELRESLSEVEEKYKKAMVSNAQLDNEKNNLIYQVDTLKDVIEEQEEQMAEFYRENEEKSKELERQKHMCSVLQHKMEELKEGLRQRDELIEKHGLVIIPDGTPNGDVSHEPVAGAITVVSQEAAQVLESAGEGPLDVRLRKLAGEKEELLSQIRKLKLQLEEERQKCSRNDGTVGDLAGLQNGSDLQFIEMQRDANRQISEYKFKLSKAEQDITTLEQSISRLEGQVLRYKTAAENAEKVEDELKAEKRKLQRELRTALDKIEEMEMTNSHLAKRLEKMKANRTALLAQQ

SEQ ID NO: 45452 - protein, 503 aa, Homo sapiens
  Payload ID: 9261
  Gene Symbol: LRRFIP2
  Gene Name: leucine rich repeat (in FLII) interacting protein 2
  Uniprot ID: Q9Y608
  ENSP ID: ENSP00000379705
MGTPASGRKRTPVKDRFSAEDEALSNIAREAEARLAAKRAARAEARDIRMRELERQQKEEDSERARYSHRSSHHRPYLGVEDALSIRSVGSHRNHSYSHSHGMKKRSSDSHKDLLASLYNGGLYNPYGPRTLDEKSDKQYAENYTRPSSRNSASATTPLSGNSSRRGSGDTSSLIDPDTSLSELRESLSEVEEKYKKAMVSNAQLDNEKNNLIYQVDTLKDVIEEQEEQMAEFYRENEEKSKELERQKHMCSVLQHKMEELKEGLRQRDELIEEKQRMQQKIDTMTKEVFDLQETLLWKDKKIGKHGLVIIPDGTPNGDVSHEPVAGAITVVSQEAAQVLESAGEGPLDVRLRKLAGEKEELLSQIRKLKLQLEEERQKCSRNDGTVGDLAGLQNGSDLQFIEMQRDANRQISEYKFKLSKAEQDITTLEQSISRLEGQVLRYKTAAENAEKVEDELKAEKRKLQRELRTALDKIEEMEMTNSHLAKRLEKMKANRTALLAQQ

SEQ ID NO: 45453 - protein, 59 aa, Homo sapiens
  Payload ID: 9261
  Gene Symbol: LRRFIP2
  Gene Name: leucine rich repeat (in FLII) interacting protein 2
  ENSP ID: ENSP00000391360
MGTPASGRKRTPVKDRFSAEDEALSNIAREAEARLAAKRAARAEARDIRMRELERQQKE

SEQ ID NO: 45454 - protein, 424 aa, Homo sapiens
  Payload ID: 9261
  Gene Symbol: LRRFIP2
  Gene Name: leucine rich repeat (in FLII) interacting protein 2
  Uniprot ID: Q9Y608
  ENSP ID: ENSP00000405480
MGTPASGRKRTPVKDRFSAEDEALSNIAREAEARLAAKRAARAEARDIRMRELERQQKELDEKSDKQYAENYTRPSSRNSASATTPLSGNSSRRGSGDTSSLIDPDTSLSELRDIYDLKDQIQDVEGRYMQGLKELKESLSEVEEKYKKAMVSNAQLDNEKNNLIYQVDTLKDVIEEQEEQMAEFYRENEEKSKELERQKHMCSVLQHKMEELKEGLRQRDELIEKHGLVIIPDGTPNGDVSHEPVAGAITVVSQEAAQVLESAGEGPLDVRLRKLAGEKEELLSQIRKLKLQLEEERQKCSRNDGTVGDLAGLQNGSDLQFIEMQRDANRQISEYKFKLSKAEQDITTLEQSISRLEGQVLRYKTAAENAEKVEDELKAEKRKLQRELRTALDKIEEMEMTNSHLAKRLEKMKANRTALLAQQ

SEQ ID NO: 45455 - protein, 225 aa, Homo sapiens
  Payload ID: 9261
  Gene Symbol: LRRFIP2
  Gene Name: leucine rich repeat (in FLII) interacting protein 2
  ENSP ID: ENSP00000409574
MGTPASGRKRTPVKDRFSAEDEALSNIAREAEARLAAKRAARAEARDIRMRELERQQKELDEKSDKQYAENYTRPSSRNSASATTPLSGNSSRRGSGDTSSLIDPDTSLSELRDIYDLKDQIQDVEGRYMQGLKELKESLSEVEEKYKKAMVSNAQLDNEKNNLIYQVDTLKDVIEEQEEQMAEFYRENEEKSKELERQKHMCSVLQHKMEELKEGLRQRDELIE

SEQ ID NO: 45456 - protein, 67 aa, Homo sapiens
  Payload ID: 9261
  Gene Symbol: LRRFIP2
  Gene Name: leucine rich repeat (in FLII) interacting protein 2
  ENSP ID: ENSP00000412206
MGTPASGRKRTPVKDRFSAEDEALSNIAREAEARLAAKRAARAEARDIRMRELERQQKEEDSERARY

SEQ ID NO: 45457 - protein, 182 aa, Homo sapiens
  Payload ID: 9261
  Gene Symbol: LRRFIP2
  Gene Name: leucine rich repeat (in FLII) interacting protein 2
  ENSP ID: ENSP00000413026
  MOD_RES (1)..(1): Any amino acid
XLDNEKNNLIYQVDTLKDVIEEQEEQMAEFYRENEEKSKELERQKHMCSVLQHKMEELKEGLRQRDELIEALEKQKEYIACLRNERDMLREELADLQETVKTGEKHGLVIIPDGTPNGDVSHEPVAGAITVVSQEAAQVLESAGEGPLDVRLRKLAGEKEELLSQIRKLKLQLEEERQKCSR

SEQ ID NO: 45458 - protein, 59 aa, Homo sapiens; identical to SEQ ID NO: 45453
  Payload ID: 9261
  Gene Symbol: LRRFIP2
  Gene Name: leucine rich repeat (in FLII) interacting protein 2
  ENSP ID: ENSP00000416013

SEQ ID NO: 45459 - protein, 424 aa, Homo sapiens; identical to SEQ ID NO: 45454
  Payload ID: 9261
  Gene Symbol: LRRFIP2
  Gene Name: leucine rich repeat (in FLII) interacting protein 2
  Uniprot ID: Q9Y608
  ENSP ID: ENSP00000416364

SEQ ID NO: 45460 - protein, 59 aa, Homo sapiens; identical to SEQ ID NO: 45453
  Payload ID: 9261
  Gene Symbol: LRRFIP2
  Gene Name: leucine rich repeat (in FLII) interacting protein 2
  ENSP ID: ENSP00000416907

SEQ ID NO: 45461 - protein, 1032 aa, Homo sapiens
  Payload ID: 9262
  Gene Symbol: LRRCC1
  Gene Name: leucine rich repeat and coiled-coil centrosomal protein 1
  Uniprot ID: Q9C099
  ENSP ID: ENSP00000353538
MEAAAAVVAAEAEVENEDGDSSCGDVCFMDKGLQSISELSLDSTLHAVNLHCNNISKIEAIDHIWNLQHLDLSSNQISRIEGLNTLTKLCTLNLSCNLITKVEGLEELINLTRLNVSYNHIDDLSGLIPLHGIKHKLRYIDLHSNRIDSIHHLLQCMVGLHFLTNLILEKDGDDNPVCRLPGYRAVILQTLPQLRILDCKNIFGEPVNLTEINSSQLQCLEGLLDNLVSSDSPLNISEDEIIDRMPVITAPIDELVPLEQFASTPSDAVLTSFMSVCQSSEPEKNNHENDLQNEIKLQKLDDQILQLLNETSNSIDNVLEKDPRPKRDTDITSESDYGNRKECNRKVPRRSKIPYDAKTIQTIKHHNKNYNSFVSCNRKMKPPYLKELYVSSSLANCPMLQESEKPKTEIIKVDQSHSEDNTYQSLVEQLDQEREKRWRAEQAENKLMDYIDELHKHANEKEDIHSLALLTTDRLKEIIFRERNSKGQLEVMVHKLQNEIKKLTVELMKAKDQQEDHLKHLRTLEKTLEKMERQKRQQQAAQIRLIQEVELKASAADREIYLLRTSLHREREQAQQLHQLLALKEQEHRKELETREFFTDADFQDALAKEIAKEEKKHEQMIKEYQEKIDVLSQQYMDLENEFRIALTVEARRFQDVKDGFENVATELAKSKHALIWAQRKENESSSLIKDLTCMVKEQKTKLAEVSKLKQETAANLQNQINTLEILIEDDKQKSIQIELLKHEKVQLISELAAKESLIFGLRTERKVWGHELAQQGSSLAQNRGKLEAQIESLSRENECLRKTNESDSDALRIKCKIIDDQTETIRKLKDCLQEKDEHIKRLQEKITEIEKCTQEQLDEKSSQLDEVLEKLERHNERKEKLKQQLKGKEVELEEIRKAYSTLNRKWHDKGELLCHLETQVKEVKEKFENKEKKLKAERDKSIELQKNAMEKLHSMDDAFKRQVDAIVEAHQAEIAQLANEKQKCIDSANLKVHQIEKEMRELLEETCKNKKTMEAKIKQLAFALNEIQQDM

SEQ ID NO: 45462 - protein, 1012 aa, Homo sapiens
  Payload ID: 9262
  Gene Symbol: LRRCC1
  Gene Name: leucine rich repeat and coiled-coil centrosomal protein 1
  Uniprot ID: Q9C099
  ENSP ID: ENSP00000394695
MLLKSIFIVYIFFYSISELSLDSTLHAVNLHCNNISKIEAIDHIWNLQHLDLSSNQISRIEGLNTLTKLCTLNLSCNLITKVEGLEELINLTRLNVSYNHIDDLSGLIPLHGIKHKLRYIDLHSNRIDSIHHLLQCMVGLHFLTNLILEKDGDDNPVCRLPGYRAVILQTLPQLRILDCKNIFGEPVNLTEINSSQLQCLEGLLDNLVSSDSPLNISEDEIIDRMPVITAPIDELVPLEQFASTPSDAVLTSFMSVCQSSEPEKNNHENDLQNEIKLQKLDDQILQLLNETSNSIDNVLEKDPRPKRDTDITSESDYGNRKECNRKVPRRSKIPYDAKTIQTIKHHNKNYNSFVSCNRKMKPPYLKELYVSSSLANCPMLQESEKPKTEIIKVDQSHSEDNTYQSLVEQLDQEREKRWRAEQAENKLMDYIDELHKHANEKEDIHSLALLTTDRLKEIIFRERNSKGQLEVMVHKLQNEIKKLTVELMKAKDQQEDHLKHLRTLEKTLEKMERQKRQQQAAQIRLIQEVELKASAADREIYLLRTSLHREREQAQQLHQLLALKEQEHRKELETREFFTDADFQDALAKEIAKEEKKHEQMIKEYQEKIDVLSQQYMDLENEFRIALTVEARRFQDVKDGFENVATELAKSKHALIWAQRKENESSSLIKDLTCMVKEQKTKLAEVSKLKQETAANLQNQINTLEILIEDDKQKSIQIELLKHEKVQLISELAAKESLIFGLRTERKVWGHELAQQGSSLAQNRGKLEAQIESLSRENECLRKTNESDSDALRIKCKIIDDQTETIRKLKDCLQEKDEHIKRLQEKITEIEKCTQEQLDEKSSQLDEVLEKLERHNERKEKLKQQLKGKEVELEEIRKAYSTLNRKWHDKGELLCHLETQVKEVKEKFENKEKKLKAERDKSIELQKNAMEKLHSMDDAFKRQVDAIVEAHQAEIAQLANEKQKCIDSANLKVHQIEKEMRELLEETCKNKKTMEAKIKQLAFALNEIQQDM
